United States Patent 11,931,406 (FLAVIVIRUS VACCINE) - sequence listing, part 52

SEQ ID NO: 18909 - RNA, 9879 nt, Artificial Sequence
  derived and/or modified CDS sequence (opt5) from DENV-1__FJ432744__SS-prME
agcgugaccaugcugcugaugcugaugcccacagcccuugcuuuccaccugacgacccggggcggggaaccucauaugaucgucuccaagcaggaacggggaaagucucuccuguuuaagacaagcgccggcguuaacaugugcacccuuauugccauggaccugggggaguucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaggcuuggcuuguccauaagcagugguuccuggaucucccucugcccuggacaagcggggcguccaccucucaagagacauggaaucgcaaagaccuucuggugaccuuuaagaccgcccacgcuaagaaacaggaagucgugguucucggaagccaggagggcgccaugcacacagcccugacgggggcuaccgaaauccaaacauccggaaccacaaccauuuucgccggccaucugaagugcagacucaaaauggauaagcugacgcuuaaagggaugagcuaugugauguguacaggcucuuucaagcuggagaaggaagucgcggagacccagcacggaaccgugcucguucagaucaaauacgagggcacagacgcuccgugcaagauuccuuuuuccacccaggaugaaaaaggggugacacaaaacggacggcugaucacggccaaucccaucgucaccgacaaggagaaaccugugaacauugaagccgagccgcccuucggcgagagcuauaucgugauuggggcuggagaaaaggcccugaaacuuucuugguuuaaaaagggcagcuccaucgggaaaauguucgaggcuacagccagaggcgcgcgccggauggccauucucggagauaccgcuugggacuuuggcucuaucgggggaguuuucacaagcgucggcaagcuggugcaucagaucuuugggaccgccuacggagugcuguucuccggcgucagcuggacgaugaaaauugggaucggcgugcuccugaccuggcuuggacucaauucuagauccacaagccucucuaugaccuguauugcuguuggccuggugacacuguaccuuggggucauggugcaggccgauuccggaugcguuaucaacuggaagggccgcgaacucaagugugggagcggaauuuuugugaccaaugagguccacacauggaccgaacaguauaaauuccaagcggacuccccuaagcggcugucugccgcuaucggcaaagccugggaggagggggugugcggcauuagaagcgcuacgcgccuggaaaacaucauguggaagcagaucuccaacgagcucaaucauauucugcuugaaaacgacaugaaauuuacaguuguggucggagauguggccggcauccuggcccaggggaagaaaaugauucggccgcagcccauggaguacaaguauucuuggaaaagcuggggaaaggcuaagaucauuggcgcggacgugcaaaaugccaccuucaucaucgaugggccuaacacccccgaauguccugacgaucagagagcuuggaauauuugggaggucgaggacuacggauuuggcaucuucacaaccaacauuuggcucaaacugcgcgauuccuauacgcagguuugcgaccaccggcugaugagcgccgccaucaaggauucuaaagcugugcacgccgacaugggcuacuggauugaauccgagaagaaugaaacauggaaacuugcgagagcuagcuucaucgaggugaaaaccuguaucuggcccaagucucauacacucugguccaacgggguccuggaaagcgagaugauuaucccgaaaauuuauggaggcccuaucucucagcacaauuaccgccccggguacuuuacccaaacagccggaccuuggcaucugggcaagcucgagcuggauuucgaccuuugcgaagggaccacggugguuguggaugagcacugcggaaaccggggccccagccugagaaccacaaccgucacaggcaaaauuauccacgaaugguguugccgguccuguacccucccuccccugcgcuuuaagggggaggacggaugcugguauggcauggagaucagaccggugaaggaaaaagaggaaaaucugguuaagagcauggugucugccggguccggagaggucgacagcuucucccuuggccuccuguguauuucuaucaugauugaagaggugaugcggagcagauggucccgcaaaaugcugaugacggggauccucgcugucuuuuuccugcuuauuaugggacagcugacauggaacgaucucauccggcugugcauuauggugggcgccaaugcgucugacagaaugggcauggggaccacauaccuggcucuuauggccaccuuuaagaugcgcccuauguucgccgucggacugcucuuuagacggcugaccagccgcgaggugcuccugcuuacaaucggccugucccucguggcuucugucgaacugcccaacagccuggaggaacuuggggauggacuggccaugggcaucaugauucucaaacugcucacggacuuccagucccaucaacugugggcuacccuucugagccucacauuuaucaagaccacauucucucugcacuaugccuggaagaccauggcgaugguucuguccauugugagccuuuuuccccugugucucucuacgacaucccagaaaaccaccuggcugccugugcuccuggggagccuuggaugcaagccgcugacaauguuccugaucgccgagaauaaaauuuggggcagaaagucuuggccccucaacgaaggcaucauggcugucgggaucguguccauucugcuuagcucccugcucaaaaacgauguuccucuggccggaccccucaucgcuggcgggaugcugauugccuguuacgugaucagcggaucuagcgccgaccuuucccuggagaaggcugcggaggucucuugggaagaggaagccgagcauagcggcgcuucccacaauauucugguggaaguucaggaugacgggaccaugaaaaucaaggaugaggagcgggacgauacacucacgauccugcuuaaggccacccugcucgccgugucuggagucuauccucugagcauucccgcuacacucuucgugugguacuuuuggcagaaaaagaaacgcagauccggcguccugugggacaccccuucucccccggaaguggagcgggccguucuugaugacggcaucuaucgcauuaugcaaagagggcugcugggacggagccaggugggcgucgggguguuccaggaaaacguuuuucauacaauguggcacgugacccgcggagcgguccucauguaccagggcaagagacuggagccuuccugggcuagcgugaaaaaggaccuuaucucuuacgggggaggcuggcggcugcaaggcuccuggaauacgggggaggaagugcagguuauugccgucgagcccggaaagaacccuaaaaaugugcagaccgcccccggcacauucaagaccagcgaaggggaggugggagcuaucgcccucgauuuuaaaccgggcacaucuggguccccuauugucaacagagaaggaaagaucgugggccuguauggcaaugggguugugaccacaagcggaacguacgucuccgcgaucgcucaggccaaagccucucaagagggcccccucccugagauugaagacgagguguuccgcaagcggaaccugaccaucauggaucuucaccccgggagcggaaagacaagacgcuaucugcccgcuauuguucgggaagccaucaaaagaaagcugcgcacccucauucuggcuccuacccggguggucgccuccgagauggcggaagcccuuaaaggcaugccgaucagauaccagacaacggcugugaaguccgagcauaccgggaaagagaucguugaccugaugugccacgccacauuuaccaugcgccuccugucucccgugcgggucccuaauuauaacaugauuaucauggaugaagcucauuucacagaccccuccagcauugccgccagaggcuacaucucuacccgggugggaaugggcgaggcugcggccauuuuuaugacggcuacaccucccgggagcguggaagccuucccucaguccaaugccgucauccaagaugaggaacgcgacaucccggagagaucuuggaacagcggauaugaguggauuaccgauuuucccggcaagaccguuugguucgugccuuccaucaagucugggaaugacauugcuaacugucugcggaaaaauggaaagcgcgugauccagcucagcagaaaaacauucgauaccgaauaccagaagaccaagaauaacgacugggacuacgucgugaccacggauauuuccgagaugggcgccaauuuucgggcggacagaguuaucgauccccgccggugccuuaagccugugauucugaaggacgggcccgaaagagucauccuggcuggcccgaugccugugacaguugccagcgccgcucagcgccggggaagaaucggccgcaaccacaauaaagagggggaucaauauauuuacaugggacagccccucaacaaugacgaggaucaugcccacuggaccgaagcgaagaugcugcuugacaacaucaauacacccgagggcauuaucccugcccuguucgaacccgagcgggaaaaaucugcugccauugauggggaguauagacuccgcggagaggcuagaaagaccuuuguggaacugaugcggcgcggcgaccugccugucuggcucuccuacaaaguggccagcgagggguuccaguauuccgauagacgguggugcuuugacggcgaacgcaacaaucagguccuugaggaaaacauggauguggagaucuggacgaaggagggagaacgcaagaagcugcggccgagauggcuggacgcucgcaccuacucugacccccucgcccugcgggaguucaaggaauuugcggccggcagacgcagcguuuccggggaucuuauccuggagauuggaaaacucccucaacaccugacacagcgggcucagaaugcccuggacaaccucgugaugcuucauaauucugaacagggcgggagagcuuaucggcacgccauggaggagcugcccgauaccaucgaaacacugaugcuccuggcccuuauugcugugcugaccggaggcgucacacucuucuuucugagcggccgcgggcugggaaagaccuccaucggccuccuuuguguuauggcgagcucugugcugcuguggauggccuccguggagccucauuggauugcugccagcaucauccucgaguucuuucugaugguccuucugauucccgagccggacagacaacggacgccucaggauaaccagcucgccuacgugguuaucgggcugcuguucaugauucucacaguggcugccaaugagaugggacuucuggaaaccaccaaaaaggaccugggcaucgggcacgucgcgguggagaaccaccaucacgccgcuaugcucgaugucgaccugcaucccgccucugcuuggacacuuuacgccguggcgaccacaauuaucacgccuaugaugcgccacaccauugaaaacacaaccgccaauaucucccugacagcuaucgccaaccaggcugccauucucaugggacuggauaaaggcuggcccaucagcaagauggacauuggcguuccucugcucgcucuugggugcuauucucaagugaauccccugacccugacggccgcgguccucaugcugguggcccauuacgcuaucauuggaccgggccuucaggccaaggcuaccagagaggcccagaaacggacagccgcggggaucaugaagaacccuaccguugauggaaucguggcuauugaccuggaucccgucguguaugacacaaaauuugaaaagcaacucggccagaucaugcugcugauucucuguaccagccagauccuucugaugcgcacgacaugggcccugugcgaguccauuacccucgcuacagggccccugaccacccuuugggagggaucuccuggcaaauucuggaauacaacgaucgccgugagcauggccaacaucuucagaggcuccuaccuggcuggggccggacucgcguuuagccugaugaagucccugggcgggggacggcgcggcaccggggcccagggagaaacacucggcgagaaguggaaaagacaacuuaaucagcugucuaagagcgaguucaacaccuauaaacgguccggcauuauggagguugacagaucugaagcuaaggaggggcugaaacgcggagagacaaccaagcacgccgucagccggggcacggcuaagcucagaugguuuguggaacgcaaucuggugaaaccggaggggaaggucaucgaucuuggauguggcagagggggaugguccuacuauugcgccggccugaaaaagguuacagaagugaaaggcuacaccaaagggggacccggccacgaggaaccuauucccauggcgaccuacggguggaaccucgugaaacugcauucuggaaaggacgucuucuuuaucccucccgagaagugugauacacugcucugcgacauuggcgagagcuccccuaauccgaccaucgaagaggggagaacacuucgcgugcugaaaaugguugaacccuggcugcggggaaaccaguucuguauuaagauccucaauccuuauaugcccagcguggucgagacgcuggagcagaugcaaagaaaacacggcggcaugcuugugcgcaacccucugucuagaaauuccacccaugaaauguacuggguuagcugcgggacaggaaacaucgugucugccgucaauaugaccuccagaaugcuccugaaccgcuuuacaauggcucaccggaagcccaccuaugagagagauguggaccugggcgccgggacgcgccacguggcugucgaaccggagguugccaaccucgauauuaucggacagagaauugaaaauaucaaacaugagcacaagagcaccuggcauuacgacgaggauaacccuuauaagacaugggcuuaccacggcucuuaugaagugaaacccuccgggagcgccuccagcauggugaauggagucgugaagcugcuuaccaaacccugggacguuauuccuauggugacacagaucgcgaugaccgauacaacccccuucggccagcaacgggucuuuaaggagaaaguggacacgcgcacaccuaaggccaagagaggcaccgcucagaucauggaaguuaccgccaaauggcuguggggguuccucucucggaacaagaaaccgagaauuuguacacgggaggaauuuacgcgcaaggugagaagcaaugcugccaucggagccgucuucguggacgagaaccaguggaacuccgcgaaagaggcuguugaagaugagcgguuuugggaccuggugcaucgcgaaagagagcuucacaagcaaggcaagugcgcgaccugcgucuacaacaugauggggaaacgggaaaagaaacugggagaguucggcaaggccaaagggucucgcgcuauuugguacauguggcucggcgccagauuccuggaguuugaagcucugggauucaugaaugaggaucacugguuuagccgggaaaacucccucucuggcguggagggggagggacugcauaaacuuggcuauauccugcgcgacauuagcaaaauccccgggggaaauauguacgccgaugacacagcgggcugggauaccagaaucacagaagacgaucuccagaacgaggccaagauuaccgacaucauggaaccugagcacgcucugcuugccaaguccauuuucaaacugacauaucagaauaaggucgugcggguucagcgccccgcuaaaaacgggaccgugauggaugucaucucuagacgggaccaacgcggcagcggacaggugggcacguacgggcucaauaccuuuacaaacauggaagcccagcugauuagacagauggaguccgagggaaucuucagcccuucugaacuggagacccccaaccucgcgggccgggugcuggauuggcuugaaaagcaugggguugagagacugaaacgcauggccaucuccggagacgacuguguggucaagccgauugaugaccgguuugcuacagcccucaccgcucugaaugauaugggcaaggugagaaaagacaucccucaaugggaacccagcaagggguggaacgauuggcagcagguuccuuucugcucucaccacuuucaucagcuuauuaugaaagacggccgcgagaucgugguccccugucggaaucaagaugagcuggugggacgggcccgcgucucccagggcgcuggguggagccuccgggaaacggccugccugggaaaguccuaugcgcagauguggcagcugauguacuuccacagacgcgaccuccggcuggccgcuaacgccauuuguucugccgugccuguugauugggugcccacaagcagaaccacaugguccauccaugcucaccaucaauggaugaccacggaggacaugcuuagcgucuggaaucgcguguggauugaagagaacccguggauggaagauaaaacccacaucucuuccuggggcgacguuccuuaucuggggaagcgggaggaccaguggugcggaagccucaucggccugacagccagagcgaccugggcuacaaauauucagguggccaucaaccaaguccggagacuuauugggaaugagaacuaccuggauuacaugaccucuaugaagcgcuuuaaaaaugaaaucgaccccgagggcgcccucugguga

SEQ ID NO: 18910 - RNA, 9879 nt, Artificial Sequence
  derived and/or modified CDS sequence (opt5) from DENV-1__FJ547060__SS-prME
agcgugaccaugcugcucaugcugaugcccaccgcccuugcuuuccaccugacgacccggggcggggaaccucauaugaucgucacaaagcaggaacggggaaaaucccuccuguuuaagaccucugccggcguuaacaugugcacacuuauugcgauggaccugggggaacucugugaagauaccaugacauacaaaugcccccgcaucaccgaagcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguucacagugguugugggagaugucgugggcauucucgcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaagcugcgcgauuccuacacacagguuugcgaccaccggcuuaugagcgcggccauuaaagauucuaaggcugugcaugccgacaugggcuauuggaucgaauccgagaaaaaugaaaccuggaagcucgccagagcuagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgccggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuucaaaggggaggacggaugcugguacggcauggagauuagaccggugaaggaaaaggaggaaaaucuuguuaaaagcauggugucugcgggguccggagaggucgacagcuuuucccucggccugcuguguaucucuauuaugaucgaagaggugaugcggagcagauggucccgcaagaugcucaugacagggacccuggcuguuuuccuucugcucauuaugggacagcugacauggaacgaucugauccggcuuugcauuauggugggcgccaaugccucugacagaaugggcauggggaccaccuaucuggcucucauggccacauuuaaaaugcgcccuauguucgcggucggacugcucuuuagacggcugacgagccgcgaggugcuucugcucaccaucggccugucccugguggcuucugucgaacuucccaacagccuggaggaacucggggauggacuggccaugggcaucaugauucucaagcugcuuacagacuuccaaucccaccagcugugggccacccuccugagccugacauuuaucaaaaccacgcuuucucugcauuacgcuuggaagacaauggccaugguucucuccauugugagccuguucccccucugucugucuaccaccucccagaagacaaccuggcuuccugugcugcuggggagccucggaugcaaaccgcugacaauguuucuuaucgcugagaauaagauuuggggcagaaaaucuuggccccugaacgaaggcaucauggccgucggggugguuuccauccuccugagcucccuccugaagaacgaugugccucuugcgggaccccugauugccggcgggaugcugaucgcuuguuaugucauuagcggaucuagcgccgaccucucccuggagaaagcugccgaggugucuugggaagaggaagccgagcacagcggcgcuucccauaauauccuuguugaagugcaggaugacgggacgaugaagauuaaagaugaggagcgggacgauacccugacaauccuccugaaggcgacccuccuggccgucucuggaguguacccucuuagcauccccgcuacacuguucgucugguauuuuuggcaaaagaaaaagcagcgcuccggcgugcugugggacaccccuucucccccggaaguugagagagccgugcucgaugacggcauuuaccggaucaugcagcgcgggcugcuuggaagaagccaggucggcguggggguuuuccaagaaaacguguuccacacgauguggcacgucacccggggagccgugcugauguaucagggcaaacgccucgagccuuccugggcuagcgugaagaaagaccugauuucuuacgggggaggcuggagacuccagggcuccuggaauacaggggaggaaguucaggucaucgccguggagcccggaaagaacccuaagaaugugcaaaccgcgcccggcacauuuaaaaccccggaaggggaggucggagcuauugcccuggauuucaagccuggcacaagcgggucucccaucgugaaccgggaaggaaaaauuguuggccuuuacggcaaugggguggucacgaccuccggaacauaugugagcgccaucgcucagaccaaggccucccaggagggcccucugcccgagaucgaagacgagguuuuuagaaaacgcaaccugaccauuauggaucuccaucccgggucuggaaagacacggagauaccugccugcgaucgugcgcgaagcuauuaagcggaaacuuagaacgcugauccucgccccgacccgcgucguggccagcgagauggcugaagcccugaagggcaugcccauucgguaucaaacaaccgcuguuaaauccgagcacacagggaaggagaucguggaccugaugugccaugccaccuucacgaugagacuccuuagcccuguccgcgugcccaauuacaacaugaucauuauggaugaagcgcacuuuacagacccuucuuccaucgccgcucggggcuauauuagcaccagagugggaaugggcgaggccgcugccaucuucaugaccgccacacccccugggucugucgaggcuuuuccgcagagcaaugcgguuauucaggaugaggaacgggacauccccgagcgcuccuggaacucuggauacgaguggaucaccgauuucccuggcaaaacagugugguuugugcccagcauuaaguccgggaaugacaucgccaacugucugagaaagaauggaaaacgggucauucagcugucucgcaagaccuucgauacggaauaucagaagaccaagaacaacgacugggacuacgugguuaccacagauaucagcgagaugggcgcuaauuuuagagccgaccgggugauugauccuagacgcugccucaaacccgucauccugaaggacgggccggaacgggugauucuugccggcccuaugcccguuaccguggcuuccgccgcgcagagacgcggacggaucggcagaaaccauaauaaggagggggaucaguacaucuauaugggacagccccugaacaaugacgaggaucacgcucacuggacggaagccaaaaugcuccuggacaacauuaauaccccugagggcaucauucccgcccuguucgaaccugagcgcgaaaagagcgcugccaucgauggggaguaccggcucagaggagaggcgcgcaaaacauucgucgaacuuaugagacggggcgaccugccgguguggcugucuuauaaggucgccuccgagggguuucaauacagcgaucgcagauggugcuucgacggcgaacggaacaaucaggugcucgaggaaaacauggauguugagauuuggaccaaagagggagaacgcaagaaacugagaccccgguggcuugacgcuagaacauauuccgacccucuggcccuccgcgaguuuaaggaguucgcugccggccggagaucugugagcggggaucugauccuggagaucggaaagcucccccagcaucuuacccagcgcgcucaaaaugcccuggacaaccuggugaugcuccacaauuccgaacagggcgggcgggcguacagacaugccauggaggagcugccugauacaauugaaacccuuaugcugcucgcucugaucgccguccugacgggaggcguuacacucuuuuuccuuucuggccgggggcugggaaaaaccagcauuggccugcucugugugauggcuuccagcgugcugcuuuggauggccucugucgagccccacuggaucgccgcuuccauuauccuggaauuuuuccucauggugcugcugaucccggagccugaccgccagagaacaccccaggauaaccaacucgcguauguugugauugggcuucuguuuaugauccugacagucgccgcuaaugagaugggacuccuggaaaccacaaagaaagaccuuggcauugggcacguggccgucgagaaccaucaccaugccacgaugcuggauguggaccuccacccugcuagcgccuggacccuguacgcgguugccacaaccaucauuacacccaugaugcggcauaccaucgaaaacacgaccgcuaauauuucucugacagccaucgcuaaccaggccgcgauccucaugggacuugauaagggcuggccuauuuccaaaauggacaucggcgugccccugcuggcccucgggugcuacagccaggucaauccgcugacccuuacagcugccgugcugaugcucguugcucacuaugccauuaucggaccuggccugcaagcuaaggccacccgcgaggcgcagaagagaacggccgcugggauuaugaaaaaccccacaguggauggaaucgucgccaucgaccuggaucccgugguguacgacgcuaaguucgaaaaacagcucggccagauuaugcuucugauccuguguaccucucaaauucuccugaugcggacaaccugggcccuuugcgagagcaucacccuggccacagggccucucacgacccugugggagggauccccgggcaaguuuuggaauacaaccauugcgguuucuauggcuaacaucuuccgcggcagcuaucuggccggggcuggacucgccuuuucccuuaugaaaagccugggcgggggaagacggggcacaggggcccagggagaaacccugggcgagaaguggaagcgccagcucaaucagcuguccaaaucugaguucaacaucuacaagagaagcggcauuauggaggucgaccgguccgaagcuaaagaggggcuuaagagaggagagacgacacgccacgccgugucucggggcaccgcgaaacugagaugguucguggaacgcaaucucgucaagcccgaggggaagguuaucgaucugggauguggcagagggggauggagcuauuacugcgccggccugaaaaaggugaccgaagugaaaggcuauacaaaagggggaccuggccaugaggaacccauuccuauggcuaccuacggguggaaccucgucaaacuucacuccggaaaggacguguuuuucacacccccugagaaaugugauacgcugcugugcgacaucggcgagucuagcccgaaucccaccauugaagaggggagaacacuccgcguucugaagaugguggaaccuuggcuucggggaaaccaauuuuguaucaagauucugaaucccuacaugccuuccgucguggagacccucgagcagaugcagagaaaacauggcggcaugcugguucgcaacccccugagcagaaauucuacacacgaaauguauuggguguccugcgggaccggaaacaucgucagcgccgugaauaugacgucuagaaugcuccugaaccgcuucaccauggcucaccggaagccgacauacgagagagauguggaccuuggcgccgggacccgccaugucgcgguugaaccugagguggccaaccuggauaucauuggacagagaaucgaaaauauuaaacacgagcauaaguccacauggcacuaugacgaggauaaccccuacaaaaccugggcuuaucauggcagcuacgaagugaagcccucuggguccgccagcuccauggucaauggagugguuaagcuccugacaaaaccuugggacgugauccccauggucacccaaauugcuaugacggauacaaccccuuuuggccagcagcggguguucaaggagaaaguugacacccgcacaccgaaggccaaaagaggcacggcucaaaucauggaagugaccgcccgguggcuuuggggguuucugagcagaaacaagaagccccggaucuguacacgcgaggaguucaccagaaaaguccggucuaaugcggccauuggagcuguguuuguugacgagaaccaguggaauagcgccaaggaggcuguggaagaugagcgcuucugggaccucguccagaaagaaagagagcugcacaagcagggcaaaugcgccacaugcguguauaacaugauggggaagcgggaaaagaaacugggagaguuuggcaaggccaaagggucccgcgcgaucugguacauguggcucggcgcuagauuccuggaguuugaagcccuuggauucaugaaugaggaucacugguucucucgggaaaacagccuguccggcgucgagggggagggacuccauaagcugggcuacauucuucgcgacaucucuaaaauuccugggggaaauauguaugccgaugacaccgcuggcugggauacaagaaucaccgaagacgaucugcaaaacgaggccaagaucacggacauuauggaacccgagcacgcucuccuggccaccagcaucuuuaaacugacauaccagaauaaggugguucgggugcagcgcccugcgaagaacgggaccgucauggaugugauuuccagacgggaccagcgcggcucuggacaagugggcacauaugggcucaauaccuucacgaacauggaagcccagcugguuagacagauggagagcgagggaaucuuuucccccugugaacuugagauuccgaaccuggcugaacgggugcucgauuggcuggagaaauacggcgucgaaagacuuaagcgcauggccaucagcggggacgacugcgugguuaaaccuaucgaugaccgguucgcuacagcccugaccgcgcucaaugauaugggaaaggugagaaaagacgucccccagugggagccuucuaagggcuggaacgauuggcaacaggugcccuuuuguucccaucacuuccaccagcugauuaugaaggacgggcgcgagaucgucgugccuugccggaaucaggaugaacugguuggcagagcccgcgugagccaaggagcuggcuggucucuccgggagacagccugucuggggaaauccuaugcucagauguggcagcuuauguacuuucauagacgcgaccugcggcucgccgcuaacgccauuugcagcgcgguccccguggauuggguuccgaccuccagaacgaccuggucuauccacgcccaucaccaauggaugacaaccgaagacaugcugagcguguggaaucgcgucuggauugaggaaaacccuuggauggaggauaagacacauguguccagcuggggagacgugcccuaucuuggcaaacgggaggaccaguggugugggucucugaucggacucaccgcuagagccacaugggccuccaauauucagguugcuaucaaccagguccggagacugaucggcaaugaaaacuaccuggauuacaugaccagcaugaagcgcuucaaaaaugagggggaccccgaaggcgcccucugguga

SEQ ID NO: 18911 - RNA, 9879 nt, Artificial Sequence
  derived and/or modified CDS sequence (opt5) from DENV-1__FJ432745__SS-prME
agcgugaccaugcugcugaugcugaugcccacagcccuugcuuuccaccugacgaccagaggcggggagccucauauggugguuuccaagcaggaacggggaaagucucuccuguuuaagaccagcgccggcgugaacaugugcacccuuaucgcgauggaccugggggagcucugugaagauacaaugaccuacaaaugcccccgcauuacagaggcugaacccgacgauguggacuguuggugcaaugccaccgauacgugggucaccuauggaacauguucccaaaccggcgagcacagacgggacaagcgcucuguggcccuggcuccucauguugggcugggacucgagacaagaaccgaaacguggaugagcuccgagggcgccuggaaacagauccagcggguggaaacaugggcucugcgccaccccggcuucaccgucauugcccuuuuucuggcgcaugccaucgggacaucuauuacccagaagggaaucaucuucauucuccugaugcuugugaccccuagcauggcuaugagaugcguuggcaucgggucccgggauuuuguggagggacugagcggcgccacaugggucgacguggugcucgagcacgggucuugugucacgaccauggcuaaggauaaacccacacuggacauugaacugcucaagaccgagguuacaaacccugccauccugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggcugggcgugcuucugaccuggcucggacucaauucuagauccacaagccugucuaugaccuguauugccguuggccuugugacacucuaccugggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcucucugcggccaucggcaaggcuugggaggagggggugugcggcauuagaagcgccacgcgccuggaaaacguuauguggaaacagaucuccaacgagcuuaaucauauccugcucgaaaacgacaugaaguucacaguggucgugggagauguggcuggcauucuggcccaggggaaaaagaugauccggccgcaacccauggaguacaaauauucuuggaaaagcuggggaaaggccaagauuaucggcgcugacguccagaauaccaccuuuauuaucgaugggccuaacacacccgaauguccugacgaucagagagcguggaauaucugggagguugaggacuacggauucggcauuuuuaccacgaacaucuggcugaaacuucgcgauuccuauacacaggugugcgaccaccggcucaugagcgccgcuauuaaagauucuaaggccgugcacgccgacaugggcuacuggaucgaauccgagaaaaaugaaaccuggaagcuggcuagagccagcuucauugaggucaagacauguaucuggcccaaaucucauacccugugguccaacggggugcucgaaagcgagaugaucauuccgaagaucuauggaggcccuauuucucaacacaauuaccgccccggguacuucacacagaccgcgggaccuuggcaucugggcaaacuugagcuggauuuugaccucugcgaagggacgaccguuguggucgaugagcacugcggaaaccggggccccagccugagaacaaccacagugaccggcaagaucauucacgaaugguguugccgguccuguacgcugccuccccuucgcuucagaggggaggacggaugcugguauggcauggagauccggccgguuaaagaaaaggaggaaaaucucgucaagagcauggucucugcuggguccggagagguggacagcuuuucccugggccugcucuguaucucuauuaugaucgaagagguuaugagaagccgcuggucccggaaaaugcugaugacagggacccuugccguguuccugcuccugauuaugggacagcugacauggaacgaucuuaucagacugugcauuauggucggcgccaaugcuucugaccgcaugggcauggggaccaccuaccucgcccugauggcgacauuuaagaugagaccuauguucgcugugggacuccuguuucggcgccuuacgagcagagaggugcugcuccugaccaucggccugucccuugucgccucuguugaacugcccaacagccucgaggaacugggggauggacucgccaugggcauuaugauccugaaacuucugacagacuuccaaucccaucagcucugggcuacccugcugagccuuacauuuaucaagaccacguucucucugcacuaugccuggaaaacaauggcuauggugcucuccauugugagccuguuuccccucugucugucuaccaccucccagaagacaaccuggcuuccuguccugcuggggagccucggaugcaagccgcugacaauguuccuuaucgccgagaauaaaauuuggggccggcgcucuuggccccugaacgaaggcaucauggcgguggggauuguuuccauccuccugagcucccuccugaagaacgaugugccucuugccggaccccugaucgcuggcgggaugcugauugccuguuacgucaucagcggaucuagcgcugaccucucccuggagaaagccgccgaggugucuugggaagaggaagcugagcauagcggcgcgucccacaauauucuuguugaagugcaggaugacgggacgaugaagaucaaagaugaggagagagacgauacccugacaauucuccugaaggccacccuccuggcugucucuggaguguauccucuuagcauccccgccacacuguuugucugguacuucuggcagaagaagaagcagcgguccggcgugcugugggacaccccuucucccccggaaguugagcgcgccgugcucgaugacggcaucuauagaauuaugcagcgggggcugcuuggacgcagccaggucggcguggggguuuuccaagaaaacguguuucauacgauguggcacgucaccagaggagcugugcugauguaccagggcaaacggcucgagccuuccugggccagcgugaagaaagaccugaucucuuacgggggaggcuggagacuccagggcuccuggaauacaggggaggaaguucaggucauugcgguggagcccggaaagaacccuaaaaaugugcaaaccgcucccggcacauucaagaccccggaaggggaggucggagccaucgcccuggauuuuaagccuggcacaagcgggucucccauugugaaccgcgaaggaaaaaucguuggccuuuauggcaaugggguggucacgaccuccggaacauacgugagcgcuauugcccaggcgaaggcuucccaggagggcccucugcccgagaucgaagacgagguuuuccggaaaagaaaccugaccaucauggaucuccaccccgggucuggaaagacccgccgguaucugccugccauugugagagaagccaucaaacgcaaacuucggacacugauucucgcuccgacgagagucguggccagcgagauggcugaagcccugaagggcaugcccauccgcuaccaaaccacagcgguuaaauccgagcauaccgggaaggagauuguggaccugaugugccacgccacauuuaccaugcggcuccuuagcccugucagagugcccaauuauaacaugaucaucauggaugaagcucauuucacggacccuucuuccauugccgcucggggcuacaucagcacacgcgugggaaugggcgaggccgccgcuauuuuuaugaccgcgacacccccugggucugucgaagccuucccgcagagcaaugcuguuauccaggaugaggaaagagacauucccgagcgguccuggaacucuggauaugaguggaucacagauuuuccuggcaaaaccgugugguucgugcccagcaucaaguccgggaaugacauugccaacugucugcgcaaaaauggaaagagagucauccagcugucucggaagacauuugauaccgaauaccagaagacgaagaacaacgacugggacuacgugguuacaaccgauauuagcgagaugggcgccaauuucagagcugaccgcgugaucgauccucggagaugccucaaacccgucauucugaaggacgggccggaacgcgugauccuugccggcccuaugcccguuacaguggcguccgcugcccagcggagaggacgcauuggccggaaccacaauaaagagggggaucaguauaucuacaugggacagccccugaacaaugacgaggaucaugcccacuggaccgaagcuaagaugcuccuggacaacaucaauacgccugagggcauuauccccgcccuguucgaaccugagagagaaaagagcgcggccauugauggggaguaucgccucagaggagaggcucggaaaaccuuugucgaacuuaugcgcagaggcgaccugccgguguggcugucuuacaaggucgccuccgagggguuccaauauagcgaucggcgcuggugcuuugacggcgaaagaaacaaucaggugcucgaggaaaacauggauguugagaucuggacaaaagagggagaacggaagaaacugagaccccgcuggcuugacgcucggaccuacuccgacccucuggcccucagagaguucaaggaauuugcugccggccgccggucugugagcggggaucugauucuggagaucggaaaacucccccagcaccuuacacagagagcgcaaaaugcccuggacaaccuggugaugcuccauaauuccgaacagggcgggcgggcuuaucgccacgccauggaggagcugccugauaccaucgaaacacuuaugcugcucgcucugauugccguccugaccggaggcguuacgcuguucuuucuuucuggcagagggcugggaaagacaagcaucggccugcucugugugauggccuccagcgugcugcuuuggauggcuucugucgagccccauuggauugcggccuccaucauucuggaguucuuucucauggugcugcugaucccggagccugaccggcagcgcacaccccaagauaaccaacucgcuuacguugugaucgggcuucuguucaugauucugaccgucgccgccaaugagaugggacuccuggaaaccaccaagaaagaccuuggcaucgggcacgcugccgugggaaaccaccaucacgcggccaugcuggaugucgaccuccauccugcuagcgccuggacacuguacgcuguggccacgaccauuaucacacccaugaugagacacaccauugagaacacaaccgcgaauaucucucugacggccauugcuaaccaggccgcuauccucaugggccuugauaagggcuggccuaucuccaaaauggacauugggguuccccugcuggcccucggaugcuauagccaggugaauccgcugacccuuacagcugccguccugaugcucguggcgcauuacgccaucauuggcccugggcugcaagcuaaggccacccgggaagcucagaaacgcacagccgccggaaucaugaagaaccccaccguugauggcauuguggcgaucgaccuggaucccgucguguaugacgcuaaguuugagaaacagcucgggcagaucaugcuucugauucuguguacgucucaaauccuccugaugagaacaaccugggcccuuugcgaaagcauuacacuggcuaccggaccucucaccacacugugggagggcuccccgggcaaguucuggaauacgaccaucgccgugucuauggccaacauuuuucgggggagcuaccuggcuggagccggccucgcguucucccuuaugaaaagccucgggggaggccgcagagggacaggagcccagggcgagacccugggcgaaaaguggaaacggcagcucaaucagcuguccaagucugaguucaacacauauaagagaagcgggaucauggaaguugaccgcuccgaggcuaaagaaggacuuaagcggggcgagaccacgaaacacgccgucucuagagggacagcuaagcugcgcugguuuguggagcggaaucucgugaaacccgaaggaaaggucaucgaucugggcugugggagaggaggcuggagcuacuauugcgccggccugaagaaaguuaccgaggugaagggguacaccaaaggaggcccugggcacgaagaacccauuccuauggcgacauacggauggaaccucgugaaacuucauuccggcaaagacgucuucuuuauucccccugaaaagugugauacccugcugugcgacaucggggagucuagcccgaaucccacaaucgaggaaggacgcacgcuccgggugcugaaaaugguugagccuuggcuuagaggcaaccaauucuguauuaagauccugaaucccuauaugccuuccguggucgaaacccucgagcagaugcagcgcaagcacggcgggaugcuggugcggaacccccugagcagaaauucuacacaugagauguacuggguuuccugcggaaccggcaacauugugagcgccgucaauaugacaucucgcaugcuccugaaccgguuuaccauggcucacagaaaaccgacguaugaacgcgauguggaccuuggggccggaaccagacacguggcugucgagccugaaguugccaaccuggauaucaucggccagcggauugagaauaucaagcaugaacacaaauccacauggcauuacgacgaggauaaccccuauaagaccugggcuuaccacgggagcuaugaggugaaacccucuggauccgccagcuccauggugaauggcgucgugaagcuccugacaaagccuugggacguuauucccauggugacccaaaucgcgaugacagauaccacgccuuucggccagcagcgcgucuuuaaagaaaagguggacacaagaaccccgaaagccaagcgggggaccgcucaaauuauggagguuacagccaaauggcuuuggggauuccugagcagaaacaagaagccccggaucuguacgcgcgaagaguuuaccagaaaagugcggucuaaugcugccaucggcgccgucuucguggacgaaaaccaguggaauagcgcgaaggaggcuguugaggaugaacgcuuuugggaccucgugcauagagagcgggaacugcacaaacaggggaagugcgccacaugcgucuacaacaugaugggaaaacgcgagaagaagcugggcgaguucgggaaagccaagggcuccagagcuauuugguacauguggcucggagcccgguuucuggaguucgaggcucuuggcuucaugaaugaagaucacugguuuucucgcgagaacagccuguccgggguggaaggagagggccuccauaaacugggguauauccuuagagacauuucuaagaucccuggaggcaauauguacgccgaugacaccgcggggugggauacacggauuaccgaggacgaucugcagaacgaagcccgcaucacagacaucauggagcccgaacacgcucuccuggccaaaagcauuuucaagcugaccuaucaaaauaaagucgugagaguucagcggccugcuaagaacggcacggugauggaugucaucucccgcagagaccagcggggaucuggccagguggggaccuacggacucaauacauuuaccaacauggaggcccaacugauuagacagauggaaagcgagggcaucuucucccccagcgagcuugaaacaccgaaccuggcggagcgcgugcucgauuggcuggaaaaguaugggguugagcggcuuaaaagaauggccauuucuggagacgacuguguggucaagccuaucgaugaccgcuuugcuaccgcccugacggcucucaaugauaugggcaaagugcggaaggacaucccccagugggaaccuuccaaaggguggaacgauuggcagcaaguucccuucugcagccaucacuuucaccagcugauuaugaaggacggcagagagaucguggucccuugucgcaaucaggaugagcuggugggacgggccagagucucucagggcgcuggguggucccuccgcgaaacagccugccugggaaagagcuacgcgcaaauguggcagcuuauguauuuccaucggagagaccugcgccucgccgcuaacgccauuuguuccgccgugcccguugauuggaucccgaccucucggacaaccuggagcauucacgcucaucaccaguggaugacgaccgaggacaugcuguccguguggaauagagucuggaucgaagagaacccuuggauggaagauaaaacacauauuagcucuuggggcgacgugcccuaccuugggaagcgggaggaccaauggugcggaucccugaucggccucaccgccagagcgacaugggcuaccaauauccagguugccauuaaccaggugcgccggcugaucgggaaugagaacuaccuggauuauaugacaagcaugaaaagauuuaagaaugaaucugaccccgagggcgcccucugguga

SEQ ID NO: 18912 - RNA, 9879 nt, Artificial Sequence
  derived and/or modified CDS sequence (opt5) from DENV-1__FJ432746__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagagcaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguuccccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccccccuucggcgagucuuauauugugaucggggccggagaaaaagcucugaagcuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacugaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaauuacauccugcuugaaaacgacaugaagcugacgguuguggucggagauguggcuggcauucucgcccaggggaaaaagaugauccggccgcaacccauggaguauaaauacagcuggaaguccuggggaaaggccaaaauuaucggcgcugacgugcagaauacaaccuuuaucauugaugggccuaacacccccgaauguccugacgaucagagagcguggaauaucugggaggucgaggacuauggauucggcauuuuuacaaccaacaucuggcugaagcugcgcgauagcuacacgcagguuugcgaccaucggcuuaugucugccgcuauuaaagauacaaaggccgugcacgccgacaugggcuauuggaucgaauccgagaaaaaugaaaccuggaagcucgcuagagccagcuucaucgaggugaagacauguauuuggcccaaaucucacacccugugguccaacgggguccuggaaagcgagaugaucauuccgaagaucuacggaggcccuauuucucaacauaauuaccgccccggguauuucacacagaccgcgggaccuuggcaccucggcaaacuggagcuugauuuugaccugugcgaagggacgaccgugguuguggaugagcauugcggaaaccggggccccagccucagaacaaccacagucaccggcaagaucauccacgaaugguguugccgguccuguacgcugccuccccugcgcuucaaaggggaggacggaugcugguacggcauggagauuagaccggugaaggaaaaggaggaaaaucuuguuaaaagcauggugucugcuggguccggagaggucgacagcuuuucccucggccugcuguguaucucuauuaugaucgaagaggugaugcggagcagauggucccgcaagaugcucaugacagggacccuggccguuuucuuucuucugauuaugggacagcucacauggaacgaucugauccggcugugcauuauggugggcgccaaugcuucugacagaaugggcauggggaccaccuaucuugcccugauggcgacauucaaaaugcgcccuauguuugcugucggacuccuguucagacggcucacgagccgcgaggugcugcuucugaccaucggccucucccugguggccucugucgaacugcccaacagccuugaggaacugggggauggacucgccaugggcaucaugauucugaagcuccugacagacuuucaaucccaccagcuuugggcuacccugcucagccugacauucguuagaaccacguuuucucugcauuacgccuggaaaacaauggcuauggugcuuuccaucgugagccuguucccccucugucugucuaccaccucccagaagacaaccuggcucccuguccugcuugggagccugggaugcaagccgcugacaauguuucucauugccgagaauaaaaucuggggccggaagucuuggccccugaacgaaggcauuauggcgguggggaucguuuccauccuucugagcucccuccugaaaaacgaugugccucucgccggaccccugauugcuggcgggaugcuuaucgccuguuaugucauuagcggaucuagcgcugaccugucccuggagaaggccgccgugguuucuugggaggaagaggcugaacacagcggcgcgucccauaauauccucguggagguccaggaugacgggacgaugaaaauuaaggaugaagagcgcgacgauacccugacaauccuucugaaagccacccuccuggcugugucuggagucuacccucucagcauccccgccacacuguucgugugguauuucuggcaaaagaagaaacagagauccggcguucuuugggacaccccuucucccccggagguggaacgggccguccuggaugacggcauuuaccgcaucaugcagagagggcugcucggacggagccaggugggcguugggguguuucaagagaacgucuuccacacgauguggcaugugacccgcggagcugugcugauguaccagggcaagagacuugaaccuuccugggccagcguuaaaaaggaccugauuucuuaugggggaggcuggcggcuccagggcuccuggaauacaggggaggagguccaggugaucgcgguggaacccggaaaaaacccuaagaauguccaaaccgcucccggcacauuuaagaccagcgagggggaagugggagccauugcccuggauuucaaaccgggcacaucuggguccccuaucguuaacagagagggaaagauugugggccucuacggcaauggggucgugacgaccagcggaacauauguuuccgcuaucgcccaggcgaaagcuucucaggaaggcccccugccugagaucgaggacgaaguguuucgcaagcggaaccuuaccauuauggaucugcaccccgggagcggaaaaaccagacgcuaccugcccgccaucguccgggaggccauuaagagaaagcuccgcacacugauccuugcuccuacgcgggugguugccuccgaaauggcugaggcccugaaaggcaugccgauuagauaucaaaccacagcggugaagagcgaacacaccgggaaagagaucgucgaccucaugugccaugccacauucaccaugcgccugcugucucccgugcgggugccuaauuacaacaugaucauuauggaugaggcucacuuuacggaccccuccagcaucgccgcuagaggcuauauuucuacacgggucggaaugggcgaagccgccgcuaucuucaugaccgcgaccccucccgggagcguugaggccuuuccucaguccaaugcugugauucaggaugaagagcgcgacaucccggaaagaucuuggaacagcggauacgaguggaucacagauuuccccggcaagaccgugugguuugucccuuccauuaaaucugggaaugacaucgccaacugucuccggaagaauggaaagcgcgugauucagcuuagcagaaaaacauucgauaccgaguaccaaaagacgaaaaacaacgacugggacuauguugugacaaccgauaucuccgaaaugggcgccaauuuccgggcugacagagucauugauccccgccggugccugaagccugugauccugaaagacgggcccgagagaguuauucucgccggcccgaugccugugacagucgcgagcgcugcccagcgccggggaagaaucggccgcaaccauaauaaggaaggggaucaguacaucuauaugggacagccccugaacaaugacgaggaucacgcccauuggaccgaggcuaagaugcuucuggacaacauuaauacgcccgaaggcaucauuccugcccucuuugagcccgaacgggagaaaucugcggccaucgauggggaauacagacugcgcggagaggcuagaaagaccuucguggagcugaugcggcgcggcgaccucccugucuggcuuuccuauaaaguggccagcgaaggguuucaauacuccgauagacgguggugcuucgacggcgagcgcaacaaucagguucuggaagagaacauggauguggaaauuuggacaaaggagggagagagaaaaaagcugcggccgagauggcucgacgcucgcaccuauucugacccccuggcccuucgggaauuuaaagaguucgcugccggcagacgcagcguguccggggaucugauccucgaaaucggaaagcugccucagcaccugacacagcgggcgcaaaaugcccucgacaaccuugucaugcugcacaauucugagcagggcgggagagcuuaccggcaugccauggaagagcugcccgauaccauugagacacucaugcugcuugcucugaucgccguucucaccggaggcgugacgcuguuuuuccugagcggccgcgggcucggaaagacauccauuggccuucugugugugauggccagcucuguccugcucuggauggcuuccguggaaccucacuggaucgcggccagcauuauccuggaguuuuuccuuaugguucugcucauccccgaaccggacagacagcggaccccucaggauaaccaacuggcuuacguggucauugggcugcucuuuaugauccuuaccguggccgccaaugagaugggacugcuggagacaaccaaaaaggaccucggcauugggcaugucgcuguggaaaaccaccaccaugccgcgaugcuggauguugaccuucaccccgccucugcuuggacacuguaugccguggcuacgaccaucauuacaccuaugaugcgccauaccaucgagaacacaaccgccaauauuucccucacggcgaucgccaaccaggcugccauccugaugggacuggauaaaggcuggcccauuagcaagauggacaucggcgucccucuccuugcucuggggugcuacucucaggugaauccccugacccucacagccgcuguucugaugcuuguggcccacuaugcgauuaucggaccgggccugcaagccaaagcuaccagagaagcccagaagcggacagcugccgggauuaugaagaacccuaccgucgauggaaucguggccaucgaccucgaucccgugguuuacgacgcgaaauucgagaagcagcugggccagauuaugcugcucauccuuuguacgagccaaauucugcugaugcgcacaaccugggcucucugcgaauccaucacacuggccaccgggccccuuaccacacugugggagggaucuccuggcaaauuuuggaauacgaccauugcugucagcauggccaacaucuucagaggcuccuaucucgccggggcuggacuggccuucagccugaugaagucccucggcgggggacggcgcggcacaggggcgcagggagagacccuuggcgaaaaauggaagagacagcugaaucagcugucuaagagcgaguuuaacacauacaaacgguccggcaucauggaaguggacagaucugaggccaaggaagggcucaaacgcggagagaccacgaagcaugcugugagccggggcacagccaaacugagaugguucgucgagcgcaaucuuguuaagccggaagggaaggugauugaucugggauguggccgggggggaugguccuauuacugcgcuggccucaaaaaggugaccgaggucaaaggcuacaccaaggggggacccggccacgaagagccuauccccauggccacauauggguggaaccuggugaaacugcacucuggaaaggacguuuuuuucauuccucccgaaaaaugugauacccuccuuugcgacaucggcgagagcuccccuaauccgacaauugaggaagggagaacgcugcgcgugcugaagauggucgagcccuggcuccggggaaaccaauuuuguaucaagauucugaauccuuacaugcccagcgugguugaaacccuugagcagaugcagagaaaacauggcggcaugcuggugcgcaacccucucucucggaauuccacacacgagauguauugggucagcugcgggaccggaaacaucgugucugcggugaauaugacauccagaaugcugcugaaccgcuucaccauggcccaucggaagcccacguacgaaagagaugucgaccucggcgcugggacccgccacguugccguggagccggaaguggcuaaccuggauaucauuggacagagaaucgagaauauuaaacacgaacauaagagcacauggcacuaugacgaggauaacccuuacaaaaccugggccuaucauggcucuuacgaggucaagcccuccgggagcgcuuccagcauggugaauggaguugugaagcuucugacaaaacccugggacgucaucccuauggugacccaaauugccaugacagauaccacgcccuuuggccagcagcggguuuucaaggaaaaaguggacacacgcaccccuaaggcgaaaagaggcaccgcccaaaucauggaggucacagcuaaguggcucuggggguuucugucucggaacaagaaaccgagaaucuguacgcgggaagaguucacccgcaaggugagaagcaaugccgcuauuggagccguuuuuguggacgaaaaccaguggaauuccgccaaagaggcggucgaggaugaacgguucugggaccuugugcaccgcgagagagaacugcauaagcagggcaaaugcgcuacaugcgucuacaacaugauggggaagcgggagaagaaacucggagaauuuggcaaggccaaagggucucgcgccaucugguauauguggcugggcgcuagauuccuggaguucgaggcccucggauuuaugaaugaagaucacugguucagccgggagaacucccugucuggcguggaaggggagggacuucacaagcugggcuacauucuccgcgacaucagcaaaauucccgggggaaauauguaugcugaugacaccgccggcugggauacaagaaucaccgaggacgaucugcagaacgaagcgaagaucacagacauuauggagccugaacaugcccuucuggcuaaauccaucuuuaagcucaccuaccaaaauaagguugugcggguccagcgccccgccaaaaacgggacggugauggaugugauuucuagacgggaccagcgcggcagcggacagguuggcaccuaugggcugaauacauucaccaacauggaggcucaacugaucagacagauggaauccgagggaauuuuuagcccuucugagcucgaaacacccaaccuggccggccgggugcuugauuggcuggagaagcacggggucgaaagacucaaacgcauggcgaucuccggagacgacugugugguuaagccgaucgaugaccgguucgccaccgcucugacggcccuuaaugauaugggcaaagugagaaaggacauuccucagugggagcccagcaagggguggaacgauuggcagcaagucccuuuuugcucucaucacuuccaccagcugaucaugaaagacggccgcgaaauugugguccccugucggaaucaggaugagcucgugggaagagcucgcguuucccagggcgccggguggagccugcgggagacagcuugccugggaaaguccuacgcccaaauguggcagcucauguauuuucauagacgcgaccugcggcuugcggccaacgcuaucuguucugccgugccugucgauugggugcccaccagcagaacaaccugguccauucacgcccaucaccaguggaugacgaccgaagacaugcugagcguuuggaaucgcguguggaucgaggaaaacccguggauggaggauaaaacacauauuucuuccuggggcgacgucccuuaccucgggaagcgggaagaccaauggugcggaagccugaucggccuuaccgcuagagccacaugggcgaccaauauccagguggcuauuaaccaggugcggagacugcucgggaaugagaacuaccuggauuauaugacaucuaugaaacgcuucaagaaugagagcgaccccgaaggcgcccugugguga

SEQ ID NO: 18913 - RNA, 9879 nt, Artificial Sequence
  derived and/or modified CDS sequence (opt5) from DENV-1__FJ432748__SS-prME
agcgugaccaugcugcucaugcugaugcccaccgcccuugcuuuccaccugacgaccagaggcggggaaccucauaugauugucuccaagcaggaacgggggaaaucucuccuguuuaagaccagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaagugccuuucuccacacaagaugaaaagggggucacgcagaacggacggcugaucaccgcgaaucccaucgugacagacaaagagaagccugugaacauugaagcugagccgcccuuuggcgagagcuauaucguuauuggggccggagaaaaagcccuuaagcucucuugguucaagaaaggcagcuccaucgggaagauguuugaggcuaccgccagaggcgcucgccggauggccauucugggagauacagcgugggacuucggcucuaucgggggagucuuuaccagcgugggcaaacuggugcaucagaucuucgggacggccuacggaguccucuuuuccggcgugagcuggaccaugaagauugggaucggcguucugcuuacauggcugggacucaauucuagauccaccagccugucuaugacauguauugcugugggccuggucacccuuuaccucggggugaugguucaggccgauuccggaugcgugaucaacuggaaaggccgcgaacugaagugugggagcggaauuuucgucacaaaugaggugcacaccuggacggaacaauauaaguuucaggcugacuccccuaaacggcugucugccgcgaucggcaaggccugggaggaggggguuugcggcauuagaagcgcuacacgccucgaaaacaucauguggaaacagaucuccaacgagcugaaucauauucuucuggaaaacgacaugaaguucaccguggucgugggagauguggccggcauccucgcucaggggaaaaagaugauucggccgcaacccauggaguacaaauauucuuggaaaagcuggggaaaggccaagaucauuggcgccgacguccagaauaccacauuuaucaucgaugggccuaacacccccgaauguccugacgaucagagagcuuggaauauuugggagguugaggacuacggauucggcaucuuuacgacaaacauuuggcugaagcugcgcgauuccuauacccaggugugcgaccaccggcuuaugagcgcggccaucaaagauucuaaggcugugcacgccgacaugggcuacuggauugaauccgagaaaaaugaaacauggaagcucgccagagcuagcuucaucgaggucaagaccuguaucuggcccaaaucucauacacugugguccaacggggugcuggaaagcgagaugauuaucccgaagauuuauggaggcccuaucucucaacacaauuaccgccccggguacuucacccaggccgcgggaccuuggcaucucggcaaacuggagcuugauuuugaccugugcgaagggacgaccguuguggucgaugagcacugcggaaaccggggccccagccucagaacaaccacagugaccggcaagauuauccacgaaugguguugccgguccuguacgcugccuccccugcgcuucaaaggggaggacggaugcugguauggcauggagaucagaccgguuaaggaaaaggaggaaaaucuugugaaaagcauggucucugcuggguccggagagguggacagcuuuucccucggccugcuguguauuucuaucaugauugaagagguuaugcggagcagauggucccgccggaugcucaugacagggacccuggccguguucuuucuucugaucaugggacagcucacauggaacgaucugauuagacugugcaucauggucggcgccaaugcuucugaccgcaugggcauggggaccaccuaccuugcccugauggcgacauucaagaugagaccuauguuugcugugggacuccuguuccggcgccucacgagcagagaggugcugcuucugaccauuggccucucccuggucgccucuguugaacugcccaacagccuugaggaacugggggauggacucgccaugggcaucaugauccugaaacuccugacagacuuucaaucccaucagcuuugggcuacccugcucagccugacauucauuaagaccacguuuucucugcacuaugccuggaaaacaauggcuauggugcuuuccaucgugagccuguucccccucugucugucuaccaccucccagaagacaaccuggcucccuguccugcuugggagccugggaugcaagccgcugacaauguuucucauugccgagaauaaaaucuggggccggcgcucuuggccccugaacgaaggcauuauggcgguggggaucguuuccauccuucugagcucccuccugaagaacgaugugccucucgccggaccccugauugcuggcgggaugcuuaucgccuguuacgucauuagcggaucuagcgcugaccugucccuggagaaagccgccgaggugucuugggaagaggaagcugagcauagcggcgcgucccacaauauccucguugaagugcaggaugacgggacgaugaagauuaaagaugaggagagagacgauacccugacaauccuucugaaggccacccuccuggcugucucuggaguguauccucucagcauccccgccacacuguucgucugguacuucuggcagaagaagaagcagcgguccggcgugcuuugggacaccccuucucccccggaaguugagcgcgccgugcuggaugacggcauuuauagaaucaugcagcgggggcugcucggacgcagccaggucggcguggggguuuuucaagaaaacguguuccauacgauguggcacgucaccagaggagcugugcugauguaccagggcaaacggcuugagccuuccugggccagcgugaagaaagaccugauuucuuacgggggaggcuggagacuccagggcuccuggaauacaggggaggaaguucaggucaucgcgguggagcccggaaagaacccuaaaaaugugcaaaccgcucccggcacauuuaagaccccggaaggggaggucggagccauugcccuggauuucaagccuggcacaagcgggucucccaucgugaaccgcgaaggaaaaauuguuggccucuauggcaaugggguggucacgaccuccggaacauacgugagcgcuaucgcccaggcgaaggcuucccaggagggcccucugcccgagaucgaagacgagguuuuucggaaaagaaaccuuaccauuauggaucugcaccccgggucuggaaagacccgccgguaucugccugccaucgugagagaagccauuaaacgcaagcuccggacacugauccuugcuccgacgagagucguggccagcgagauggcugaagcccugaagggcaugcccauucgcuaccaaaccacagcgguuaaauccgagcauaccgggaaggagaucguggaccucaugugccacgccacauucaccaugcggcugcugagcccugucagagugcccaauuauaacaugaucauuauggaugaagcucauuuuacggacccuucuuccaucgccgcucggggcuacauuagcacacgcgugggaaugggcgaggccgccgcuaucuucaugaccgcgacacccccugggucugucgaagccuuuccgcagagcaaugcuguuauucaggaugaggaaagagacauccccgagcgguccuggaacucuggauaugaguggaucacagauuucccuggcaaaaccgugugguuugugcccagcauuaaguccgggaaugacaucgccaacugucuccgcaaaaauggaaagagagucauucagcuuucucggaagacauucgauaccgaauaccagaaaacgaagaacaacgacugggacuacgugguuacaaccgauaucagcgagaugggcgccaauuucagagcugaccgcgugauugauccucggagaugccugaaacccgucauccugaaggacgggccggaacgcgugauucucgccggcccuaugcccguuacaguggcguccgcugcccagcggagaggacgcaucggccggaaccacaauaaagagggggaucaguauaucuacaugggacagccccugaacaaugacgaggaucaugcccacuggaccgaagcuaagaugcuucuggacaacauuaauacgccugagggcaucauucccgcccucuuugaaccugagagagaaaagagcgcggccaucgauggggaguaucgccugagaggagaggcucggaaaaccuucgucgaacugaugcgcagaggcgaccucccgguguggcuuucuuacaaggucgccuccgagggguuucaauauagcgaucggcgcuggugcuucgacggcgaaagaaacaaucaggugcuggaggaaaacauggauguugagauuuggacaaaagagggagaacggaagaaacugagaccccgcuggcucgacgcucggaccuacuccgacccucuggcccuuagagaguuuaaggaguucgcugccggccgccggucugugagcggggaucugauccucgagaucggaaaacugccccagcaccugacacagagagcgcaaaaugcccucgacaaccuugugaugcugcauaauuccgaacagggcgggcgggcuuaucgccacgccauggaggagcugccugauaccauugaaacacucaugcugcuugcucugaucgccguccucaccggaggcguuacgcuguuuuuccugucuggcagagggcucggaaagacaagcauuggccuucugugugugauggccuccagcgugcugcucuggauggcuucugucgagccccauuggaucgcggccuccauuauccuggaauuuuuccuuauggugcugcucaucccggagccugaccggcagcgcacaccccaggauaaccaacuggcuuacguugugauugggcugcucuuuaugauccuuaccgucgccgccaaugagaugggacugcuggaaacaaccaagaaagaccucggcauugggcacguggcugucgagaaccaccaucacgccgcgaugcuggauguggaccuucauccugccagcgcuuggacacuguacgccguugcuacgaccaucauuacacccaugaugagacacaccaucgaaaacacaaccgccaauauuucucucacggcgaucgccaaccaggcugccauccugaugggacuggauaagggcuggccuauuuccaaaauggacaucggcgugccccuccuugcucuggggugcuauagccaggucaauccgcugacccucacagccgcugugcugaugcuuguugcccauuacgcgauuaucggaccuggccugcaagccaaggcuacccgggaggcccagaaacgcacagcugccgggauuaugaagaaccccaccguggauggaaucgucgccaucgaccucgaucccgugguguaugacgcgaaguucgaaaaacagcugggccagauuaugcugcucauccuuuguacgucucaaauucugcugaugagaacaaccugggcucucugcgagagcaucacacuggccaccgggccucuuaccacacugugggagggauccccgggcaaguuuuggaauacgaccauugcuguuucuauggccaacaucuuccggggcagcuaccucgccggggcuggacuggccuucucccugaugaaaagccucggcgggggacgcagaggcacaggggcgcagggagaaacccuuggcgagaaguggaaacggcagcugaaucagcuguccaagucugaauuuaacacauauaagagaagcggcaucauggaggucgaccgcuccgaagccaaagaggggcucaagcggggagagaccacgaaacacgcugugucuagaggcacagccaagcugcgcugguucguggaacggaaucuugucaaacccgaggggaagguuauugaucugggauguggcagagggggauggagcuacuauugcgcuggccucaagaaagugaccgaagugaagggcuacaccaaagggggaccuggccacgaggaacccaucccuauggccacauacggguggaaccuggucaagcugcauuccggaaaagacguguuuuucauucccccugagaagugugauacccuccuuugcgacaucggcgagucuagcccgaaucccacaauugaagaggggcgcacgcugcggguucugaaaaugguggaaccuuggcucagaggaaaccaauuuuguaucaagauucugaaucccuauaugccuuccgucguggagacccuugagcagaugcagcgcaagcacggcggcaugcugguucggaacccccucagcagaaauucuacacaugaaauguacuggguguccugcgggaccggaaacaucgucagcgcggugaauaugacaucucgcaugcugcugaaccgguucaccauggcccacagaaaaccgacguaugagcgcgauguggaccucggcgcugggaccagacacgucgccguugaaccugagguggcuaaccuggauaucauuggacagcggaucgaaaauauuaagcaugagcacaaauccacauggcauuacgacgaggauaaccccuauaagaccugggccuaccacggcagcuaugaagugaaacccucuggguccgcuagcuccauggucaauggagugguuaaacuucugacaaagccuugggacgugauccccauggucacccaaauugccaugacagauaccacgccuuuuggccagcagcgcguguucaaagagaagguugacacaagaaccccgaaagcgaagcggggcaccgcccaaaucauggaagugacagcuaaauggcucuggggguuucugagcagaaacaagaagccccggaucuguacgcgcgaggaguucaccagaaaaguccggucuaaugccgcuauuggagccguguuuguugacgagaaccaguggaauagcgccaaggaggcgguggaagaugagcgcuucugggaccuuguccauagagaacgggagcugcacaaacagggcaagugcgcuacaugcguguacaacaugauggggaaacgcgaaaagaagcucggagaguuuggcaaagccaagggguccagagccaucugguacauguggcugggcgcucgguuccuggaguucgaagcccucggauuuaugaaugaggaucacugguucucucgcgaaaacagccuguccggcgucgagggggagggacuucauaaacugggcuauauucucagagacaucucuaagauuccugggggaaauauguacgcugaugacaccgccggcugggauacacggaucaccgaagacgaucugcagaacgaggcgcgcaucacagacauuauggaacccgagcacgcccuucuggcuaaaagcaucuuuaagcucaccuaucaaaauaaagugguuagagugcagcggccugccaagaacgggacggucauggaugugauuucccgcagagaccagcggggcucuggacaggugggcaccuacgggcugaauacauucaccaacauggaagcucaacugaucagacagauggagagcgagggaaucuuuucccccagcgaacucgagacaccgaaccuggccgaacgcguucuugauuggcuggagaaguauggcguggaacggcucaaaagaauggcgaucucuggggacgacugugucgugaagccuaucgaugaccgcuucgccaccgcucugacggcccuuaaugauaugggaaaaguucggaaggacauuccccagugggagccuuccaaaggcuggaacgauuggcagcaagugcccuuuugcagccaucacuuccaccagcugaucaugaaggacgggagagagauugucgugccuugucgcaaucaggaugaacucgucggccgggcuagagugucucagggagccggcuggucccugcgcgagacagcuugccugggaaagagcuacgcccaaauguggcagcucauguauuuucaucggagagaccugcgccuugcggccaacgcuaucuguuccgccguucccguggauuggauuccgaccucucggacaaccuggagcauccacgcccaucaccaguggaugacgaccgaagacaugcuguccgucuggaauagaguguggauugaggaaaacccuuggauggaggauaaaacacauaucagcucuuggggagacguucccuaccucggcaagcgggaggaccaauggugcgggucccugaucggacuuaccgcuagagccacaugggcgaccaauauucagguggcuaucaaccagguccgccggcugauuggcaaugaaaacuaccucgauuauaugacaagcaugaaaagauucaagaaugagucugaccccgaaggggcccugugguga

SEQ ID NO: 18914 - RNA, 9879 nt, Artificial Sequence
  derived and/or modified CDS sequence (opt5) from DENV-1__FJ432749__SS-prME
uccgugaccaugcugcucaugcugaugcccaccgcccuugcuuuccaccugacgaccagaggcggggaaccucauaugaucgucaccaagcaggaacggggaaagucccuucuguuuaagaccucugccggcguuaauaugugcacccuuauugccauggaccugggggaacucugugaagauaccaugacauacaagugcccgcgcaucaccgaagcugaacccgacgauguggacuguuggugcaaugccacggauaccugggugacauauggaaccuguagccaaacaggcgagcacagacgggacaagcgcuccgucgcccuggcuccucauguggggcugggacucgagaccagaacggaaacauggaugucuagcgagggcgccuggaagcagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaggacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuuccugacccaagaugaaaaggggguuacacagaacggacggcuuaucacggcuaaucccauugugaccgacaaagagaagccugucaacaucgaagccgagccgcccuuuggcgaguccuauauugugaucggggccggagaaaaagcucucaagcugagcugguucaagaaaggcucuagcauugggaagauguuugaggccacagcuagaggcgcccgccggauggcgauccugggagauaccgccugggacuucggcuccaucgggggaguguuuacaucuguuggcaaacucguccaucagauuuucgggaccgcuuacggagugcuguuuagcggcguguccuggacgaugaagaucgggauuggcguccuucugaccuggcucggacugaauagcagaucuacaucccugagcaugaccuguaucgccgugggccuuguuacacucuaccugggggugaugguccaggcugauucuggaugcgugauuaacuggaaaggccgcgaacugaaguguggguccggaaucuucguuaccaaugaggugcacacauggaccgaacaauauaaguuucaggccgacagcccuaaacggcucuccgcggccauuggcaaggcuugggaggagggggucugcggcaucagaucugccacgcgccuggaaaacaucauguggaaacagauuagcaacgagcuuaaucauauccugcucgaaaacgacaugaaguucacagugguugugggagaugucgugggcauucuggcucaggggaaaaagaugauccggccgcaacccauggagcacaaauacuccuggaagucuuggggaaaggccaaaauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaaacuucgcgauagcuacacacagguuugcgaccaccggcucauguccgcggccauuaaagauagcaaggcugugcaugccgacaugggcuauuggaucgaaucugagaaaaaugaaaccuggaagcuggccagagcuuccuucaucgaggugaagacauguauuuggcccaaaagccacacccuguggucuaacgggguccucgaauccgagaugaucauuccgaagaucuacggaggcccuauuagccaacauaauuaucgccccggguacuucacacagaccgccggaccuuggcaccugggcaaacuugagcuggauuuugaccucugcgaagggacgaccgugguuguggaugagcacugcggaaaccggggccccucucugagaacaaccacagucaccggcaagaucauccaugaaugguguugccggagcuguacgcugccuccccuucgcuucaaaggggaggacggaugcugguacggcauggagauuagaccggugaaggaaaaggaggaaaaucucguuaaauccauggugagcgcggggucuggagaggucgacuccuuuagccugggccugcucuguaucuccauuaugaucgaagaggugaugcggucuagauggagccgcaagaugcugaugacagggacccuugcuguuuuccugcuccugauuaugggacagcugacauggaacgaucuuauccggcugugcauuauggugggcgccaaugccuccgacagaaugggcauggggaccaccuaucucgcucugauggccacauuuaaaaugcgcccuauguucgcggucggacuccuguuuagacggcuuacgucucgcgaggugcugcuccugaccaucggccugagccuuguggcuuccgucgaacugcccaacucucucgaggaacugggggauggacucgccaugggcaucaugauucugaaacuucugacagacuuccaaagccaccagcucugggccacccugcugucccuuacauuuaucaaaaccacgcugagccuccauuacgcuuggaagacaauggccaugguucugucuauugugucccucuucccccugugucuuagcaccaccucucagaagacaaccuggcugccugugcugcucgggucccugggaugcaaaccgcuuacaauguuucugaucgcugagaauaagauuuggggcagaaaaagcuggccccucaacgaaggcaucauggccgucggggugguuucuauccugcucuccagccugcuuaagaacgaugugccucuggcgggaccccugauugccggcgggaugcucaucgcuuguuaugucauuuccggaagcucugccgaccugagccuugagaaagcugccgagguguccugggaagaggaagccgagcacucuggcgcuagccauaauauccugguugaagugcaggaugacgggacgaugaagauuaaagaugaggagcgggacgauacccucacaauccugcucaaggcgacccugcuugccgucuccggaguguacccucugucuauccccgcuacacuguucgucugguauuuuuggcaaaagaaaaagcagcgcagcggcgugcucugggacaccccuagcccucccgaaguugagaaagccgugcuggaugacggcauuuacagaaucaugcagcgggggcuucugggacgcucucaggucggcguggggguuuuccaagaaaacguguuccacacgauguggcacgucaccagaggagccgugcucauguaucagggcaagcggcuggagcccagcugggcuuccgugaaaaaggaccucauuagcuacgggggaggcuggcgccugcagggcucuuggaauacaggggaggaaguucaggucaucgccguggagcccggaaagaacccuaaaaaugugcaaaccgcgcccggcacauuuaagaccccggaaggggaggucggagcuauugcccuugauuucaaaccuggcacauccgggagccccaucgugaacagagaaggaaagauuguuggccuguacggcaaugggguggucacgaccucuggaacauauguguccgccaucgcucaggccaaagcgagccaggagggcccucugcccgagaucgaagacgagguuuuucggaagagaaaccucaccauuauggaucugcaucccggguccggaaagacccgccgguaccuuccugcuaucgugagagaagccauuaaacgcaagcugcggacacucauccuggccccgacgagagucguggcuucugagauggccgaagcucugaaaggcaugcccauucgcuaucaaaccacagccguuaagagcgagcacaccgggaaagagaucguggaccucaugugccaugcgacauucaccaugcggcuucuguccccugucagagugcccaauuacaacaugaucauuauggaugaagcccacuuuacggacccuagcucuaucgcugcccgcggcuauauuuccacacgggugggaaugggcgaggcugccgccaucuucaugaccgcuacacccccugggagcgucgaagcguuuccgcagucuaaugccguuauucaggaugaggaaagagacauccccgagcggagcuggaacuccggauacgaguggaucacagauuucccuggcaagaccgugugguuugugcccucuauuaagagcgggaaugacaucgcuaacugucugcgcaaaaauggaaagagagucauucagcucucccggaaaacauucgauaccgaauaucaaaagacgaaaaacaacgacugggacuacgugguuacaaccgauaucucugagaugggcgccaauuuucgcgccgacagagugauugauccucggagaugccugaagcccgucauccuuaaggacgggccggaacgcgugauucuggcuggcccuaugcccguuacaguggccagcgcggcucagcggagaggacgcaucggccggaaccauaauaaagagggggaucaguacaucuauaugggacagccccucaacaaugacgaggaucacgcccacuggaccgaagccaagaugcugcuggacaacauuaauacgccugagggcaucauucccgcucucuucgaaccugagagagaaaaauccgccgcgaucgauggggaguaccgccuucggggagaggccagaaagaccuucgucgaacugaugcgcagaggcgaccugccgguguggcucagcuauaaagucgcuucugagggguuucaauacuccgaucggcgcuggugcuucgacggcgaaagaaacaaucaggugcuggaggaaaacauggauguugagauuuggacaaaggagggagaacggaagaaacuucgccccagauggcuggacgcccggaccuauagcgacccucucgcucugagagaguuuaaagaguucgccgcuggccgccgguccgugucuggggaucugauccucgagaucggaaaacuuccccagcaucugacacagagagcccaaaaugcgcuggacaaccucgugaugcugcacaauagcgaacagggcgggcgcgccuaccggcaugcuauggaggagcuuccugauaccauugaaacacugaugcuccuggcccugaucgcuguccucaccggaggcguuacgcucuuuuuccuguccggcagagggcugggaaagacaucuauuggcgugcucugugugauggccagcuccguccugcuuuggauggccagcguggagccccacuggaucgcugcgucuauuauccuggaauuuuuccucaugguucugcugaucccggagccugaccggcagcgcacaccccaggauaaccaacucgccuauguggucauugggcuucuguuuaugauccugaccguggcugccaaugagaugggacuccuggaaacaaccaaaaaggaccuuggcauugggcacgucgccguggagaaccaucaccaugcuacaaugcuggauguugaccuccacccugccuccgcguggacgcuguacgccguggcuaccacaaucauuacccccaugaugagacauacaaucgaaaacaccacggccaauauuagccugaccgcuaucgccaaccaggcggccauccucaugggacuugauaaaggcuggccuauuucuaagauggacaucggcgucccccugcuggcucucgggugcuacucccaggugaauccgcugacacuuaccgccgcuguucugaugcucguggcccacuaugcuauuaucggaccuggccugcaagccaaggcgacacgggaggcccagaaacgcaccgcugccgggauuaugaagaaccccacggucgauggaaucguggcuaucgaccuggaucccgugguuuacgacgccaaauucgaaaagcagcucggccagauuaugcuucugauccuguguacaagccaaauucuccugaugagaaccacaugggcccuuugcgagucuaucacccuggcgaccgggccucucacaacgcugugggagggaagcccgggcaaauuuuggaauaccacaauugcugucuccauggccaacaucuuccggggcucuuaucuggcuggggccggacucgccuuuagccuuaugaagucccugggcgggggacgcagaggcaccggggcucagggagaaacacugggcgagaaguggaaacggcagcucaaucagcugagcaaguccgaguucaacaucuacaaacgcucuggcauuauggagguggacagaagcgaagccaaggaggggcuuaaacggggagagaccacgagacacgcggugucccgcggcacagccaagcugcggugguucgucgaaagaaaucucguuaagcccgaggggaaagugaucgaucugggauguggccgcgggggauggucuuauuacugcgcuggccugaagaaagugaccgaagucaagggcuauaccaaagggggaccuggccaugaggaacccauuccuauggccacauacggguggaaccucgugaaacuucacagcggaaaagacguguuuuucacacccccugagaagugugauacccugcugugcgacaucggcgaguccucuccgaaucccacgauugaagaggggcggacccucagaguucugaagauggucgaaccuuggcuucgcggaaaccaauuuuguaucaaaauucugaaucccuacaugccuagcgugguugagacacucgagcagaugcagcggaagcauggcggcaugcuggugagaaacccccugucccgcaauagcacccacgaaauguauugggucucuugcgggacaggaaacaucguguccgcugugaauaugaccagccggaugcuccugaacagauucacgauggcccaccgcaaaccgaccuacgagcgggaugucgaccuuggcgcggggacaagacauguugccguggaaccugagguggcuaaccuggauaucauuggacagcgcaucgaaaauauuaagcacgagcauaaaucuaccuggcacuaugacgaggauaaccccuacaagacaugggccuaucauggcuccuacgaagucaagcccagcgggucugcuuccagcauggugaauggaguugugaaacuccugaccaagccuugggacgucauccccauggugacacaaauugccaugaccgauacgacaccuuuuggccagcagagaguuuucaaagagaagguggacacccggaccccgaaagcuaagcgcggcacagcccaaaucauggaagucacggcgagauggcuuuggggguuucugucccggaacaagaaacccagaaucuguacccgggaggaguucacacgcaaggugagaagcaaugccgcuauuggagccguuuuuguggacgagaaccaguggaacucugcuaaagaggccgucgaagaugagcgguucugggaccucgugcagaaggaacgcgagcugcacaaacagggcaagugcgcgaccugcgucuauaacaugauggggaagagagagaagaagcugggagaguuuggcaaagcgaaggggagccgggcuaucugguacauguggcucggcgcccgcuuccuggaguuugaagcccuuggauucaugaaugaggaucacugguucuccagagaaaacucucugagcggcguggagggggagggacuccauaaacugggcuacauucuucgggacaucuccaagauuccugggggaaauauguaugcugaugacacagccggcugggauacccgcaucacagaagacgaucugcaaaacgaggcuaaaaucaccgacauuauggaacccgagcacgcccuccuggcgacgucuaucuuuaagcugaccuaccagaauaagguugugagaguccagcggccugccaaaaacgggacagugauggaugugauuagccgcagagaccagcggggcuccggacaaguuggcaccuaugggcucaauacauucaccaacauggaagcucagcugauccgccagauggagucugagggaauuuuucuucccagcgaacuggagacgccgaaccucgccgaaagagugcuggauuggcuugagaaguacggcgucgaacggcugaaaagaauggcuaucuccggggacgacugugugguuaagccuaucgaugaccgcuucgccacagcgcucaccgcccugaaugauaugggaaaagugcggaaggacauuccccagugggagccuagcaagggcuggaacgauuggcaacagguccccuuuugcucucaucacuuccaccagcugaucaugaaagacgggagagagauuguggucccuugucgcaaucaggaugaacucgugggccgggcuagaguuucccaaggagccggcuggagccugcgcgagacagcuugccuugggaagucuuaugcccagauguggcagcugauguacuuucaucggagagaccuccgccuggcugccaacgcgaucuguuccgccgugcccgucgauugggugccgaccagccggacgaccugguccauucacgcucaucaccaauggaugacaaccgaagacaugcuuucuguuuggaauagaguguggaucgaggaaaacccuuggauggaggauaaaacacaugucagcuccuggggagacgugcccuaucugggcaagcgcgaggaccaguggugcgggagccucauuggacugaccgcccgggccacaugggcuucuaauauccagguggccaucaaccagguuagacggcugauuggcaaugaaaacuaccucgauuacaugaccuccaugaaaagauucaagaaugagggggaccccgaaggcgcguuuugguga

SEQ ID NO: 18915 - RNA, 9879 nt, Artificial Sequence
  derived and/or modified CDS sequence (opt5) from DENV-1__FJ410212__SS-prME
agcgugaccaugcugcucaugcugaugcccacagcucuugcuuuccaccugacgaccagaggaggggagccucauaugaucguguccaagcaggaacggggaaaaucucuccuguuuaagaccagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccagaccggcgagcacagacgggagaagcgcucugucgcccuggcuccucauguggggcugggacucgaaacaagaaccgagacguggaugagcuccgaaggcgccuggaaacagauucagcggguugagacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggacuuuguugagggacugagcggcgccacauggguggaugucgugcucgaacacgggucuugugugacgaccauggcuaaggacaaacccacacuggauaucgagcugcucaagaccgaagucacaaacccugccguucugcgcaaacuuugcauugaggcgaagaucuccaauaccacgacagacagcagauguccgacccaaggagaagccacccugguggaggagcaggaugcuaacuucgugugccggcgcacauuugucgacagaggcuggggcaauggguguggacucuucggcaaagggucucugcuuaccugcgccaaguuuaagugcgugacaaaacuggaaggaaagauuguucaguacgagaaccucaaauauuccgugaucgucacggugcacaccggcgaucagcaucaaguugggaaugaaagcacagagcacggaaccacagcuaccaucacgccccaggccccuaccacagaaauucagcugaccgacuacggcgcccugacacucgacuguucuccccggaccggccuggauuucaacgagauggugcuucugacgaugaaggagaaauccuggcucguccauaagcagugguuucuggaccuuccucugcccuggacaagcggggcuuccaccucucaagaaacauggaaucgccaggaucuccuggugaccuucaaaaccgcgcacgccaagaagcaggaggucgugguucugggaagccaagaaggcgcuaugcacacagcccucacgggggccaccgagauccagacauccggaaccacaaccauuuuugcuggccaucugaaaugcagacuuaagauggacaaacugacgcucaaggggaugagcuaugugauguguacaggcucuuucaaacuggaaaaggaggucgccgagacccagcacggaaccgugcugguucagaucaaguacgaaggcacagaugcgccgugcaaaauuccuuucuccacccaagacgagaagggggugacacagaacggacggcuuaucacggcuaaucccaucgucaccgauaaagaaaagccugugaacauugaggccgagccgcccuuuggcgaaagcuauaucgugauuggggccggagagaaagcucucaagcugucuugguucaagaaaggcagcuccaucgggaagauguuugaagccacagcuagaggcgcccgccggauggcgauucugggagacaccgccugggauuucggcucuaucgggggaguuuuuacaagcgucggcaaacucgugcaucagaucuucgggaccgcuuacggagugcuguuuuccggcgucagcuggacgaugaagauugggaucggcgcccuucugaccuggcucggacucaauucuagauccacaagccugucuaugaccuguauugcugugggccuuguuacacucuaccugggggugaugguccaggccgacuccggaugcgugaucaacuggaaaggccgcgagcugaagugugggagcggaauuuucguuaccaaugaagugcacacauggaccgagcaauauaaguuucaggcggauuccccuaaacggcucucugccgcuaucggcaaggccugggaggaaggggucugcggcauuagaagcgcuacgcgccuggagaacaucauguggaaacagaucuccaacgaacuuaaucauauucugcucgagaacgacaugaaguucacagugguugugggagacgucgccggcauccuggugcaggggaaaaagaugauucggccgcaacccauggaauacaaauauucuuggaaaagcuggggaaaggccaaaaucauuggcgcugaugugcaaaauuccaccuuuaucaucgacgggccuaacacccccgaguguccugaugaccagagagcguggaauauuugggaggucgaagauuacggauucggcaucuuuacaaccaacauuuggcugaaacuucgcgacagcuauacgcagguuugcgaucaccggcucaugucugccgcuaucaaagacuccaaggccgugcacgccgauaugggcuacuggauugagagcgagaagaaugagacauggaagcuggcuagagccucuuucaucgaagugaagaccuguaucuggcccaaaucccauacacuguggagcaacgggguccucgagucugagaugauuaucccgaagauucacggaggcccuaucagccaacauaauuaucgccccggguacuucacccagacagcgggaccuuggcaccugggcaaacuugaacuggacuuugaucucugcgaggggaccacggugguuguggacgaacacugcggaaaccggggccccucccugagaaccacaaccgucacaggcaagauuauccaugagugguguugccggagcuguacccugccuccccuucgcuucagaggggaggauggaugcugguacggcauggaaauccggccggugaaagagaaggaagagaaucucguuaagucuaugguguccgcugggagcggagaagucgacuccuuuucucugggccugcucuguauuagcaucaugauugaggaggugaugagaucccgcuggucucggaaaaugcugaugacggggacacuugccguuuucuuucugcucaucaugggacagcugaccuggaacgaccugauuagacuuugcaucauggugggcgccaaugcuagcgaucgcaugggcauggggacaaccuaucuggcccucauggcgaccuucaagaugagaccuauguuugcugucggacugcuguuccggcgccugacauccagagaagugcuucugcucacgauuggccugucucugguggccagcgucgagcuucccaacucccuggaagaacugggggacggacuggccaugggcaucaugauccucaaacugcuuaccgauuuucaaagcuaccagcugugggcuacacuccugucucugaccuucauuaagacaaccuuuucccuucacuaugccuggaaaacgauggcuaugguucugagcaucgugucucucuucccccugugucucuccacaaccagccagaagaccacauggcugccugugcuucuggggucucugggaugcaagccgcucaccauguuucugauugccgaaaauaaaaucuggggccggaaguccuggccccuuaacgagggcauuauggcggucgggaucgugagcauccugcucuccagccugcucaaaaacgacguuccucuggccggaccccuuauugcuggcgggaugcugaucgccuguuacgugauuucuggaagcuccgcugaucugucucucgagaaggccgccgaagucagcugggaggaagaggcugaacauuccggcgcgucucacaauauccugguggagguucaggacgaugggacaaugaaaauuaaggacgaggaacgcgaugacacgcuuaccauccugcucaaagccacacugcucgcugugagcggagucuauccucuguccauccccgccacccuuuucguguggcauuucuggcaaaagaagaaacagagaucuggcguccugugggauacaccuagcccucccgagguggaacgggccguucuggacgauggcauuuaccgcaucaugcagagagggcuccugggacggucccaggugggcgucgggguguuucaagagaacguuuuccacaccauguggcacgugacgcgcggagcuguccuuauguaucagggcaagagacuggagcccagcugggccucugugaaaaaggaccucauuuccuacgggggaggcuggcgguuucagggcagcuggaauaccggggaagaggugcagguuaucgcggucgaacccggcaaaaacccuaagaaugugcaaacagcucccggcaccuucaagacaccggagggggaagugggagccauugcccuggacuuuaaaccuggcaccucugggucccccaucgucaacagagagggaaagauugugggccucuacggcaaugggguugugacaacgagcggaaccuaugucuccgcuaucgcccaggcgaaggcuucucaggagggcccucugcccgaaaucgaggaugaaguguuccgcaagcggaaccuuacaauuauggaccugcaucccgggagcggaaaaaccagacgcuaccugccugccaucguucgggaggccauuaagagaaagcuccgcacccugauccuugcuccgacacggguggucgccuccgaaauggcugaggcccugaaaggcaugcccauuagauaucaaacgaccgcggucaagagcgagcacacagggaaagaaaucguugaucucaugugccaugccaccuuuacaaugcgccugcugucuccugugcggguccccaauuacaacaugaucauuauggacgaggcucacuucaccgauccuuccagcaucgccgcuagaggcuauauuucuacgcgggugggaaugggcgaagccgccgcuaucuuuaugacagcgacacccccugggagcauggaggccuucccgcaguccaaugcugugauucaggacgaagaaagagauauccccgagagaucuuggaacagcggauacgaauggaucaccgacuuuccuggcaagacagucugguucguucccuccauuaaagccgggaaugauaucgccaacugucuccggaagaauggaaagcgcgugauucagcuuucuagaaaaaccuucgacacagaguaucaaaagaccaaaaacaacgauugggacuacguggucacgacagacaucagcgaaaugggcgcuaauuuucgggccgauagagugauugacccucgccggugccugaagcccguuauccugaaagaugggccggagagagugauucucgcgggcccuaugcccgucaccguggcuuccgccgcccagcgccggggaagaaucggccgcaaccauaauaaggagggggaccaguacaucuauaugggacagccccugaacaaugaugaagaccacgcucacuggacagaggccaagaugcuucuggauaacauuaauaccccugaaggcaucauucccgcccucuucgagccugaacgggagaaaagcgccgcuaucgacggggaguacagacugcgcggagaagccagaaagacguuuguugagcugaugcggcgcggcgaucucccgguguggcuuucuuauaaagucgcuuccgaaggguuccaauacagcgacagacgguggugcuuugauggcgagcgcaacaaucaggugcuggaagagaacauggacgucgagauuuggaccaaggaaggagagcgcaaaaagcugcggcccagauggcucgaugcccgcacauauuccgacccucuggcccuucgggaguucaaagaguuugccgcgggcagacgcucugugagcggggaccugauccucgaaaucggaaagcugccccagcaucugacccagcgggcccaaaaugcucucgauaaccuuguuaugcugcacaauuccgagcagggcgggagagccuaccggcaugcuauggaggaacugccugacacaauugagacccucaugcugcuugcccugaucgccgugcucacaggaggcgugacccuguucuuucugucuggcaaggggcucggaaaaacgagcauuggccuucugugugucauggcuuccagcguucugcucuggauggcgucuguggaaccccacuggaucgccgcuuccauuauccuggaguucuuucuuauggugcugcucaucccggagccugaucgccagagaacaccccaggacaaccaacuggccuaugucgugauugggcuccucuucaugauccuuaccguugccgcuaaugaaaugggacugcuggagaccacaaagaaagaucucggcauugggcacguggccgucgaaaaccaucaccaugcggccaugcuggacguggaucuucacccugcuagcgccuggacccuguacgcugucgccacaacgaucgugacccccaugaugcggcauacaauugagaacaccacagcgaauaucucucucaccgccauugcuaaccaggccgcuauccugaugggacuggacaagggcuggccuaucuccaaaauggauauuggcguuccccuccuugcccuggggugcuacagccaggugaauccgcugacgcucaccgcugccguccugaugcuuguggcgcacuaugccaucauuggaccuggccugcaagcuaaggccacacgcgaagcucagaagagaaccgccgccgggaucaugaaaaaccccacaauugacggaaucguugcgaucgaucucgaccccguggucuacgaugcuaaguuugagaaacagcugggccagauuaugcugcucauccuuuguaccucucaaauucugcugaugcggacgacaugggcccucugcgagagcaucacccuggcuacagggccucuuaccacccugugggaaggauccccgggcaaguucuggaauacaacgauugccgugucuauggccaacaucuuccgcggcagcuaucucgcuggggccggacuggcguuuucccugaugaaaagccucggcgggggaagacggggcaccggggcccagggagagacacuuggcgaaaaguggaagcgccagcugaaucagcuguccaaaucugaguucaacaccuacaagagaagcggcaucauggaaguggaccgguccgaggcuaaagaggggcucaagagaggagaaacaaccaaacacgccguuucucgcggcacggcuaagcugcggugguuugucgagagaaaucuugugaagcccgaagggaaagugauugaccugggauguggccgcgggggauggagcuauuacugcgccggccucaagaaagucacagagguuaagggcuauaccaaagggggaccuggccaugaggaacccaucccuauggcgaccuacggguggaaccuggugaagcugcacuccggaaaagauguguucuuuauucccccugagaagugugacacacuccuuugcgauaucggcgaaucuagcccgaaucccaccauugaggaagggcggacacugagaguccugaagaugguggagccuuggcuccgcggaaaccaauucuguaucaaaauucugaaucccuacaugccuuccguuguggagacgcuugaacagaugcagcggaagcauggcggcaugcuggucagaaacccccucagccgcaauucuacccacgagauguauuggguguccugcgggacaggaaacaucguuagcgccgugaauaugaccucucggaugcugcugaacagauuuacaauggcucaccgcaaaccgaccuacgaacgggacgucgaucucggcgccgggacgagacauguggcuguggagccugaagucgccaaccuggacaucauuggacagcgcaucgagaauauuaagcacgagcauaaauccaccuggcacuaugaugaagacaaccccuacaagacaugggcuuaucauggcagcuacgagguuaagcccucuggguccgccagcuccauggugaauggaguggucaaacuucugaccaagccuugggaugugauccccaugguuacacaaauugcgaugaccgacacaaccccuuucggccagcagagaguguuuaaagaaaaggucgauacgcggacaccgaaagccaagcgcggcaccgcucaaaucauggaggugaccgccagauggcucuggggguuccugagccggaacaagaaacccagaaucuguacacgggaagaguuuacgcgcaagguuagaucuaaugcugccauuggagccguguucgucgacgagaaccaguggaauagcgcgaaagaagcuguggaggacgaucgguuuugggaccuuguucaccgcgaaagagagcugcacaagcagggcaaaugcgcgaccugcguguauaacaugauggggaagcgggaaaagaaacucggagaguucggcaaggccaaagggucccgcgcuaucugguacauguggcugggcgccagauuccuggaguuugaagcucucggauucaugaaugaggaucauugguuuucucgggaaaacagccuguccggcgucgagggggagggacuucacaagcugggcuacauucuccgcgacaucucuaaaauuccugggggaaauauguaugccgaugacacagcgggcugggauaccagaaucacagaagacgaucugcagaacgaggccaagaucaccgacauuauggaacccgagcaugcccuucuggccaaaagcaucuucaagcucacauaccaaaauaaggugguccgggugcagcgcccugcuaaaaacgggaccguuauggaugugauuuccagacgggaccagcgcggcucuggacaggucggcacguaugggcugaauaccuuuacaaacauggaagcccaacugaucagacagauggagagcgagggaauuuuccuccccaacgaacuggagaccccgaaucuugcgggccgggugcuggauuggcucgaaaaguacgggguggagagacugaaacgcauggccaucuccggagacgacuguguugugaagccuaucgaugaccgguuugcuacagcccuuaccgcucugaacgauaugggcaaagucagaaaggacauuccccagugggaaccuagcaagggguggaaugauuggcagcaagugcccuucugcucucaccacuuucaucagcucaucaugaaagacggccgcgagauuguugugccuugucggaaccaggaugagcuggucggcagagcucgcgugucccagggagcuggguggagccugcgggaaacggccugccucggaaagucuuaugcgcaaauguggcagcugauguacuuccacagacgcgaccuucggcuggccgcuaaugccaucuguuccgccguccccguggauuggguuccgacaagcagaaccacaugguccauucaugcucaccaucaguggaugaccacggaggacaugcucucuguguggaaccgcgucuggaucgaagagaauccuuggauggaagauaaaacccggauuagcuccugggaggacgugcccuaucugggcaagagagaggaccaauggugcgggagccuuaucggacugacagcccgggcgaccugggcuacaaacauccagguugccauuaaucaggugagacgccucaucggcaacgaaaauuacucugauuacaugaccuccaugaaacgguuuaagaacgagagcgaacccgagggggcccugugguga

SEQ ID NO: 18916 - RNA, 9879 nt, Artificial Sequence
  derived and/or modified CDS sequence (opt5) from DENV-1__FJ461307__SS-prME
agcgugaccaugcugcucaugcugaugcccacggcccuugcuuuccaccugacgaccagaggaggggagccucauaugaucgucuccaagcaggaacggggaaaaucucuccuguuuaagaccagcgccggaguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccagaccggcgagcacagacgggagaagcgcucugucgcccuggcuccucauguggggcugggacucgaaacaagaaccgagacguggaugagcuccgaaggcgccuggaaacagauucagcggguugagacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggacuuuguugagggacugagcggcgccacauggguggaugucgugcucgaacacgggucuugugugacgaccauggcuaaggacaaacccacacuggauaucgagcugcucaagaccgaagucacaaacccugccguucugcgcaaacuuugcauugaggcgaagaucuccaauaccacgacagacagcagauguccgacccaaggagaagccacccugguggaggagcaggaugcuaacuucgugugccggcgcacauuugucgacagaggcuggggcaauggguguggacucuucggcaaagggucucugcuuaccugcgccaaguuuaagugcgugacaaaacuggaaggaaagauuguucaguacgagaaccucaaauauuccgugaucgucacggugcacaccggcgaucagcaucaaguugggaaugaaagcacagagcacggaaccacagcuaccaucacgccccaggccccuaccacagaaauucagcugaccgacuacggcgcccugacacucgacuguucuccccggaccggccuggauuucaacgagauggugcuucugacgaugaaggagaaauccuggcucguccauaagcagugguuucuggaccuuccucugcccuggacaagcggggcuuccaccucucaagaaacauggaaucgccaggaucuccuggugaccuucaaaaccgcgcacgccaagaagcaggaggucgugguucugggaagccaagaaggcgcuaugcacacagcccucacgggggccaccgagauccagacauccggaaccacaaccauuuuugcuggccaucugaaaugcagacuuaagauggacaaacugacgcucaaggggaugagcuaugugauguguacaggcucuuucaaacuggaaaaggaggucgccgagacccagcacggaaccgugcugguucagaucaaguacgaaggcacagaugcgccgugcaaaauuccuuucuccacccaagacgagaagggggugacacagaacggacggcuuaucacggcuaaucccaucgucaccgauaaagaaaagccugugaacauugaggccgagccgcccuuuggcgaaagcuauaucgugauuggggccggagagaaagcucucaagcugucuugguucaagaaaggcagcuccaucgggaagauguuugaagccacagcuagaggcgcccgccggauggcgauucugggagacaccgccugggauuucggcucuaucgggggaguuuuuacaagcgucggcaaacucgugcaucagaucuucgggaccgcuuacggagugcuguuuuccggcgucagcuggacgaugaagauugggaucggcgugcuucugaccuggcucggacucaauucuagauccacaagccugucuaugaccuguauugccguuggccuugugacacucuaccugggggucauggugcaggcugacuccggaugcguuaucaacuggaaaggccgcgagcugaagugugggagcggaauuuucgugaccaaugaaguccacacauggaccgagcaauauaaguuucaggccgauuccccuaaacggcucucugcggccaucggcaaggcuugggaggaaggggugugcggcauuagaagcgccacgcgccuggagaacaucauguggaaacagaucuccaacgaacuuaaucauauucugcucgagaacgacaugaaguucacaguuguggucggagacguggcuggcauccuggugcaggggaaaaagaugauucggccgcaacccauggaauacaaauauucuuggaaaagcuggggaaaggccaaaaucauuggcgccgauguccaaaauuccaccuuuaucaucgacgggccuaacacccccgaguguccugaugaccagagagcuuggaauauuugggagguugaagauuacggauucggcaucuuuacaaccaacauuuggcugaaacuucgcgacagcuauacacaggugugcgaucaccggcucaugucugcggccaucaaagacuccaaggcugugcacgccgauaugggcuacuggauugagagcgagaagaaugagacauggaagcuggccagagcuucuuucaucgaagucaagaccuguaucuggcccaaaucccauacacuguggagcaacggggugcucgagucugagaugauuaucccgaagauucacggaggcccuaucagccaacauaauuaucgccccggguacuucacccagacagccggaccuuggcaccugggcaaacuugaacuggacuuugaucucugcgaggggaccacgguuguggucgacgaacacugcggaaaccggggccccucccugagaaccacaaccgugacaggcaagauuauccaugagugguguugccggagcuguacccugccuccccuucgcuucagaggggaggauggaugcugguacggcauggaaauccggccgguuaaagagaaggaagagaaucucgugaagucuauggucuccgcggggagcggagaaguggacuccuuuucucugggccugcucuguauuagcaucaugauugaggagguuaugagaucccgcuggucucggaaaaugcugaugacggggacacuugcuguguucuuucugcucaucaugggacagcugaccuggaacgaccugauuagacuuugcaucauggucggcgccaaugccagcgaucgcaugggcauggggacaaccuaucuggcucucauggccaccuucaagaugagaccuauguuugcggugggacugcuguuccggcgccugacauccagagaagugcuucugcucacgauuggccugucucuggucgcuagcguugagcuucccaacucccuggaagaacugggggacggacuggccaugggcaucaugauccucaaacugcuuaccgauuuucaaagcuaccagcugugggccacacuccugucucugaccuucauuaagacaaccuuuucccuucacuaugcuuggaaaacgauggccauggugcugagcaucgugucucucuucccccugugucucuccacaaccagccagaagaccacauggcugccuguccuucuggggucucugggaugcaagccgcucaccauguuucugauugcugaaaauaaaaucuggggccggaaguccuggccccuuaacgagggcauuauggccguggggaucguuagcauccugcucuccagccugcucaaaaacgacgugccucuggcgggaccccuuauugccggcgggaugcugaucgcuuguuacgucauuucuggaagcuccgccgaucugucucucgagaaggcugccgaagugagcugggaggaagaggccgaacauuccggcgcuucucacaauauccugguugaggugcaggacgaugggacaaugaaaauuaaggacgaggaacgcgaugacacgcuuaccauccugcucaaagcgacacugcucgccgucagcggaguguauccucuguccauccccgcuacccuuuucgucuggcauuucuggcaaaagaagaaacagagaucuggcgugcugugggauacaccuagcccucccgagguugaacgggccgugcuggacgauggcauuuaccgcaucaugcagagagggcuccugggacggucccaggucggcguggggguuuuucaagagaacguguuccacaccauguggcacgucacgcgcggagccgugcuuauguaucagggcaagagacuggagcccagcugggcuucugugaaaaaggaccucauuuccuacgggggaggcuggcgguuucagggcagcuggaauaccggggaagagguucaggucaucgccguggaacccggcaagaacccuaagaaugugcaaacagcgcccggcaccuucaagacaccggagggggaagucggagcuauugcccuggacuuuaaaccuggcaccucugggucccccaucgugaacagagagggaaagauuguuggccucuacggcaaugggguggucacaacgagcggaaccuauguguccgccaucgcucaggccaaagcgucucaggagggcccucugcccgaaaucgaggaugaaguuuuccgcaagcggaaccuuacaauuauggaccugcaucccgggagcggaaaaaccagacgcuaccugccugcuaucgugcgggaggccauuaagagaaagcuccgcacccugauccuugccccgacacgggucguggcuuccgaaauggccgaggcucugaaaggcaugcccauuagauaucaaacgaccgccguuaagagcgagcacacagggaaagaaaucguggaucucaugugccaugcgaccuuuacaaugcgccugcugucuccuguccgggugcccaauuacaacaugaucauuauggacgaggcccacuucaccgauccuuccagcaucgcugccagaggcuauauuucuacgcgggugggaaugggcgaagcugccgccaucuuuaugacagcuacacccccugggagcauggaggcguucccgcaguccaaugccgucauucaggacgaagaaagagauauccccgagagaucuuggaacagcggauacgaauggaucaccgacuuuccuggcaagacaguuugguucgugcccuccauuaaagcugggaaugauaucgccaacugucuccggaagaauggaaagcgcgugauucagcuuucuagaaaaaccuucgacacagaguaucaaaagaccaaaaacaacgauugggacuacgucgugacgacagacaucagcgaaaugggcgccaauuuucgggcugauagaguuauugacccucgccggugccugaagcccgugauccugaaagaugggccggagagagucauucucgccggcccuaugcccgugaccguugcguccgcugcccagcgccggggaagaaucggccgcaaccauaauaaggagggggaccaguacaucuauaugggacagccccugaacaaugaugaagaccacgcccacuggacagaggcuaagaugcuucuggauaacauuaauaccccugaaggcaucauucccgcccucuucgagccugaacgggagaaaagcgcggccaucgacggggaguacagacugcgcggagaagcuagaaagacguuuguggagcugaugcggcgcggcgaucucccggucuggcuuucuuauaaaguggccuccgaaggguuccaauacagcgacagacgguggugcuuugauggcgagcgcaacaaucagguccuggaagagaacauggacguggagauuuggaccaaggaaggagagcgcaaaaagcugcggcccagauggcucgaugcucgcacauauuccgacccucuggcccuucgggaguucaaagaguuugcugccggcagacgcucuguuagcggggaccugauccucgaaaucggaaagcugccccagcaucugacccagcgggcgcaaaaugcccucgauaaccuugugaugcugcacaauuccgagcagggcgggagagcuuaccggcaugccauggaggaacugccugacacaauugagacccucaugcugcuugcucugaucgccgugcucacaggaggcgucacccuguucuuucugucuggcaaggggcucggaaaaacgagcauuggccuucuguguguuauggccuccagcgugcugcucuggauggcuucuguggaaccccacuggaucgcggccuccauuauccuggaguucuuucuuaugguccugcucaucccggagccugaucgccagagaacaccccaggacaaccaacuggcuuaugugguuauugggcuccucuucaugauccuuaccguggccgccaaugaaaugggacugcuggagaccacaaagaaagaucucggcauugggcacgucgcuguggaaaaccaucaccaugccgcgaugcuggacgucgaucuucacccugccagcgcuuggacccuguacgccguggcuacaacgaucauuacccccaugaugcggcauacaaucgagaacaccacagccaauauuucucucaccgcgaucgccaaccaggcugccauccugaugggacuggacaagggcuggccuauuuccaaaauggauaucggcguuccccuccuugcucuggggugcuacagccaggugaauccgcugacgcucaccgccgcuguccugaugcuuguggcccacuaugcgauuaucggaccuggccugcaagccaaggcuacacgcgaagcccagaagagaaccgcugccgggauuaugaaaaaccccacaaucgacggaaucguugccauugaucucgaccccguggucuacgaugcgaaguuugagaaacagcugggccagaucaugcugcucauucuuuguaccucucaaauccugcugaugcggacgacaugggcucucugcgagagcauuacccuggccacagggccucuuaccacccugugggaaggauccccgggcaaguucuggaauacaacgaucgcugugucuauggccaacaucuuccgcggcagcuaucucgccggggcuggacuggccuuuucccugaugaaaagccucggcgggggaagacggggcaccggggcgcagggagagacacuuggcgaaaaguggaagcgccagcugaaucagcuguccaaaucugaguucaacaccuacaagagaagcggcauuauggaaguggaccgguccgaggccaaagaggggcucaagagaggagaaacaaccaaacacgcuguuucucgcggcacggccaagcugcggugguuugucgagagaaaucuugugaagcccgaagggaaagugaucgaccugggauguggccgcgggggauggagcuauuacugcgcuggccucaagaaagucacagagguuaagggcuauaccaaagggggaccuggccaugaggaacccauuccuauggccaccuacggguggaaccuggugaagcugcacuccggaaaagauguguucuuuauucccccugagaagugugacacacuccuuugcgauaucggcgaaucuagcccgaaucccaccaucgaggaagggcggacacugagaguccugaagaugguggagccuuggcuccgcggaaaccaauucuguauuaaaauccugaaucccuacaugccuuccguuguggagacgcuugaacagaugcagcggaagcauggcggcaugcuggucagaaacccccucagccgcaauucuacccacgagauguauuggguguccugcgggacaggaaacaucguuagcgcggugaauaugaccucucggaugcugcugaacagauuuacaauggcccaccgcaaaccgaccuacgaacgggacgucgaucucggcgcugggacgagacauguggccguggagccugaagucgcuaaccuggacauuaucggacagcgcauugagaauaucaagcacgagcauaaauccaccuggcacuaugaugaagacaaccccuacaagacaugggccuaucauggcagcuacgagguuaagcccucuggguccgcuagcuccauggugaauggaguggucaaacuucugaccaagccuugggaugugauucccaugguuacacaaaucgccaugaccgacacaaccccuuucggccagcagagaguguuuaaagaaaaggucgauacgcggacaccgaaagcgaagcgcggcaccgcccaaaucauggaggugaccgcuagauggcucuggggguuccugagccggaacaagaaacccagaauuuguacacgggaagaguuuacgcgcaagguuagaucuaaugccgcuaucggagccguguucgucgacgagaaccaguggaauagcgccaaagaagcgguggaggacgaucgguuuugggaccuuguucaccgcgaaagagagcugcacaagcagggcaaaugcgcuaccugcguguauaacaugauggggaagcgggaaaagaaacucggagaguucggcaaggccaaagggucccgcgccauuugguacauguggcugggcgcuagauuccuggaguuugaagcccucggauucaugaaugaggaucauugguuuucucgggaaaacagccuguccggcgucgagggggagggacuucacaagcugggcuacauccuccgcgacauuucuaaaaucccugggggaaauauguaugcugaugacacagccggcugggauaccagaaucacagaagacgaucugcagaacgaggcgaagauuaccgacaucauggaacccgagcaugcccuucuggcuaaaagcauuuucaagcucacauaccaaaauaaggugguccgggugcagcgcccugccaaaaacgggaccguuauggaugugaucuccagacgggaccagcgcggcucuggacaggucggcacguaugggcugaauaccuuuacaaacauggaagcucaacugauuagacagauggagagcgagggaaucuuccuccccaacgaacuggagaccccgaaucuugccggccgggugcuggauuggcucgaaaaguacgggguggagagacugaaacgcauggcgaucuccggagacgacuguguugugaagccuauugaugaccgguuugccacagcucuuaccgcccugaacgauaugggcaaagucagaaaggacaucccccagugggaaccuagcaagggguggaaugauuggcagcaagugcccuucugcucucaccacuuucaucagcucauuaugaaagacggccgcgagaucguugugccuugucggaaccaggaugagcuggucggcagagcucgcgugucccagggcgccggguggagccugcgggaaacggcuugccucggaaagucuuaugcccaaauguggcagcugauguacuuccacagacgcgaccuucggcuggcggccaaugcuauuuguuccgccguccccguggauuggguuccgacaagcagaaccacaugguccauccaugcccaccaucaguggaugaccacggaggacaugcucucuguguggaaccgcgucuggauugaagagaauccuuggauggaagauaaaacccggaucagcuccugggaggacgugcccuaucugggcaagagagaggaccaauggugcgggagccuuaucggacugacagcucgggccaccugggcgacaaacauucagguugcuaucaaucaggugagacgccucauuggcaacgaaaauuacucugauuacaugaucuccaugaaacgguuuaagaacgagagcgaacccgagggggcccugugguga

SEQ ID NO: 18917 - RNA, 9879 nt, Artificial Sequence
  derived and/or modified CDS sequence (opt5) from DENV-1__FJ410213__SS-prME
agcgugaccaugcugcucaugcugaugcccaccgcccuugcuuuccaccugacgaccagaggcggggaaccucauaugaucgugacaaagcaggaacggggaaaaucccuccuguuuaagaccucugccggcguuaauaugugcacacuuauugcgauggaccugggggaacucugugaagauaccaugacauacaaaugcccccgcaucaccgaagcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuuguuacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacguccagaauaccaccuuuaucaucgaugggccuaacacacccgaauguccugacgaucagagagcuuggaauauuugggagguugaggacuauggauucggcaucuuuaccacgaacauuuggcugaagcugcgcgauuccuacacacaggugugcgaccaccggcuuaugagcgcggccaucaaagauucuaaggcugugcaugccgacaugggcuauuggauugaauccgagaaaaaugaaaccuggaagcucgccagagcuagcuucaucgaggucaagacauguaucuggcccaaaucucacacccugugguccaacggggugcuggaaagcgagaugauuaucccgaagauuuacggaggcccuaucucucaacauaauuaucgccccggguacuucacacagaccgccggaccuuggcaccucggcaaacuggagcuugauuuugaccugugcgaagggacgaccguuguggucgaugagcacugcggaaaccggggccccagccucagaacaaccacagugaccggcaagauuauccaugaaugguguugccgguccuguacgcugccuccccugcgcuucaaaggggaggacggaugcugguacggcauggagaucagaccgguuaaggaaaaggaggaaaaucuugugaaaagcauggucucugcgggguccggagagguggacagcuuuucccucggccugcuguguauuucuaucaugauugaagagguuaugcggagcagauggucccgcaagaugcucaugacagggacccuggcuguguuccuucugcucaucaugggacagcugacauggaacgaucugauucggcuuugcaucauggucggcgccaaugccucugacagaaugggcauggggaccaccuaucuggcucucauggccacauuuaaaaugcgcccuauguucgcggugggacugcucuuuagacggcugacgagccgcgaggugcuucugcucaccauuggccugucccuggucgcuucuguugaacuucccaacagccuggaggaacucggggauggacuggccaugggcaucaugauccucaagcugcuuacagacuuccaaucccaccagcugugggccacccuccugagccugacauuuauuaaaaccacgcuuucucugcauuacgcuuggaagacaauggccauggugcucuccaucgugagccuguucccccucugucugucuaccaccucccagaagacaaccuggcuuccuguccugcuggggagccucggaugcaaaccgcugacaauguuucuuauuacggagaauaagaucuggggcagaaaaucuuggccccugaacgaaggcauuauggcuguggggguuguguccauccuccugagcucccuccugaaggaugacgucccucuugccggaccccugaucgcgggcgggaugcugauugccuguuaugugaucagcggaucuagcgcugaucucucccuggagaaagccgcugagguuucuugggaagaggaagccgagcacagcggcgccucccauaacauucuuguggaaguccaggacgaugggaccaugaagaucaaagacgaggagcgggaugacacacugaccauucuccugaaggcuacacuccuggcggugucuggagucuacccucuuagcauccccgccacccuguucgugugguauuuuuggcaaaagaaaaagcagcgcuccggcguucugugggauacgccuucucccccggaaguggagagagcuguccucgacgacggcaucuaccggauuaugcagcgcgggcugcuuggaagaagccaggugggcguugggguguuccaagaaaaugucuuccacaccauguggcacgugacacggggagccgugcugauguaucagggcaaacgccucgagccuuccugggccagcguuaagaaagaucugaucucuuacgggggaggcuggagacuccagggcuccuggaacaccggggaggaaguccaggugauugcuguggagcccggaaagaauccuaagaacguccaaacagcccccggcaccuuuaaaacaccggaaggggaggugggagcgaucgcucuggacuucaagccuggcacgagcgggucucccauuguuaaucgggaaggaaaaaucgugggccuuuacggcaacggggucgugaccacauccggaaccuauguuagcgccauugcccaggcuaaggccucccaggagggcccucugcccgagaucgaagaugagguguuuagaaaacgcaaucugaccaucauggaccuccaucccgggucuggaaagacacggagauaccugccugcgauuguccgcgaagcuaucaagcggaaacuuagaacgcugauucucgccccgacccgcgugguugccagcgagauggcugaagcccugaagggcaugcccauccgguaucaaacaaccgcugugaaauccgagcacacagggaaggagauugucgaucugaugugccaugccaccuucacgaugagacuccuuagcccugugcgcgugcccaacuacaauaugaucaucauggacgaagcgcacuuuacagauccuucuuccauugccgcucggggcuauaucagcaccagagucggaaugggcgaggccgcugccauuuucaugaccgccacacccccugggucuguugaggcuuuuccgcagagcaacgcggugauccaggacgaggaacgggauauucccgagcgcuccuggaacucuggauacgaguggaucaccgacuucccuggcaaaacagugugguuuguccccagcaucaaguccgggaacgauauugccaauugucugagaaagaacggaaaacgggugauccagcugucucgcaagaccuucgacacggaauaucagaagaccaagaauaacgacugggauuacguugugaccacagacauuagcgagaugggcgcuaacuuuagagccgaucgggucaucgacccuagacgcugccucaaacccgugauucugaaggaugggccggaacggguuauccuugccggcccuaugcccgugaccgucgcuuccgccgcgcagagacgcggacggauuggcagaaaucauaacaaggagggggaccaguacaucuauaugggacagccccugaauaacgaugaggaccacgcucacuggacggaagccaaaaugcuccuggauaauaucaacaccccugagggcauuauccccgcccuguucgaaccugagcgcgaaaagagcgcugccauugacggggaguaccggcucagaggagaggcgcgcaaaacauucguggaacuuaugagacggggcgaucugccggucuggcugucuuauaagguggccuccgagggguuucaauacagcgaccgcagauggugcuucgauggcgaacggaauaaccagguucucgaggaaaauauggacguggagaucuggaccaaagagggagaacgcaagaaacugagaccccgguggcuugacgcuagaacauauuccgauccucuggcccuccgcgaguuuaaggaguucgcugccggccggagaucugugagcggggaccugauucuggagaucggaaagcucccccagcaucuuacccagcgcgcucaaaacgcccuggauaaucuggucaugcuccacaacuccgaacagggcgggcgggcguacagacaugccauggaggagcugccugacacaaucgaaacccuuaugcugcucgcucugauugccguucugacgggaggcgugacacucuuuuuccuuucuggccgggggcugggaaaaaccagcaucggccugcucugugugauggcuuccagcguccugcuuuggauggccucuguggagccccacuggauugccgcuuccaucauucuggaauuuuuccucaugguucugcugaucccggagccugaucgccagagaacaccccaggacaaucaacucgcguauguggucaucgggcuucuguuuaugauucugacaguggccgcuaacgagaugggacuccuggaaaccacaaagaaagaucuuggcaucgggcacgucgccguggagaaucaucaccaugccacgaugcuggacguugaucuccacccugcuagcgccuggacccuguacgcgguggccacaaccauuaucacacccaugaugcggcauaccauugaaaacacgaccgcuaacaucucucugacagccauugcuaaucaggccgcgauccucaugggacuugacaagggcuggccuaucuccaaaauggauauuggcgucccccugcuggcccucgggugcuacagccaggugaacccgcugacccuuacagcugccguucugaugcucguggcucacuaugccaucauuggaccuggccugcaagcuaaggccacccgcgaggcgcagaagagaacggccgcugggaucaugaaaaaucccacagucgacggaauuguggccaucgaucuggaccccgugguuuacgacgcuaaguucgaaaaacagcucggccagaucaugcuucugauucuguguaccucucaaauccuccugaugcggacaaccugggcccuuugcgagagcauuacccuggccacagggccucucacgacccugugggagggauccccgggcaaguuuuggaacacaaccaucgcggucucuauggcuaauauuuuccgcggcagcuaucuggccggggcuggacucgccuuuucccuuaugaaaagccugggcgggggaagacggggcacaggggcccagggagaaacccugggcgagaaguggaagcgccagcucaaccagcuguccaaaucugaguucaauaucuacaagagaagcggcaucauggagguggaucgguccgaagcuaaagaggggcuuaagagaggagagacgacacgccacgccgugucucggggcaccgcgaaacugagaugguucgucgaacgcaaccucguuaagcccgaggggaaggugauugaccugggauguggcagagggggauggagcuauuacugcgccggccugaaaaaggugaccgaagucaaaggcuauacaaaagggggaccuggccaugaggaacccaucccuauggcuaccuacggguggaaucucgugaaacuucacuccggaaaggaugucuuuuucacacccccugagaaaugugacacgcugcugugcgauauuggcgagucuagcccgaaccccaccaucgaagaggggagaacacuccgcgugcugaagauggucgaaccuuggcuucggggaaaucaauuuuguauuaagauccugaaccccuacaugccuuccgugguugagacccucgagcagaugcagagaaaacauggcggcaugcuggugcgcaauccccugagccggaacucuacacacgaaauguauugggucuccugcgggaccggaaauauugugagcgccgugaacaugacgucuagaaugcuccugaaucgcuucaccauggcucaccggaagccgacauacgagagagacgucgaucuuggcgccgggacccgccauguugcgguggaaccugagguggccaaccuggacaucaucggacagagaauugaaaacaucaaacacgagcauaaguccacauggcacuaugaugaggacaaucccuacaaaaccugggcuuaucauggcagcuacgaagucaagcccucuggguccgccagcuccauggugaacggaguugugaagcuccugacaaaaccuugggaugucauucccauggugacccaaaucgcuaugacggacacaaccccuuuuggccagcagcggguuuucaaggagaaaguggacacccgcacaccgaaggccaaaagaggcacggcucaaauuauggaagucaccgcccgguggcuuuggggguuucugagcagaaauaagaagccccggaucuguacacgcgaggaguucaccagaaaagugcggucuaacgcggccaucggagcuguuuuuguggaugagaaucaguggaacagcgccaaggaggcugucgaagacgagcgcuucugggaucucgugcagaaagaaagagagcugcacaagcagggcaaaugcgccacaugcgucuauaauaugauggggaagcgggaaaagaaacugggagaguuuggcaaggccaaagggucccgcgcgauuugguacauguggcucggcgcuagauuccuggaguuugaagcccuuggauucaugaacgaggaccacugguucucucgggaaaauagccuguccggcguggagggggagggacuccauaagcugggcuacauccuucgcgauauuucuaaaaucccugggggaaacauguaugccgacgauaccgcuggcugggacacaagaauuaccgaagaugaccugcaaaaugaggccaagaucacggauaucauggaacccgagcacgcucuccuggccaccagcauuuuuaaacugacauaccagaacaagguugugcggguccagcgcccugcgaagaaugggaccgugauggacgugaucuccagacgggaucagcgcggcucuggacaaguuggcacauaugggcucaacaccuucacgaauauggaagcccagcugauuagacagauggagagcgagggaaucuuucuucccuccgaacuggagacaccgaaccucgcugaacgggugcuggacuggcuugagaaauacggcgucgaaagacugaagcgcauggccauuagcggggacgauugugugguuaaaccuaucgacgaucgguucgcuaccgcccucacagcgcugaacgacaugggaaaggugagaaaagauaucccccagugggagccuucuaagggcuggaaugacuggcaacagguccccuuuugcucccaucacuuccaccagcugauuaugaaggaugggcgcgagaucguggucccuugucggaaccaggacgaacucgugggcagagcccgcguuagccaaggagcuggcuggucucugcgggagaccgccugccuugggaaauccuaugcucagauguggcagcugauguacuuucauagacgcgaucuccggcuggccgcuaaugccauuuguagcgcggugcccgucgacugggugccgacguccagaaccacauggucuauccacgcccaucaccaauggaugaccacagaagauaugcuuagcguuuggaaccgcguguggauugaggaaaauccuuggauggaggacaagacccaugucuccagcuggggagacgugcccuaucugggcaaacgggaggaucaguggugcgggucucucaucggacugacagcuagagccaccugggccuccaacauucagguggcuaucaaucagguucggagacugaucggcaacgaaaauuaccucgacuacaugacgagcaugaagcgcuucaaaaacgagggggaucccgaaggcgcccugugguga

SEQ ID NO: 18918 - RNA, 9879 nt, Artificial Sequence
  derived and/or modified CDS sequence (opt5) from DENV-1__FJ461308__SS-prME
agcgugacaaugcugcugaugcugaugcccacagcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagagccgaaaccuggaugagcuccgagggcgcuuggaaacagauucagcggguugaaacgugggcccuccgccaccccggcuuuacagugaucgcgcuguuccuugcccaugcuauugggaccucuaucacacagaagggaaucauuuuuauccugcucaugcuggucaccccuagcauggccaugagaugcgugggcauugggucccgggauuucguugagggacuuagcggcgcuaccuggguggacgucgugcuggagcacgggucuugugugacaacgauggccaaggauaaacccacccucgacaucgaacugcugaagacagaggucaccaacccugcgguucuccgcaaacugugcauugaagccaagaucuccaauacaaccacggauagcagauguccgacacaaggagaggcuacccuuguggaagaacaagacgccaacuuugugugccggcgcaccuucgucgauagaggcuggggcaauggguguggacuguuuggcaaagggucucucauuacaugcgcuaaguucaagugcgugaccaaacuggagggaaagacaguucaguacgaaaaccuuaaauauuccgugaucgucacggugcacaccggcgaccagcaucaaguugggaaugagagcacagaacacggaaccacagccaccaucacgccccaggccccuucuaccgagauucagcugacagacuacggcgcucucacccuggauuguagcccccggacaggccuggacuuuaacgaaauggugcuccugaccaugaaggagaaaagcuggcuuguccauaagcagugguuccuggaucucccucugcccuggacguccggggcgucuacaagccaagagaccuggaaucgcaaagaccuucuggugacauuuaagaccgcccacgcuaagaaacaggaagucgugguucucggaucccaggagggcgccaugcacaccgcccugacaggggcuacggaaauccaaaccagcggaacaaccacaauuuucgccggccaucugaagugcagacucaaaauggauaagcugacccuuaaagggaugucuuaugugauguguacgggcuccuucaagcuggagaaggaagucgcggagacacagcacggaaccgugcucguucagaucaaauacgagggcaccgacgcuccgugcaagauuccuuuuagcacacaggaugaaaaaggggugacccaaaacggacggcugaucacagccaaucccaucgucacggacaaggagaaaccugugaacauugaagccgagccgcccuucggcgagucuuguaucgugauuggggcuggagaaaaggcccugaaacuuagcugguuuaaaaagggcuccucuaucgggaaaauguucgaggcuaccgccagaggcgcgcgccggauggccauucucggagauacagcuugggacuuuggcagcaucgggggaguuuucaccuccgucggcaagcuggugcaucagaucuuugggacagccuauggagugcuguucagcggcgucucuuggaccaugaaaauugggaucggcgugcuccugacguggcuuggacucaauuccagaagcaccucucucuccaugacaugcauugcuguuggccuggugacccuguaccuuggggucauggugcaggccgauagcggauguguuaucaacuggaagggccgcgaacucaagugcggguccggaauuuuugugacaaaugagguccacaccuggacagaacaguacaaauuccaagcggacucuccuaagcggcugagcgccgcuaucggcaaagccugggaggaggggguguguggcauuagauccgcuacccgccuggaaaacaucauguggaagcagaucucuaacgagcucaaucauauucugcuugaaaacgacaugaaauuuacgguuguggucggagauguggccggcauccuggcccaggggaagaaaaugauucggccgcagcccauggagcacaaguauagcuggaaguccuggggaaaagcuaagaucauuggcgcggacgugcaaaauacaaccuucaucaucgaugggccuaacacccccgaaugcccugacgaucagagagccuggaauauuugggaggucgaggacuacggauuuggcaucuucacaaccaacauuuggcucaaacugcgcgauagcuauacgcagguuugugaccaccggcugaugucugcugccaucaaggauuccaaagccgugcaugcugacaugggcuacuggauugaaagcgagaagaaugaaacauggaaacuugccagagcgucuuucaucgaggugaaaaccugcaucuggcccaagucccacacacucuggagcaacgggguccuggaaucugagaugauuaucccgaaaauuuauggaggcccuaucagccagcauaauuaccgccccggguauuuuacccaaacagcuggaccuuggcaccugggcaagcucgagcuggauuucgaccuuugcgaagggaccacggugguuguggaugagcacuguggaaaccggggccccucccugagaaccacaaccgucacaggcaaaauuauccaugaauggugcugucggagcugcacccucccuccccugcgcuuuaagggggaggacggauguugguacggcauggagaucagaccggugaaggaaaaagaggaaaaucugguuaagucuaugguguccgccgggagcggagaggucgacuccuucucucuuggccuccugugcauuagcaucaugauugaagaggugaugcgguccagauggucucgcaaaaugcugaugacggggacacucgccgucuuuuuccugcuuaucaugggacagcugaccuggaacgaucucauucggcuguguaucauggugggcgcuaaugccagcgacagaaugggcauggggacaaccuaccuggcgcuuauggcuaccuuuaagaugcgcccuauguucgccgucggacugcucuuuagacggcugacaucccgcgaggugcuccugcuuacgauuggccugucucucguggccagcgucgaacugcccaacucccuggaggaacuuggggauggacuggcuaugggcaucaugauccucaaacugcucaccgacuuccagagccaccaacugugggccacacuucugucucucaccuuuauuaagacaaccuucucccugcauuaugcuuggaagacgauggccaugguucugagcaucgugucucuuuuuccccugugccucuccacaaccagccagaaaaccacauggcugccugugcuccuggggucucuuggauguaagccgcugaccauguuccugauugcggagaauaaaaucuggggcagaaaguccuggccccucaacgaaggcauuauggccgucgggaucgugagcauccugcuuuccagccugcucaaaaacgauguuccucuggcuggaccccucauugccggcgggaugcugaucgcuugcuacgugauuucuggaagcuccgccgaccuuucucuggagaaggccgcugaggucagcugggaagaggaagcggagcacuccggcgccucucauaauauccugguggaaguucaggaugacgggacaaugaaaauuaaggaugaggagcgggacgauacgcucaccauccugcuuaaggcuacacugcucgccgugagcggagucuauccucuguccauccccgccacccucuucgugugguacuuuuggcagaaaaagaaacaacgcucuggcguccugugggacacaccuuccccucccgaaguggagagagcuguucuugaugacggcauuuaucggaucaugcagcgcgggcugcugggaagaucccaggugggcgucgggguguuccaggaaaacguuuuucacaccauguggcacgugacgcggggagccguccucauguaccaaggcaagcgccuggagcccagcugggcgucugugaaaaaggaccuuauuuccuaugggggaggcuggagacugcagggcagcuggaauaccggggaggaagugcagguuaucgcugucgagcccggaaagaacccuaaaaaugugcagacagcccccggcaccuucaagacaucugaaggggaggugggagccauugcucucgauuuuaaaccgggcaccuccgggagcccuaucgucaaccgggaaggaaagauugugggccuguacggcaaugggguugugacaacguccggaaccuacgucucugccaucgcgcaagcuaaagccagccaggagggcccccucccugagaucgaagacgagguguucagaaagcgcaaccugacaauuauggaucuucaucccggguccggaaagacccggagauaucugcccgccaucguucgcgaagcuauuaaacggaagcugagaacccucauccuggccccuacacgcguggucgcuagcgagauggccgaagcgcuuaaaggcaugccgauucgguaccagacgaccgccgugaagucugagcacacagggaaagagaucguugaccugaugugucaugcuaccuuuacaaugagacuccugucccccgugcgcgucccuaauuauaacaugaucauuauggaugaagcccacuucaccgaccccagcucuaucgcugcccggggcuacauuagcacgagagugggaaugggcgaggccgcugcgaucuuuaugacagccaccccucccggguccguggaggcuuucccucaaucuaaugccgucauucaggaugaagaacgggacaucccggagcgcagcuggaacuccggauaugaguggaucaccgauuuucccggcaagacaguuugguucgugccuucuauuaagagcgggaaugacaucgccaacugccugcgcaagaauggaaagcgggugauucagcucucccgcaaaaccuucgauacagaauaccagaagaccaaaaacaacgacugggacuaugucgugacgacagauaucagcgagaugggcgcuaauuuuagagccgaccggguuauugaucccagacgcugccuuaagccugugauccugaaggacgggcccgaacgggucauucuggcgggcccgaugccugugaccguugcuucugccgcccaaagacgcggacggaucggcagaaaccauaauaaagagggggaucaguacaucuacaugggacagccccucaacaaugacgaggaucacgcucacuggacagaagccaagaugcugcuugacaacauuaauacccccgagggcaucauuccugcgcuguucgaacccgagcgcgaaaaauccgccgcuaucgauggggaguaucggcucagaggagaggcccgcaagacguuuguggaacugaugagacggggcgaccugccugucuggcucagcuacaaaguggcuuccgagggguuccaguauucugaucgcagaugguguuuugacggcgaacggaacaaucaaguccuugaggaaaacauggauguggagauuuggaccaaggagggagaacgcaaaaagcugagaccgcgguggcuggacgccagaacauacagcgacccccucgcucugcgcgaguucaaggaauuugccgcgggccggagauccguuucuggggaucuuauccuggagaucggaaaacucccucagcaucugacccagcgcgcccagaaugcucuggacaaccucgugaugcuucacaauagcgaacaaggcgggcgggccuauagacaugcuauggaggagcugcccgauacaauugaaacccugaugcuccuggcccuuaucgccgugcugacaggaggcgucacccucuucuuucuguccggccgggggcugggaaagacgagcauuggccuccuuugcguuauggcuucuuccgugcugcuguggauggcgagcguggagccucacuggaucgccgcuucuauuauccucgaguucuuucugaugguccuucugauccccgagccggaccgccagagaacaccucaggauaaccagcucgccuacgugguuauugggcugcuguucaugauccucaccguggccgcuaaugagaugggacuucuggaaaccaccaagaaggaccugggcauugggcacgucgccguggagaaccaucaccaugcggccaugcucgaugucgaccugcaccccgcuuccgccuggacccuuuaugcuguggccacaacgaucauuaccccuaugaugcggcauacaaucgaaaacaccacagcgaauauuagccugaccgccaucgcuaaccaagccgcuauccucaugggacuggauaaaggcuggcccauuucuaagauggacaucggcguuccucugcucgcccuuggguguuacagccaggugaauccccugacgcugaccgcugccguccucaugcugguggcgcacuacgccauuaucggaccgggccuucaggcuaaggccacacgcgaggcucagaagagaaccgccgccgggauuaugaagaacccuacaguugauggaaucguggcgaucgaccuggaucccgucguguaugacgcuaaauuugaaaagcagcucggccagauuaugcugcugauccucugcaccucccagauucuucugaugcggacgacaugggcccugugugagucuaucacccucgcuacagggccccugaccacccuuugggagggaagcccuggcaaauucuggaauacaacgauugccguguccauggccaacaucuuccgcggcagcuaccuggcuggggccggacucgcguuuucccugaugaagucucugggcgggggaagacggggcaccggggcccaaggagaaacacucggcgagaaguggaaacgccagcuuaaucagcugagcaaguccgaguucaacaccuauaaaagaucuggcaucauggagguugaccggagcgaagcuaaggaggggcugaaaagaggagagacaaccaagcacgccgucucccgcggcacggcuaagcuccggugguuuguggaaagaaaucuggugaaaccggaggggaaggucauugaucuuggaugcggccgcgggggauggucuuacuauugugccggccugaaaaagguuacagaagugaaaggcuacaccaaagggggacccggccaugaggaaccuauccccauggcgaccuauggguggaaccucgugaaacugcacagcggaaaggacgucuucuuuauuccucccgagaagugcgauacacugcucugugacaucggcgaguccagcccuaauccgaccauugaagaggggcggacacuuagagugcugaaaaugguugaacccuggcugcgcggaaaccaguucugcaucaagauucucaauccuuacaugcccucuguggucgagacgcuggagcaaaugcagcggaaacauggcggcaugcuugugagaaacccucugucccgcaauagcacccacgaaauguacuggguuucuugugggacaggaaacaucguguccgccgucaauaugaccagccggaugcuccugaacagauuuacaauggcucaccgcaagcccaccuaugagcgggauguggaccugggcgccgggacgagacauguggcugucgaaccggagguugccaaccucgauaucauuggacagcgcaucgaaaauauuaaacacgagcauaagucuaccuggcacuacgacgaggauaacccuuauaagacaugggcuuaccauggcuccuaugaagugaaacccagcggguccgccagcucuauggugaauggagucgugaagcugcuuaccaaacccugggacguuaucccuauggugacacagauugcgaugaccgauacaacccccuucggccaacagagagucuuuaaggagaaaguggacacgcggacaccuaaggccaagcgcggcaccgcucagaucauggaaguuaccgccaaauggcuguggggguuccucagcagaaacaagaaaccgcggaucugcacaagagaggaauuuacgcggaaggugcgcuccaaugcugccauuggagccgucuucguggacgagaaccaauggaacucugcgaaagaggcuguugaagaugagagauuuugggaccuggugcaccgggaacgcgagcuucacaagcagggcaagugcgccaccugugucuacaacaugauggggaaaagagaaaagaaacugggagaguucggcaaggccaaagggagccgggcuaucugguauauguggcucggcgcccgcuuccuggaguuugaagcucugggauucaugaaugaggaucauugguuuuccagagaaaacucucucagcggcguggagggggagggacugcacaaacuuggcuacauucugcgggacaucuccaaaauucccgggggaaauauguacgccgaugacacagcgggcugggauacccgcaucacagaagacgaucuccagaacgaggccaagaucaccgacauuauggaaccugagcaugcucugcuugccaagucuaucuucaaacugacauaucagaauaaggucgugagaguucaacggcccgcuaaaaacgggaccgugauggaugucauuagccgcagagaccagcggggcuccggacaggugggcacguacgggcucaauaccuuuacaaacauggaagcccagcugauccgccaaauggagagcgagggaauuuucucuccuuccgaacuggagacccccaaccucgcgggcagagugcuggauuggcuugaaaagcacgggguugagcggcugaaaagaauggccaucagcggagacgacugcguggucaagccgaucgaugaccgcuuugcuacagcccucaccgcucugaaugauaugggcaaggugcggaaagacauuccucagugggaacccucuaagggguggaacgauuggcagcagguuccuuucuguucccaccauuuucaccaacuuaucaugaaagacggcagagagauugugguccccugccgcaaucaggaugagcuggugggacgggccagagucagccagggcgcuggguggucccuccgcgaaacggccugucugggaaagucuuaugcgcagauguggcaacugauguacuuccaucggagagaccuccgccuggccgcuaacgccaucugcagcgccgugccuguugauugggugcccacaucccggaccacauggagcauucacgcucaucaccaguggaugaccacggaggacaugcuuucugucuggaauagaguguggaucgaagagaacccguggauggaagauaaaacccacauuuccagcuggggcgacguuccuuaucuggggaagcgcgaggaccagugguguggaucucucaucggccugacagcccgggcgaccugggcuacaaauauccaaguggccauuaaccaggucagacggcuuaucgggaaugagaacuaccuggauuauaugaccagcaugaagagauuuaaaaaugaauccgaccccgagggcgcccucugguga

SEQ ID NO: 18919 - RNA, 9879 nt, Artificial Sequence
  derived and/or modified CDS sequence (opt5) from DENV-1__FJ461310__SS-prME
agcgugaccaugcugcucaugcugaugcccaccgcucuugcuuuccaccugacgacccggggcggggaaccucauaugaucguguccaagcaggaacggggaaaaucucuccuguuuaagacaagcgccggcguuaacaugugcacccuuauugcgauggaccugggggaacucugugaagauacaaugaccuacaaaugcccccgcaucacagaagcugaacccgacgauguggacuguuggugcaaugccaccgauacgugggugaccuauggaacauguucccaaaccggcgagcaccggcgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccugauuacacuuuaccucggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcugucugcggccaucggcaaggcuugggaggagggggucugcggcaucagaagcgccacgcgccucgaaaacauuauguggaaacagaucuccaacgagcugaaucauauucuucuggaaaacgacaugaaguucacagugguugugggagaugucgcuggcauccucgcccaggggaaaaagaugauucggccgcaacccauggaguacaaauauucuuggaaaagcuggggaaaggccaagaucaucggcgcugacgugcagaauaccaccuuuauuaucgaugggccuaacacacccgaauguccugacgaucagagagcguggaauauuugggagguggaggacuacggauucggcaucuuuaccacgaacauuuggcugaagcugcgcgauuccuauacacaggucugcgaccaccggcuuaugagcgccgcuaucaaagauucuaaggccguucacgccgacaugggcuacuggaucgaauccgagaaaaaugaaaccuggaagcucgcuagagccagcuucauugaggugaagacauguaucuggcccaaaucucauacccugugguccaacggggugcuggaaagcgagaugauuaucccgaagauuuauggaggcccuaucucucaacacaauuaccgccccggguacuucacacaggcggcuggaccuuggcaucucggcaaacuggagcuugauuuugaccugugcgaagggaccacggucgugguugaugagcacugcggaaaccggggccccagccucagaaccacaaccgugacaggcaagaucauucacgaaugguguugccgguccuguacccugccuccccugcgcuucagaggggaggacggaugcugguauggcauggagauccggccggucaaagaaaaggaggaaaaucuugucaagagcaugguuucugccggguccggagagguggacagcuuuucccucggccugcuguguauuucuaucaugauugaagaggucaugagaagccgcuggucccggagaaugcucaugacggggacacuggccguguucuuucuucugaucaugggacagcucaccuggaacgaucugauucgccugugcaucaugguuggcgcuaaugccucugacagaaugggcauggggacaaccuaccuugcgcugauggcuaccuucaaaaugcggccuauguuugccgugggacuccuguuccgcagacucacaagccgggagguccugcuucugacgaucggccucucccugguggccucuguggaacugcccaacagccuugaggaacugggggauggacucgcuaugggcauuaugauccugaagcuccugaccgacuuucaaucccaucagcuuugggccacacugcucagccugaccuucauuaaaacaaccuuuucucugcacuaugcuuggaagacgauggccaugguccuuuccaucguuagccuguucccccucugucugucuacaaccucccagaaaaccacauggcucccugugcugcuugggagccugggaugcaagccgcugaccauguuucucauugcggagaauaagaucuggggccgcagaucuuggccccugaacgaaggcaucauggccguggggauugucuccauccuucugagcucccuccugaaaaacgaugugccucucgcuggaccccugauugccggcgggaugcuuaucgcuuguuacguuauuagcggaucuagcgccgaccugucccuggagaaggccgcugaggugucuugggaagaggaagcggagcauagcggcgccucccacaauauccucgucgaagugcaggaugacgggacaaugaaaaucaaggaugaggagcgggacgauacgcugaccauucuucugaaagcuacacuccuggccguuucuggaguguauccucucagcauccccgccacccuguucgucugguacuucuggcaacgcaagaaacagagauccggcgugcuuugggacacaccuucucccccggaagucgagcgggcugugcuggaugacggcauuuaucgcaucaugcagagagggcugcucggacggagccagguuggcgugggggucuuucaagaaaacguguuccauaccauguggcacguuacgagaggagccgugcugauguaccagggcaagcgccuugagccuuccugggcgagcgucaagaaagaccugauuucuuacgggggaggcuggcggcuccagggcuccuggaauaccggggaggaaguccaggugaucgcuguugagcccggaaagaacccuaaaaauguccaaacagcccccggcaccuuuaagacaccggaaggggaggugggagccauugcucuggauuucaaaccuggcaccagcgggucucccaucgugaacagagaaggaaagaucgucggccucuauggcaauggggugguuacaacguccggaaccuacgugagcgccauugcgcaggcuaaggccucccaggagggcccucugcccgagaucgaagacgaggucuuucgcaaacggaaccuuacaauuauggaucugcaccccgggucuggaaagaccagacgcuaucugccugccaucgugcgggaagcuauuaaaagaaagcuccgcacccugauccuugccccgacacggguuguggcuagcgagauggccgaagcgcugaaaggcaugcccaucagauaccaaacgaccgccgucaaguccgagcauacagggaaggagauuguggaccucaugugccacgcuaccuucacaaugcggcugcugagcccuguucgcgugcccaauuauaacaugaucauuauggaugaagcccauuuuaccgacccuucuuccaucgcugccagaggcuacauuagcacgcgggucggaaugggcgaggccgcugcgaucuucaugacagccacacccccugggucuguggaggcuuuuccgcagagcaaugccgugauccaggaugaggaacgcgacauucccgagagauccuggaacucuggauaugaguggaucaccgauuucccuggcaaaacagucugguuuguucccagcauuaaguccgggaaugacaucgccaacugucuccggaaaaauggaaagagagugauucagcuuucucgcaaaaccuucgauacagaauaccaaaagaccaagaacaacgacugggacuacguggucacgacagauaucagcgagaugggcgcuaauuuccgggccgacagagugauugauccucgccggugccugaaacccguuauccugaaggacgggccggaaagagugauccucgcgggcccuaugcccgucaccguggcuuccgccgcccagcgccggggaagaauuggccgcaaccacaauaaagagggggaucaguauaucuacaugggacagccccugaacaaugacgaggaucaugcucacuggacagaagccaagaugcuucuggacaacauuaauaccccugagggcaucauucccgcgcucuuugaaccugagagagaaaagagcgccgcuaucgauggggaguaucggcugcgcggagaggccagaaagacguucguugagcugaugcggcgcggcgaccucccgguguggcuuucuuacaaggucgcuuccgagggguuucaauauagcgauagacgguggugcuucgacggcgaaagaaacaaucaggugcuggaggaaaacauggaugucgagaucuggaccaaagagggagaacgcaagaaacugcggcccagauggcucgacgcccgcacauacuccgacccucuggcccuucgggaguuuaaggaguucgccgcgggcagacggucugugagcggggaucugauucucgagaucggaaaacugccccagcaccugacccagcgcgcccaaaaugcucucgacaaccuuguuaugcugcauaauuccgaacagggcgggagagccuaucggcacgcuauugaggagcugccugauacaaucgaaacccucaugcugcuugcccugauugccgugcucacaggaggcgugacccuguuuuuccugucuggccgcgggcucggaaagacgagcaucggccuucugugugucauggcuuccagcguucugcucuggauggcgucuguggagccccauuggaucgccgcuuccauuauccuggaauuuuuccuuauggugcugcucauuccggagccugacagacagcggacaccccaggauaaccaacuggccuacgucgugaucgggcugcucuuuaugauucuuaccguugccgcuaaugagaugggacugcuggaaaccaccaaaaaggaccucggcaucgggcacguggccgucgagaaccaccaucacgcggccaugcuggauguggaccuucauccugcuagcgccuggacccuguacgcugucgccacaacgauuaucacccccaugaugcgccacacaaucgaaaacaccacagcgaauauuucucucaccgccaucgcuaaccaggccgcuauucugaugggacuggauaagggcuggccuaucuccaaaauggacauuggcgugccccuccuugcccuggggugcuauagccagguuaauccgcugacgcucaccgcugccgugcugaugcuugucgcgcauuacgccaucaucggaccuggccugcaagcuaaggccacaagagaggcucagaaacggaccgccgccgggauuaugaagaaccccacaguggauggaaucguugcgauugaccucgaucccguggucuaugacgcuaaauucgaaaagcagcugggccagaucaugcugcucauucuuuguaccucucaaauccugcugaugcgcacgacaugggcccucugcgagagcaucacccuggcuacagggccucuuaccacccugugggagggauccccgggcaaguuuuggaauacaacgauugccgugucuauggccaacaucuucagaggcagcuaccucgcuggggccggacuggcguucucccugaugaaaagccucggcgggggacggagaggcaccggggcccagggagaaacacuuggcgagaaguggaaacgccagcugaaucagcuguccaagucugaauuuaacaccuauaaacggagcggcauuauggagguggacagauccgaagcuaaggaggggcucaagcgcggagagacaaccaaacacgccguuucucggggcacggcuaagcugagaugguucgucgaacgcaaucuugugaaacccgaggggaaggugaucgaucugggauguggcagagggggauggagcuacuauugcgccggccucaaaaaggucacagaaguuaagggcuacaccaaagggggaccuggccacgaggaacccauuccuauggcgaccuacggguggaaccuggugaagcugcauuccggaaaagacguguuuuucauucccccugagaagugugauacacuccuuugcgacauuggcgagucuagcccgaaucccaccaucgaagaggggagaacacugcgcguccugaaaaugguggaaccuuggcuccggggaaaccaauuuuguaucaagauucugaaucccuauaugccuuccguuguggagacgcuugagcagaugcagagaaaacacggcggcaugcugguccgcaacccccucagcagaaauucuacccaugaaauguacuggguguccugcgggacaggaaacaucguuagcgccgugaauaugaccucuagaaugcugcugaaccgcuucacaauggcucacagaaagccgaccuaugagcgggaugucgaccucggcgccgggacgcgccacguggcuguggaaccugaggucgccaaccuggauauuaucggacagagaauugaaaauaucaagcaugagcacaaauccaccuggcauuacgacgaggauaaccccuauaagacaugggcuuaccacggcagcuaugaaguuaaacccucuggguccgccagcuccauggugaauggaguggucaaacuucugaccaaaccuugggacgugauccccaugguuacacaaauugcgaugaccgauacaaccccuuuuggccagcagcggguguucaaggagaaggucgacacgagaacaccgaaagccaagcggggcaccgcucaaaucauggaagugaccgccaaauggcucuggggguuucugagccgcaacaagaaacccagaauuuguacacgggaggaguucacgcgcaagguuagaucuaaugcugccaucggagccguguuugucgacgagaaccaguggaauagcgcgaaggaggcuguggaagaugagcgguucugggaccuuguucaucgcgaaagagagcugcacaaacagggcaagugcgcuaccugcguguacaacaugauggggaaacgggaaaagaaacucggagaguuuggcaaggccaaggggucccgcgcuauuugguacauguggcugggcgccagauuccuggaguucgaagcucucggauuuaugaaugaggaucacugguucucucgggaaaacagccuguccggcgucgagggggagggacuucauaaacugggcuauauccuccgcgacaucucuaagauuccugggggaaauauguacgccgaugacacagcgggcugggauaccagaaucacagaagacgaucugcagaacgaggcccggauuaccgacaucauggaacccgagcacgcccuucuggccaaaagcauuuuuaagcucacauaucaaaauaaagugguccgcgugcagagaccugcuaagaacgggaccguuauggaugugaucucccggagagaccagcgcggcucuggacaggucggcacguacgggcugaauaccuucacaaacauggaagcccaacugauccggcagauggagagcgagggaaucuuuucccccagcgaacucgagaccccgaaccuggcggaaagagugcuugauuggcuggagaaauauggcguggaacgccucaagcggauggccaucucuggggacgacuguguugugaagccuauugaugacagauucgcuacagcccugaccgcucuuaaugauaugggaaaaguccgcaaggacaucccccagugggagccuuccaaaggcuggaacgauuggcagcaagugcccuuuugcagccaucacuuccaccagcugauuaugaaggacgggcgggagaucguugugccuuguagaaaucaggaugaacucgucggccgcgcccgggugucucagggagcuggcuggucccugagagagacggccugccuggggaaaagcuacgcgcaaauguggcagcucauguauuuucaucgccgggaccugagacuugccgcuaacgccauuuguuccgccguccccguggauuggaucccgacaucucggaccacauggagcauccacgcucaucaccaguggaugaccacggaagacaugcuguccguuuggaauagaguguggauugaggaaaacccuuggauggaggauaagacccauaucagcucuuggggagacguccccuaccucggcaagcgcgaggaccaauggugcgggucccugauuggacuuacagcccgggcgaccugggcuacaaauauccagguggccauuaaccagguuagacgccugaucggcaaugaaaacuaccucgauuauaugaccagcaugaaaagauucaagaaugagucugaccccgaaggggcccugugguga

SEQ ID NO: 18920 - RNA, 9879 nt, Artificial Sequence
  derived and/or modified CDS sequence (opt5) from DENV-1__FJ906728__SS-prME
agcgugacaaugcugcugaugcugaugcccacagcccuugcuuuccaccugacgacccggggaggggaaccucauaugaucguguccaagcaggaacggggaaaaucucuccuguuuaagacaagcgccggcguuaacaugugcacccuuauugcgauggaccugggggaacucugugaagauacaaugaccuacaaaugcccgcgcaucacagaagcugaacccgacgauguggacuguuggugcaaugccaccgauacgugggugaccuauggaacauguucccagaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugauucuggauuguucuccccggacaggccucgacuucaacgaaauggugcugcuuaccaugaaggagaaauccuggcugguccauaagcagugguuucucgaucugccucuucccuggacgagcggggcuuccacaucucaagagaccuggaaucgccaggaccugcucgugacauucaaaaccgcgcacgccaagaagcaggaagucgugguucugggaagccaagagggcgcuaugcacaccgcccugacaggggccacggaaauccagaccuccggaacaaccacaauuuuugcuggccaucucaaaugcagacugaagauggauaaacuuacccugaaggggaugagcuaugugauguguacgggcccguucaaacucgagaaggaagucgccgagacacagcacggaaccgugcugguucagaucaaguacgagggcaccgacgcgccuugcaaaauccccuucucuacacaagaugaaaagggggugacccagaacggacggcugauuacagcuaauccuaucgucacggacaaagagaagcccgugaacauugaagccgagcccccuuuuggcgaguccuauaucgugauuggggccggagaaaaagcucuuaagcucagcugguucaagaaaggcucuagcaucgggaagauguuugaggccaccgcuagaggcgcccgccggauggcgauccugggagauacagccugggacuucggcuccauugggggaguuuuuaccucugucggcaaacuggugcaucagaucuucgggacagcuuacggagugcucuuuagcggcgucuccuggaccaugaagauugggaucggcgugcugcuuacguggcugggacucaauagcagaucuaccucccugagcaugacauguauugccguuggccuggugacccuuuaccucggggucauggugcaggcugauucuggaugcguuaucaacuggaaaggccgcgaacugaaguguggguccggaauuuucgugacaaaugagguccacaccuggacagaacaauauaaguuucaggccgacagcccgaaacggcuguccgcggccaucggcaaggcuugggaggagggggugugcggcaucagaucugccacccgccucgaaaacauuauguggaaacagaucagcaacgagcugaaucauauucuucuggaaaacgacaugaagcucacgguuguggucggagauguggcuggcauccuggggcagggcaagaagaugauucggccccaaccuauggaguacaaauauuccuggaagucuuggggcaaggccaaaaucaucggggccgacgcucagaauacaaccuucauuaucgauggacccaacaccccugaaugucccgacgaucagagagcguggaauauuugggagguggaggacuacggcuuuggcaucuucacaaccaacauuuggcugaaacuucgcgauagcuauacgcaggucugcgaccaccggcucauguccgccgcuaucaaagauagcaaggccguucacgccgacaugggguacuggaucgaaucugagaaaaaugaaacauggaagcuggcuagagccuccuuuauugaggugaagaccuguaucuggccgaaaagccauacacuguggucuaacggagugcucgaauccgagaugauuaucccuaagauuuauggcgggcccaucagccaacacaauuaccgcccuggauacuucacccagacagcgggccccuggcaucuggggaaacuugagcuggauuucgaccucugcgaaggaaccacggucgugguugaugagcacugcggcaaccggggcccuucucugagaaccacaaccgugacagggaagaucauucacgaaugguguugccggagcuguacccugcccccgcuucgcuuuagaggagaggacggcugcugguaugggauggagauccggccugucaaagaaaaggaggaaaaucucgugaaguccaugguuagcgcuggaucuggcgagguggacuccuucagccuggggcugcucuguauuuccaucaugauugaagaggucaugagaucucgcuggagccggaaaaugcugaugacgggaacacuugccguguuuuuccugcucaucaugggccagcugaccuggaacgaucugauuagacuuugcaucaugguuggcgccaaugcuuccgaccgcauggggaugggaacaaccuaccuggcccucauggcgaccuuuaagaugagacccauguucgcugugggccugcuccugcggcgccuuacaucuagagagguccugcuccugacgaucgggcugagccuuguggccuccguggaacugcccaacucucucgaggaacugggagauggccucgccauggggauuaugauccugaaacuucugaccgacuuucaaagccaucagcucugggcuacacugcugucccuuaccuucauuaagacaaccuuuagccugcacuaugccuggaaaacgauggcuaugguccucucuaucguuucccuguucccucucugucugagcacaaccucucagaagaccacauggcuuccggugcugcugggaucccucggcugcaagccccugaccauguuucuuauugccgagaauaaaaucuggggcagaaagagcuggccucugaacgaagggaucauggcggugggaauugucucuauccuccuguccagccuccugaaaaacgaugugccccuugccggcccucugauugcugggggaaugcugaucgccuguuacguuauuuccggcagcucugcugaccucagccuggagaaggccgccgagguguccugggaagaggaagcugagcauucuggggcgagccacaauauccuugucgaagugcaggaugacggaacaaugaaaaucaaggaugaggagcgcgacgauacgcugaccauucuccugaaagccacacuccuggcuguuuccggcguguauccccuuucuaucccugccacccuguucgucugguacuuuuggcaaaagaagaaacagagaagcggcgugcugugggacacacccuccccgccugaagucgagcgggccgugcucgaugacgggauuuaucgcaucaugcagagaggacugcuuggccggucucagguuggggugggagucuuccaagaaaacguguuccauaccauguggcacguuacgcgcggcgcugugcugauguaccaggggaagagacucgagcccagcugggccuccgucaaaaaggaccugauuagcuacggaggcggcuggcggcucagagggucuuggaauaccggagaggaaguccaggugaucgcgguugagccuggcaaaaaccccaagaauguccagacagcuccggggaccuuuaagacaccugaaggagaggugggcgccauugcccuggauuucaaacccgggaccuccggaagcccuaucgugaaccgcgaaggcaagaucgucggccuuuaugggaauggagugguuacaacgucuggcaccuacguguccgcuauugcccaagcgaaagcuagccaggaggggccccugcccgagaucgaagacgaggucuuucggaagagaaaccugacaauuauggaucuccacccuggauccggcaaaacccgccgguaucugccggccaucgugagagaagccauuaagcgcaaacuucggacccugauccucgcucccacaagaguuguggccucugagauggcugaagcccugaaagggaugccuauccgcuaccagacgaccgcggucaagagcgagcauacaggcaaagagauuguggaccugaugugccacgccaccuucacaaugcggcuccuuucccccguuagagugccuaauuauaacaugaucauuauggaugaagcucauuuuaccgaccccagcucuaucgccgcucggggauacauuuccacgcgcgucggcaugggggaggccgccgcuaucuucaugacagcgaccccuccgggaagcguggaagccuuuccccaaucuaaugcugugauccaggaugaggaaagagacauuccugagcggagcuggaacaccggcuaugaguggaucacagauuuccccgggaagaccgucugguuuguuccuuccauuaaaucuggaaaugacaucgccaacugucugcgcaagaauggcaagagagugauucagcugagccggaaaacauucgauaccgaauaccagaagacgaaaaacaacgacugggacuacguggucacaaccgauaucuccgagaugggggccaauuuuagagcugaccgcgugauugauccccggagaugccucaagccgguuauccugaaagacggcccugaacgcgugauccuugccggacccaugcccgucacaguggcgucugcugcccaacggagaggccgcauugggcggaaccacaauaaggagggagaucaguauaucuacaugggccagccucugaacaaugacgaggaucaugcccacuggaccgaagcuaagaugcuccuggacaacauuaauacgcccgaggggaucauuccugcccuguucgaaccggagagagaaaagagcgcggccguugauggagaguaucgccucagaggcgaggcucggaagaccuucguggagcuuaugcgcagaggggaccugcccgucuggcuguccuacaaaguggccagcgagggcuuucaguauucugaucggcgcuggugcuucgacggagaaagaaacaaucaaguccucgaggaaaacauggauguggagaucuggacaaaggagggcgaacggaaaaagcugagaccucgcuggcuugacgcucggaccuacuccgacccccuggcccucagagaguuuaaagaguucgcugccgggcgccggagcguuuccggagaucugauccuggagauuggcaagcucccucagcaccuuacacagagagcgcagaaugcccuggacaaccuggugaugcuccauaauucugaacaagggggacgggcuuaucgccacgccauggaggagcugcccgauaccaucgaaacacuuaugcugcucgcucugauugccgugcugaccggcggcgucacgcucuuuuuccuuagcgggagaggacugggcaagacauccaucgggcugcucuguguuauggccucuagcgugcugcuuuggauggcuuccguggagccgcauuggauugcggccagcaucauccuggaauuuuuccucaugguccugcugauuccugagcccgaccggcagcgcaccccucaggauaaccagcucgcuuacgugguuaucggacuucuguuuaugauucuggccguggccgcuaaugagaugggccuccuggaaaccaccaagaaggaccuugggaucggacacgucgccguggagaaccaccaucacgcggccaugcuggaugucgaccuccaucccgcuucugccuggacccuguacgcuguggccacaacgauuaucaccccuaugaugagacacacaauugaaaacaccacagcgaauaucucccugaccgccaucgcuaaccaagccgcuauucucaugggccuugauaaaggcuggcccaucagcaagauggacauugggguuccgcugcuggcccucggaugcuauucucaggugaauccucugacgcuuaccgcugccguccugaugcucguggcgcauuacgccaucauuggccccgggcugcaggcuaaagccacacgggaggcucaaaagcgcaccgccgccggaaucaugaagaaccccacaguugauggcaucguggcgauugaccuggauccugucguguaugacgcuaaauucgaaaagcagcucgggcagaucaugcuucugauucuguguaccucccagauccuccugaugagaacgacaugggcccuuugcgagagcauuacccuggcuacaggaccgcucaccacccugugggagggcucucccggcaaauuuuggaauacaacgaucgccgugagcauggccaacaucuuccggggguccuaccuggcuggagccggccucgcguuuucucuuaugaaaagccucgggggaggccgcagagggaccggagcccaaggcgaaacacugggcgagaaauggaagcggcagcucaaucagcuguccaagagcgaguucaacaccuauaaaagauccgggauuauggagguugaccgcucugaagcuaaggagggacuuaaacggggcgagacaaccaagcacgccgucagcagagggacggcuaaacugcgcugguucguggaacggaaucucgugaagccugagggaaaggucaucgaucugggcugugggagaggaggcugguccuacuauugcgccggccugaaaaagguuacagaagugaaaggguacaccaagggaggccccgggcacgaggaaccuauucccauggcgaccuacggauggaaccucgugaaacuucauucuggcaaggacgucuuuuucaucccuccggagaaaugugauacacugcugugcgacauuggggagagcucccccaauccuaccaucgaagagggacgcacacuccgggugcugaagaugguugaacccuggcuuagaggcaaccaguuuuguauuaagauccugaauccuuauaugcccucuguggucgagacgcucgagcaaaugcagcgcaaacacggcgggaugcuggugcggaacccgcugagcagaaauuccacccaugaaauguacuggguuagcugcggaacaggcaacaucgugucugccgucaauaugaccucccgcaugcuccugaaccgguucacaauggcucacagaaagccuaccuaugagcgcgauguggaccuugggacgggaaccagacacguggccgucgaacccgagguugcuaaccuggauauuaucggccagcggauugaaaauaucaaacaugagcacaagagcacauggcauuacgacgaggauaaccccuauaaaaccugggccuaccacgggucuuaugaagugaagccuuccggaagcgcuucuuccauggugaauggcgucgugaagcuccugacaaaacccugggacguuauuccuauggugacccagaucgccaugacagauaccacgccguuuggccaacagcgcgucuucaaggagaaaguggacacaagaacccccaaggcgaaacgggggaccgcccagaucauggaaguuacagcuagauggcuuuggggauuucugagccggaacaagaagccucgcauuuguacgagagaggaguucacccggaaagugcgcuccaaugccgcuaucggcgccgucuuuguggacgagaaccaauggaauagcgccaaggaggcgguugaagaugagagauucugggaccucgugcaucgggaacgcgagcugcacaaacaggggaagugcgcuacaugcgucuacaacaugaugggaaaaagagaaaagaagcugggcgaguuugggaaagccaagggcucucgggccauuugguacauguggcucggagcucgcuuccuggaguuugaagcccuuggcuucaugaaugaggaucacugguucagcagagaaaacucccugucugggguggagggagagggccuccauaaacugggguauauccuucgggacauuagcaagauccccggaggcaauauguacgcugaugacaccgccgggugggauacacgcaucaccgaagacgaucugcagaacgaggcgaaaauuacagacaucauggaaccugagcacgcccuccuggcuaaggccauuuuuaaacugaccuaucagaauaaggucgugagaguucaacggcccgcuaagaacggcacggugauggaugucaucucccgcagagaccagcggggaucuggccagguggggaccuacggacucaauacauucaccaacauggaagcccagcugauuagacaaauggagagcgagggcaucuuuuccccgucugaacuugagacaccuaaccuggcggaacgcgcccucgauuggcuggagaaauaugggguggaacggcuuaagagaauggcuaucagcggagacgacuguguugugaaacccauugaugaccgcuucgccaccgcucugacggcccucaaugauaugggcaagguccggaaagacaucccucagugggagcccuccaagggguggaacgauuggcaacaggugccuuuuugcagccaucacuuccaccaacugauuaugaaggacggcagagagaucguugugcccugucgcaaucaggaugaacuggucggacgggcuagagugucucagggcgccggguggucccuccgcgagacagcgugccugggaaaaagcuacgcccagauguggcaacuuauguauuuucaucggagagaccugcgccucgcugccaacgccauuuguucugcugucccgguggauuggguuccuaccucccggacaaccuggagcauccacgcccaucaccaguggaugacgaccgaagacaugcuguccguguggaauagagucuggauugaggaaaaccccuggauggaggauaagacacauaucucuagcugggaggacgugcccuaccuuggcaaacgggaagaccaguggugcgggucccugaucggacucaccgcgagagcuacaugggccaccaauauucaaguugccaucaaccaggugcgccggcugauuggcaaugagaacuaccuggauuauaugacaagcaugaagagauucaaaaaugaaucugacccugagggggcucucugguga

SEQ ID NO: 18921 - RNA, 9879 nt, Artificial Sequence
  derived and/or modified CDS sequence (opt5) from DENV-1__FJ461313__SS-prME
agcgugaccaugcugcucaugcugaugcccaccgcccuugcuuuccaccugacgaccagaggaggggaaccucauaugaucgucuccaagcaggaacggggaaagucucuccuguuuaagaccagcgccggcguuaauaugugcacccuuauugcgauggaccugggggaacucugugaagauacaaugaccuacaaaugcccccgcaucacagaagcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggcuaugguccaggccgauuccggaugcgugauuaacuggaaaggccgcgaacugaagugugggagcggaaucuucguuaccaaugaggugcacacauggaccgaacaauauaaguuucaggcggacuccccuaaacggcugucugccgcuauuggcaaggccugggaggagggggucugcggcaucagaagcgcuacgcgccucgaaaacaucauguggaaacagauuuccaacgagcugaaucauauccuucuggaaaacgacaugaagcucacagugguugugggagaugucgccggcauucuggggcagggcaagaagaugauccggccgcaacccauggaguacaaauauucuuggaaaagcuggggcaaggccaagauuaucggggcugacgcgcagaauaccaccuucaucauugauggaccuaacacacccgaauguccugacgaucagagagccuggaauaucugggagguggaggacuacggcuuuggcauuuucaccacgaacaucuggcugaaacuucgcgauuccuauacacaggugugcgaccaccggcucaugagcgcugccauuaaagauucuaaggccguccacgcugacaugggguacuggaucgaauccgagaaaaaugaaaccuggaagcuggccagagcgagcuuuaucgagguuaagacauguauuuggcccaaaucucauacccugugguccaacggagugcucgaaagcgagaugaucauuccgaagaucuauggcgggccuauuucucaacacaauuaccgccccggauacuucacacagaccgcuggcccuuggcaucuggggaaacuugagcuggauuucgaccucugcgaaggaacgaccguggucguggaugagcacugcggcaaccggggccccagccugagaacaaccacaguuaccgggaagaucauccacgaaugguguugccgguccuguacgcugccuccccuucgcuuuagaggagaggacggcugcugguaugggauggagauucggccggugaaagaaaaggaggaaaaucucgucaagagcauggugucugccggauccggcgagguugacagcuucucccuggggcugcucuguaucucuauuaugaucgaagaggugaugagaagccgcuggucccggaaaaugcugaugacaggaacccuugccgucuuuuuccugcucauuaugggccagcugacauggaacgaucugaucagacuuugcauuauggugggcgcuaaugccucugaccgcauggggaugggaaccaccuaccuggcgcucauggcuacauuuaagaugagaccuauguucgccguuggccugcucuuucggcgccugacgagcagagaggugcuucugcucaccaucgggcugucccuggucgccucuguggaacuucccaacagccuggaggaacucggagauggccuggcuauggggaucaugauucucaaacugcuuacagacuuccaaucccaucagcugugggccacccuccugagccugacauuuaucaagaccacguucucucuucacuaugcuuggaaaacaauggccauggugcuguccauugucagccucuuuccccugugucucucuaccaccucccagaagacaaccuggcugccuguucuucugggaagccugggcugcaagccgcucacaauguuccugaucgcggagaauaaaauuuggggccggaagucuuggccccuuaacgaagggaucauggccgugggaaucguguccauucugcucagcucccugcucaaaaacgaugucccucuggcuggcccccuuaucgccgggggaaugcugauugcuuguuacgugaucagcggcucuagcgccgaccugucccucgagaaggccgcugagguuucuugggaagaggaagcggagcauagcggggccucccacaauauucugguggaaguccaggaugacggaacgaugaaaaucaaggaugaggagcgcgacgauacccuuacaauccugcucaaagcuacccugcucgccgugucuggcguuuauccucugagcauucccgccacacuuuuugugugguacuucuggcaaaagaagaaacagagauccggcguccugugggacaccccuucucccccggaaguggagcgggcuguccuggaugacgggaucuaucgcauuaugcagagaggacuccugggccggagccagguggggguuggaguguuccaagaaaacgucuuucauacgauguggcacgugacccgcggcgccguucuuauguaccaggggaagagacuggagccuuccugggcgagcgugaaaaaggaccucaucucuuacggaggcggcuggcggcugagaggguccuggaauacaggagaggaaguccaggugauugcuguggagcccggcaaaaacccuaagaauguucagaccgcccccgggacauucaagaccccggaaggagaggucggcgccaucgcucucgauuuuaaaccugggacaagcggaucucccauugugaaccgcgaaggcaagaucgugggccuguaugggaauggagucgugacgaccuccggcacauacguuagcgccaucgcgcaagcuaaagccucccaggaggggccucuucccgagauugaagacgagguguuccggaagagaaaccugaccaucauggaucugcaccccggaucuggcaaaacccgccgguaucucccugccauugucagagaagcuaucaagcgcaagcugcggacacuuauucuggccccgacgagagugguugcuagcgagauggccgaagcgcucaaagggaugcccauccgcuaccagaccacagccgugaaguccgagcauaccggcaaagagaucgucgaccugaugugccacgcuacauuuaccaugcggcugcucagcccugugagaguucccaauuauaacaugauuaucauggaugaagcccauuucacggacccuucuuccauugcugcccggggauacaucagcacacgcgugggcaugggggaggccgcugcgauuuuuaugaccgccacacccccuggaucugucgaggcuuucccgcaaagcaaugccgugauccaggaugaggaaagagacauccccgagcgguccuggaacucuggcuaugaguggauuacagauuuuccugggaagaccgugugguucguccccagcaucaaauccggaaaugacauugccaacugucuucgcaagaauggcaagagaguuauccagcugucucggaaaacauuugauaccgaauaccagaagacgaaaaacaacgacugggacuacguggugacaaccgauauuagcgagaugggggcuaauuucagagccgaccgcgucaucgauccucggagaugccugaagcccgugauucucaaagacggcccggaacgcguuauccuggcgggaccuaugcccgugacagucgcuuccgccgcccaacggagaggccgcaucgggcggaaccacaauaaggagggagaucaguauauuuacaugggccagccccuuaacaaugacgaggaucaugcucacuggaccgaagccaagaugcugcucgacaacaucaauacgccugaggggauuauccccgcgcuguucgaaccugagagagaaaagagcgccgcuguggauggagaguaucgccugagaggcgaggcccggaagaccuuuguugagcucaugcgcagaggggaccuuccgguguggcugucuuacaaagucgcuuccgagggcuuccaguauagcgaucggcgcuggugcuuugacggagaaagaaacaaucaagugcuggaggaaaacauggaugucgagauuuggacaaaggagggcgaacggaaaaagcucagaccccgcuggcuggacgcccggaccuacuccgacccucuugcucugagagaguucaaagaauuugccgcggggcgccggucugugagcggagaucucauccuggagaucggcaagcugccccagcaccucacacagagagcccagaaugcucuugacaaccugguuaugcugcauaauuccgaacaagggggacgggccuaucgccacgcuauggaggagcucccugauaccauugaaacacugaugcuucuggcccucaucgccgugcugaccggcggcgugacgcuguucuuucucucugggagaggacuuggcaagacaagcauugggcugcugugugucauggcuuccagcguucuccuguggauggcgucuguggagccccauuggaucgccgcuuccauuauccuugaguucuuucugauggugcuccugaucccggagccugaccggcagcgcacaccccaggauaaccagcuggccuacgucgugauuggacuccuuuucaugauccugaccguugccgcuaaugagaugggccugcucgaaacaaccaaaaaggaccuggggauuggacacguggccgucgagaaccaccaucacgcggccaugcuugauguggaccugcauccugcuagcgccuggacacucuacgcugucgccacgaccaucauuacacccaugaugagacacaccaucgaaaacacaaccgcgaauauuucucugacggccaucgcuaaccaagccgcuauccugaugggccucgauaaaggcuggccuauuuccaagauggacaucggggugccccuucuggcccugggaugcuauagccagguuaauccgcucacccugacagcugccgugcuuaugcuggucgcgcauuacgccauuaucggcccugggcuccaggcuaaagccacccgggaggcucaaaagcgcacagccgccggaauuaugaagaaccccaccguggauggcaucguugcgaucgaccuggaucccguggucuaugacgcuaaauuugaaaagcagcuggggcagauuaugcuccuuauccuguguacgucucagauucugcucaugagaacaaccugggcccugugcgagagcaucacacuugcuaccggaccucugaccacacucugggagggcuccccgggcaaauucuggaauacgaccauugccgugucuauggccaacaucuuucgggggagcuaccuggcuggagccggccuggcguucucccucaugaaaagccuugggggaggccgcagauccacaggggcccaaggagaaacccugggcgagaaauggaagcggcagcugaaucagcucucuaagagcgaguucaacacauauaaaagauccggcaucauggagguggaccgcucugaagcuaaggaggggcugaaacggggagagaccacgaagcacgccguuagcagaggcacagcuaaacuucgcugguuugucgaacggaaucuggugaagcccgaggggaaggugauugaucucggauguggcagagggggaugguccuacuauugcgccggccugaaaaaggucaccgaaguuaaaggcuacaccaaagggggaccuggccacgaggaacccaucccuauggcgacauacggguggaaccuggugaaacuccauucuggaaaggacguguucuuuauucccccugagaaaugugauacccuucugugcgacaucggcgagagcuccccgaaucccacaauugaagaggggcgcacgcugcggguccucaagaugguggaaccuuggcugagaggaaaccaguucuguaucaagauucuuaaucccuauaugccuagcguuguggagacccuggagcaaaugcagcgcaaacacggcggcaugcucguccggaacccccugucuagaaauuccacacaugaaauguacugggugagcugcgggaccggaaacaucguuucugccgugaauaugacaucccgcaugcugcucaaccgguuuaccauggcucacagaaagccgacguaugagcgcgaugucgaccugggcaccgggacaagacacguggccguggaaccugaggucgcuaaccuugauaucauuggacagcggaucgaaaauauuaaacaugagcacaagagcaccuggcauuacgacgaggauaaccccuauaaaacaugggccuaccacggcucuuaugaaguuaagcccuccgggagcgcuuccagcauggugaauggaguggucaagcugcucaccaaaccuugggacgugauccccaugguuacacagauugccaugaccgauacgacaccuuucggccaacagcgcguguuuaaggagaaagucgacaccagaaccccgaaggcgaaacggggcacagcccagaucauggaagugacggcuagauggcuguggggguuccuuucucggaacaagaagccccgcaucuguaccagagaggaauuuacacggaaaguucgcagcaaugccgcuauuggagccguguucgucgacgagaaccaauggaacuccgccaaggaggcgguggaagaugagagauuuugggaccugguucaucgggaacgcgagcuccacaaacagggcaagugcgcuaccugcguguacaacaugauggggaaaagagaaaagaagcugggagaguucggcaaagccaaggggucucgggccaucugguacauguggcugggcgcucgcuuucucgaguucgaagcccugggauucaugaaugaggaucacugguuuagcagagaaaacucccuuucuggcgucgagggggagggacugcauaaacucggcuauauucugcgggacaucagcaagauuccugggggaaauauguacgcugaugacacagccggcugggauacccgcaucacagaagacgaucuucagaacgaggcgaaaaucaccgacauuauggaacccgagcacgcccugcucgcuaaggccaucuucaaacugacguaucagaauaagguggucagagugcaacggccugcuaagaacgggaccguuauggaugugauuucccgcagagaccagcggggcucuggacaggucggcacauacgggcugaauaccuuuacaaacauggaagcccagcucaucagacaaauggagagcgagggaauuuucucccccagcgaacuggagaccccgaaccuugcggaacgcgcccugaauuggcucgagaaauauggcguggaacggcugaagagaauggcuaucucuggggaugacugugugguuaaaccuaucgacgaucgcuuugccacggcucuuacagcccugaacgacaugggaaaggugcggaaagauauuccccagugggagccuuccaagggcuggaaugacuggcagcagguccccuucugcagccaucacuuucaccaacucaucaugaaggaugggagagagauugugguuccuugucgcaaccaggacgaacuggugggccgggcuagagucucucagggagccggcuggucccugcgcgagaccgcgugccucgggaaaagcuacgcccagauguggcaacugauguauuuccaucggagagaucuucgccuggcugccaaugccaucuguuccgcugugcccgucgacugggugccgacaucucggaccacguggagcauucacgcccaucaccaguggaugaccacagaagauaugcucuccguuuggaacagaguguggaucgaggaaaauccuuggauggaggacaagacccauauuagcucuugggaggauguccccuaccugggaaaacgggaagaccaguggugcggcucccuuaucgggcugacagcgagagcuaccugggccacaaacauccaaguggccauuaaucagguucgccggcucaucggaaacgagaauuaccuggacuauaugaccagcaugaagagauuuaaaaacgaaucugaucccgagggcgcucugugguga

SEQ ID NO: 18922 - RNA, 9879 nt, Artificial Sequence
  derived and/or modified CDS sequence (opt5) from DENV-1__FJ547063__SS-prME
agcgugaccaugcugcucaugcugaugcccacagcccuugcuuuccaccugacgaccagaggcggggaaccucauaugaucguguccaagcaggaacggggaaaaucucuccuguuuaagacaagcgccggcguuaauaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggagguggaggacuacggauucggcauuuuuacgacaaacaucuggcugaaacuucgcgauuccuauacccaggucugcgaccaccggcucaugagcgcggccauuaaagauucuaaggcuguucacgccgacaugggcuacuggaucgaauccgagaaaaaugaaacauggaagcuggccagagcuagcuucaucgaggugaagaccuguauuuggcccaaaucucauacacugugguccaacggggugcucgaaagcgagaugaucauuccgaagaucuauggaggcccuauuucucaacacaauuaccgccccggguacuucacccagacggccggaccuuggcaucugggcaaacuugagcuggauuuugaccucugcgaagggaccacagucgugguugaugagcacugcggaaaccggggccccagccugagaaccacaaccgugacgggcaagaucauccacgaaugguguugccgguccuguacacugccuccccuucgcuucagaggggaggacggaugcugguauggcauggagauucggccggucaaagaaaaggaggaaaaucucgucaagagcaugguuucugcgggguccggagagguggacagcuuuucccugggccugcucuguaucucuauuaugaucgaagaggucaugagaagccgcuggucccggaaaaugcugaugaccgggacacuugcuguguucuuucugcucauuaugggacagcugaccuggaacgaucugaucagacuuugcauuaugguuggcgccaaugccucugaccgcaugggcauggggaccacauaccuggcucucauggccacguucaagaugagaccuauguuugcggugggacugcuguuccggcgccugaccagcagagagguccuucugcucacaaucggccugucccugguggcuucuguggaacuucccaacagccuggaggaacucggggauggacuggccaugggcaucaugauucucaaacugcuuaccgacuuucaaucccaucagcugugggccacacuccugagccugaccuucaucaagacgacauuuucucuucacuaugcuuggaaaaccauggccaugauucuguccaucgucagccucuucccccugugucucucuaccacaucccagaagaccacauggcugccuguucuucuggggagccugggaugcaagccgcucacgauguuucugauugcugagaauaaaaucuggggccggcgcucuuggccccuuaacgaaggcaucauggccguggggauuguguccauccugcucagcucccugcucaagaacgaugucccucuggcgggaccccuuauugccggcgggaugcugaucgcuuguuacgugauuagcggaucuagcgccgaccugucccucgagaaagcugccgagguuucuugggaagaggaagccgagcauagcggcgcuucccacaauauccugguggaaguccaggaugacgggaccaugaagaucaaagaugaggagagagacgauacacuuaccauucugcucaaggcgacacugcucgccgugucuggaguuuauccucugagcauccccgcuacccuuuucgugugguacuucuggcagaagaagaagcagcgguccggcguccugugggacacgccuucucccccggaaguggagcgcgccguccuggaugacggcauuuauagaaucaugcagcgggggcuccugggacgcagccaggugggcguugggguguuucaagaaaacgucuuccauaccauguggcacgugacaagaggagccguucuuauguaccagggcaaacggcuggagccuuccugggcuagcgugaagaaagaccucauuucuuacgggggaggcuggagacugcagggcuccuggaauaccggggaggaaguccaggugaucgccguggagcccggaaagaacccuaaaaauguucaaacagcgcccggcaccuuuaagacaccggaaggggaggucggagcuauugcccucgauuucaagccuggcacgagcgggucucccaucgugaaccgcgaaggaaaaaucgugggccuguauggcaauggggucgugaccacauccggaaccuacguuagcgccauugcucaggccaaggcgucccaggagggcccucuucccgagaucgaagacgagguguuucggaaaagaaaccugaccauuauggaucugcaccccgggucuggaaagacacgccgguaucucccugcuaucgucagagaagccauuaaacgcaagcugcggacgcuuauccuggccccgaccagagugguugcuagcgagauggccgaagcucucaagggcaugcccauccgcuaccaaacaaccgccgugaaauccgagcauacagggaaggagauugucgaccugaugugccacgcgaccuucacgaugcggcugcucagcccugugagaguucccaauuauaacaugaucauuauggaugaagcccauuuuacagacccuucuuccaucgcugcccggggcuacauuagcacccgcgugggaaugggcgaggcugccgccaucuucaugaccgcuacacccccugggucugucgaagcguuuccgcagagcaaugccgugauccaggaugaggaaagagacauucccgagcgguccuggaacucuggauaugaguggaucaccgauuucccuggcaaaacagugugguuuguccccagcauuaaguccgggaaugacaucgcuaacugucuucgcaaaaauggaaagagaguuauucagcugucucggaagaccuucgauacggaauaccagaagaccaagaacaacgacugggacuacguggugaccacagauaucagcgagaugggcgccaauuucagagccgaccgcgucauugauccucggagaugccugaaacccgugauccucaaggacgggccggaacgcguuauccuggcuggcccuaugcccgugaccgucgccuccgcggcucagcggagaggacgcauuggccggaaccacaauaaagagggggaucaguauaucuacaugggacagccccuuaacaaugacgaggaucaugcccacuggacggaagccaagaugcugcucgacaacauuaauaccccugagggcaucauucccgcucuguuugaaccugagagagaaaagagcgccgcgaucgauggggaguaucgccugagaggagaggcccggaaaacauucguggaacucaugcgcagaggcgaccuuccgguuuggcugucuuacaagguggcuuccgagggguuucaauauagcgaucggcgcuggugcuucgacggcgaaagaaacaaucagguccuggaggaaaacauggauguggagaucuggaccaaagagggagaacggaagaaacucagaccccgcuggcuggacgcccggacauacuccgacccucuugcucugagagaguuuaaggaguucgccgcuggccgccggucugucagcggggaucucauucuggagaucggaaaacugccccagcaccucacccagagagcccaaaaugcgcuugacaaccuggugaugcugcauaauuccgaacagggcgggcgggccuaucgccacgcuauggaggagcucccugauacaauugaaacccugaugcuucuggcccucaucgcuguucugacgggaggcgugacacuguuuuuccucucuggcagagggcuuggaaagaccagcauuggccugcugugugugauggccuccagcguccuccuguggauggccucuguugagccccauuggaucgcugcguccaucauucuugaauuuuuccugauggugcuccugaucccggagccugaccggcagcgcacaccccaggauaaccaacuggccuacguggucauugggcuccuuuuuaugauccugacaguggcugccaaugagaugggacugcucgaaaccacaaagaaagaccugggcauugggcacguugccguggagaaccaccaucacgcugccaugcuugaugucgaccugcauccugcgagcgccuggacgcucuacgcuguggccaccacaaucauuacccccaugaugagacacacaaucgaaaacaccacggcuaauaucucucugaccgccauugcgaaccaggccgcuauccugaugggacucgauaagggcuggccuauuuccaaaauggacaucggcgucccccuucuggcccuggggugcuauagccaggugaauccgcucacacugaccgcugccguucuuaugcugguggcucauuacgccauuaucggaccuggccuccaagcgaaggccacacgggaggcucagaaacgcaccgccgcugggaucaugaagaaccccacggucgauggaauuguggccaucgaccuggaucccguuguguaugacgccaaguucgaaaaacagcugggccagauuaugcuccuuauccuguguacaucucaaauucugcucaugagaaccacaugggcgcugugcgagagcaucacccuugcuaccgggccucugacaacgcucugggagggauccccgggcaaguuuuggaauaccacaaucgccgucucuauggcuaacauuuuccggggcagcuaccuggccggggccggacuggcuuucucccucaugaaaagccuuggcgggggacgcagaggcaccggggcccagggagaaacacugggcgagaaguggaaacggcagcugaaucagcucuccaagucugaauuuaacaccuauaagagaagcggcaucauggagguggaccgcuccgaagcgaaagaggggcugaagcggggagagacgacaaaacacgccgugucuagaggcaccgcuaaacuucgcugguucguugaacggaaucuggucaaacccgaggggaaggugauugaucucggauguggcagagggggauggagcuacuauugcgccggccugaagaaagugaccgaagucaagggcuacacaaaagggggaccuggccacgaggaacccaucccuauggcuaccuacggguggaaccugguuaagcuccauuccggaaaagacguguuuuucauucccccugagaagugugauacacuucugugcgacaucggcgagucuagcccgaaucccacgauugaagaggggcgcacccugcgggugcucaaaauggucgaaccuuggcugagaggaaaccaauuuuguaucaagauccuuaaucccuauaugccuuccgugguugagacacuggagcagaugcagcgcaagcacggcggcaugcucgugcggaacccccugcagagaaauagcacccaugaaauguacugggucucuugcgggacaggaaacauuguguccgccguuaauaugaccagccgcaugcugcucaaccgguucacgauggcgcacagaaaaccgaccuaugagcgcgauguggaccugggcgccgggacaagacacgucgcuguggaaccugagguggccaaccuugauaucauuggacaacggaucgaaaauauuaagcaugagcacaaaucuaccuggcauuacgacgaggauaaccccuauaagacaugggcuuaccacggcuccuaugaagucaaacccagcgggucugccuccagcaugguuaauggaguggugaagcugcucaccaagccuugggacgucauccccauggugacacagaucgcuaugaccgauacgacaccuuuuggccagcaacgcguuuucaaagagaagguggacaccagaaccccgaaagccaagcggggcacagcgcagauuauggaagucacggccaaauggcuguggggguuucuuuccagaaacaagaagccccggaucuguacccgcgaggaguucacaagaaaagugcggagcaaugcugccauuggagcuguuuuuguggacgagaaccaguggaacucugccaaggaggccgucgaagaugagcgcuucugggaccuggugcauagagaacgggagcuccacaaacagggcaagugcgcgaccugcguuuacaacaugauggggaaacgcgaaaagaagcugggagaguuuggcaaagcuaaggggagcagagccaucugguacauguggcugggcgcccgguuccucgaguucgaagcucugggauuuaugaaugaggaucacugguucucccgcgaaaacucucuuagcggcguggagggggagggacugcauaaacucggcuauauucugagagacaucuccaagaucccugggggaaauauguacgccgaugacacagcuggcugggauacccggauuacagaagacgaucuucaaaacgaggcccgcaucaccgacauuauggaacccgagcacgcgcugcucgccaaaucuaucuuuaagcugacguaucagaauaaagucgugagaguccagcggccugcuaagaacgggaccgugauggauguuauuagccgcagagaccagcggggcuccggacaagugggcacauacgggcugaauaccuucacaaacauggaagcccagcucaucagacagauggagucugagggaaucuuuagccccuccgaacuggagaccccgaaccuugcugaacgcguccuggauuggcucgagaaguauggcguggaacggcugaaaagaauggccauuagcggggacgacugugugguuaagccuaucgaugaccgcuucgcgacggcccuuacagcucugaaugauaugggaaaagugcggaaggacauuccccagugggagccuucuaaaggcuggaacgauuggcaacagguccccuuuugcucccaucacuuccaccagcucaucaugaaggacgggagagagauugugguuccuugucgcaaucaggaugaacuggugggccgggccagagucagccaaggagcuggcuggucucugcgcgagaccgccugccucgggaaguccuacgcucagauguggcagcugauguauuuucaucggagagaccuucgccuggccgcgaacgccaucuguagcgcugugcccgucgauuggauuccgacaucccggaccacguggucuauccacgcccaucaccaauggaugaccacagaagacaugcucagcguguggaauagaguuuggaucgaggaaaacccuuggauggaggauaaaacccauauuuccagcuggggagacgugcccuaccugggcaagcgggaggaccaguggugcgggucucuuaucggacugacagccagagcuaccugggccacaaauauucaggucgcgaucaaccaggugcgccggcucauuggcaaugaaaacuaccuggauuauaugaccuccaugaaaagauucaagaaugagagcgaccccgaaggggcucugugguga

SEQ ID NO: 18923 - RNA, 9879 nt, Artificial Sequence
  derived and/or modified CDS sequence (opt5) from DENV-1__FJ410218__SS-prME
agcgugaccaugcugcucaugcugaugcccaccgcccuugcuuuccaccugacgacccggggcggggaaccucauaugauugucaccaagcaggaacggggaaaaucccuccuguuuaagaccucugccggcguuaacaugugcacccuuauugccauggaccugggggaacucugugaagauaccaugacauacaaaugcccccgcaucaccgaagcugaacccgacgauguggacuguuggugcaaugccacggauaccugggugaccuauggaaccuguagccaaacaggcgagcaccggcgggacaagcgcuccguugcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguucacagugguugugggagaugucgugggcauucucgcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaagcugcgcgauuccuacacacagguuugcgaccaccggcuuaugagcgcggccauuaaagauucuaaggcugugcaugccgacaugggcuauuggaucgaauccgagaaaaaugaaaccuggaagcucgccagagcuagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgccggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuucaaaggggaggacggaugcugguacggcauggagauuagaccggugaaggaaaaggaggaaaaucuuguuaaaagcauggugucugcgggguccggagaggucgacagcuuuucccucggccugcuguguaucucuauuaugaucgaagaggugaugcggagcagauggucccgcaagaugcucaugacagggacccuggcuguuuuccuucugcucauuaugggacagcugacauggaacgaucugauccggcuuugcauuauggugggcgccaaugccucugacagaaugggcauggggaccaccuaucuggcucucauggccacauuuaaaaugcgcccuauguucgcggucggacugcucuuuagacggcugacgagccgcgaggugcuucugcucaccaucggccugucccugguggcuucugucgaacuucccaacagccuggaggaacucggggauggacuggccaugggcaucaugauucucaagcugcuuacagacuuccaaucccaccagcugugggccacccuccugagccugacauuuaucaaaaccacgcuuucucugcauuacgcuuggaagacaauggccaugguucucuccauugugagccuguucccccucugucugucuaccaccucccagaagacaaccuggcuuccugugcugcuggggagccucggaugcaaaccgcugacaauguuucuuaucgucgagaauaagauuuggggcagaaaaucuuggccccugaacgaaggcaucauggcuguggggguuguguccauccuccugagcucccuccugaagaacgaugucccucuugccggaccccugauugcgggcgggaugcugaucgccuguuaugugauuagcggaucuagcgcugaccucucccuggagaaagccgcugagguuucuugggaagaggaagccgagcacagcggcgccucccauaauauccuuguggaaguccaggaugacgggacgaugaagauuaaagaugaggagcgggacgauacccugacaauccuccugaaggcuacccuccuggcggugucuggagucuacccucuuagcauccccgccacacuguucgugugguauuuuuggcaaaagaaaaagcagcgcuccggcguucugugggacaccccuucucccccggaaguggagagagcuguccucgaugacggcauuuaccggaucaugcagcgcgggcugcuuggaagaagccaggugggcguugggguguuccaagaaaacgucuuccacacgauguggcacgugacccggggagccgugcugauguaucagggcaaacgccucgagccuuccugggccagcguuaagaaagaccugauuucuuacgggggaggcuggagacuccagggcuccuggaauacaggggaggaaguccaggugaucgcuguggagcccggaaagaacccuaagaauguccaaaccgcccccggcacauuuaaaaccccggaaggggaggugggagcgauugcucuggauuucaagccuggcacaagcgggucucccaucguuaaccgggaaggaaaaauugugggccuuuacggcaauggggucgugacgaccuccggaacauauguuagcgccaucgcccaggcuaaggccucccaggagggcccucugcccgagaucgaagacgagguguuuagaaaacgcaaccugaccauuauggaucuccaucccgggucuggaaagacccggagauaccugccugcgaucguccgcgaagcuauuaagcggaaacuuagaacacugauccucgccccgacgcgcgugguugccagcgagauggcugaagcccugaagggcaugcccauucgguaucaaaccacagcugugaaauccgagcacaccgggaaggagaucgucgaccugaugugccaugccacauucaccaugagacuccuuagcccugugcgcgugcccaauuacaacaugaucauuauggaugaagcgcacuuuacggacccuucuuccaucgccgcucggggcuauauuagcacaagagucggaaugggcgaggccgcugccaucuucaugaccgccacacccccugggucuguugaggcuuuuccgcagagcaaugcggugauucaggaugaggaacgggacauccccgagcgcuccuggaacucuggauacgaguggaucacagauuucccuggcaaaaccgugugguuuguccccagcauuaaguccgggaaugacaucgccaacugucugagaaagaauggaaaacgggugauucagcugucucgcaagacauucgauaccgaauaucagaagacgaagaacaacgacugggacuacguugugacaaccgauaucagcgagaugggcgcuaauuuuagagccgaccgggucauugauccuagacgcugccucaaacccgugauccugaaggacgggccggaacggguuauucuugccggcccuaugcccgugacagucgcuuccgccgcgcagagacgcggacggaucggcagaaaccauaauaaggagggggaucaguacaucuauaugggacagccccugaacaaugacgaggaucacgcucacuggaccgaagccaaaaugcuccuggacaacauuaauacgccugagggcaucauucccgcccuguucgaaccugagcgcgaaaagagcgcugccaucgauggggaguaccggcucagaggagaggcgcgcaaaaccuucguggaacuuaugagacggggcgaccugccggucuggcugucuuauaagguggccuccgagggguuucaauacagcgaucgcagauggugcuucgacggcgaacggaacaaucagguucucgaggaaaacauggauguggagauuuggacaaaagagggagaacgcaagaaacugagaccccgguggcuugacgcuagaaccuauuccgacccucuggcccuccgcgaguuuaaggaguucgcugccggccggagaucugugagcggggaucugauccuggagaucggaaagcucccccagcaucuuacacagcgcgcucaaaaugcccuggacaaccuggucaugcuccacaauuccgaacagggcgggcgggcguacagacaugccauggaggagcugccugauaccauugaaacacuuaugcugcucgcucugaucgccguucugaccggaggcgugacgcucuuuuuccuuucuggccgggggcugggaaaaacaagcauuggccugcucugugugauggcuuccagcguccugcuuuggauggccucuguggagccccacuggaucgccgcuuccauuauccuggaauuuuuccucaugguucugcugaucccggagccugaccgccagagaacaccccaggauaaccaacucgcguauguggucauugggcuucuguuuaugauccugaccguggccgcuaaugagaugggacuccuggaaacaaccaagaaagaccuuggcauugggcacgucgccguggagaaccaucaccaugccacaaugcuggauguugaccuccacccugcuagcgccuggacgcuguacgcgguggccaccacaaucauuacccccaugaugcggcauacaaucgaaaacaccacggcuaauauuucucugaccgccaucgcuaaccaggccgcgauccucaugggacuugauaagggcuggccuauuuccaaaauggacaucggcgucccccugcuggcccucgggugcuacagccaggugaauccgcugacacuuaccgcugccguucugaugcucguggcucacuaugccauuaucggaccuggccugcaagcuaaggccacacgcgaggcgcagaagagaaccgccgcugggauuaugaaaaaccccacggucgauggaaucguggccaucgaccuggaucccgugguuuacgacgcuaaguucgaaaaacagcucggccagauuaugcuucugauccuguguacaucucaaauucuccugaugcggaccacaugggcccuuugcgagagcaucacccuggccaccgggccucucacaacgcugugggagggauccccgggcaaguuuuggaauaccacaauugcggucucuauggcuaacaucuuccgcggcagcuaucuggccggggcuggacucgccuuuucccuuaugaaaagccugggcgggggaagacggggcaccggggcccagggagaaacacugggcgagaaguggaagcgccagcucaaucagcuguccaaaucugaguucaacaucuacaagagaagcggcauuauggagguggaccgguccgaagcuaaagaggggcuuaagagaggagagaccacgcgccacgccgugucucggggcacagcgaaacugagaugguucgucgaacgcaaucucguuaagcccgaggggaaggugaucgaucugggauguggcagagggggauggagcuauuacugcgccggccugaaaaaggugaccgaagucaaaggcuauaccaaagggggaccuggccaugaggaacccauuccuauggcuacauacggguggaaccucgugaaacuucacuccggaaaggacgucuuuuucacacccccugagaaaugugauacacugcugugcgacaucggcgagucuagcccgaaucccacgauugaagaggggagaacccuccgcgugcugaagauggucgaaccuuggcuucggggaaaccaauuuuguaucaagauucugaaucccuacaugccuuccgugguugagacacucgagcagaugcagagaaaacauggcggcaugcuggugcgcaacccccugagcagaaauucuacccacgaaauguauugggucuccugcgggacaggaaacaucgugagcgccgugaauaugaccucuagaaugcuccugaaccgcuucacgauggcucaccggaagccgaccuacgagagagaugucgaccuuggcgccgggacacgccauguugcgguggaaccugagguggccaaccuggauaucauuggacagagaaucgaaaauauuaaacacgagcauaaguccaccuggcacuaugacgaggauaaccccuacaaaacaugggcuuaucauggcagcuacgaagucaagcccucuggguccgccagcuccauggugaauggaguugugaagcuccugaccaaaccuugggacgucauccccauggugacacaaauugcuaugaccgauacgacaccuuuuggccagcagcggguuuucaaggagaaaguggacacccgcaccccgaaggccaaaagaggcacagcucaaaucauggaagucacggcccgguggcuuuggggguuucugagcagaaacaagaagccccggaucuguacccgcgaggaguucacaagaaaagugcggucuaaugcggccauuggagcuguuuuuguggacgagaaccaguggaauagcgccaaggaggcugucgaagaugagcgcuucugggaccucgugcagaaagaaagagagcugcacaagcagggcaaaugcgcgaccugcgucuauaacaugauggggaagcgggaaaagaaacugggagaguuuggcaaggccaaagggucccgcgcgaucugguacauguggcucggcgcuagauuccuggaguuugaagcccuuggauucaugaaugaggaucacugguucucucgggaaaacagccuguccggcguggagggggagggacuccauaagcugggcuacauucuucgcgacaucucuaaaauuccugggggaaauauguaugccgaugacacagcuggcugggauaccagaaucacagaagacgaucugcaaaacgaggccaagaucaccgacauuauggaacccgagcacgcucuccuggccacgagcaucuuuaaacugaccuaccagaauaagguugugcggguccagcgcccugcgaagaacgggacagugauggaugugauuuccagacgggaccagcgcggcucuggacaaguuggcaccuaugggcucaauacauucaccaacauggaagcccagcugaucagacagauggagagcgagggaaucuuuucccccagcgaacuugagaucccgaaccuggcugaacgggugcucgauuggcuggagaaauacggcgucgaaagacuuaagcgcauggccaucucuggggacgacugugugguuaaaccuauugaugaccgguucgcuacggcccugacagcgcucaaugauaugggaaaggugagaaaagacgucccccagugggagccuuccaagggcuggaacgauuggcaacaggugcccuuuugcagccaucacuuccaccagcugaucaugaaggacgggcgcgagauugucgugccuugucggaaucaggaugaacugguuggcagagcccgcgugucucaaggagcuggcuggucccuccgggagaccgccugccuggggaaaagcuaugcucagauguggcagcuuauguacuuucauagacgcgaccugcggcucgccgcuaacgccaucuguuccgcgguccccguggauuggguuccgacaucuagaaccacguggagcauucacgcccaucaccaauggaugaccacagaagacaugcuguccguguggaaucgcgucuggaucgaggaaaacccuuggauggaggauaagacccaugugagcucuuggggagacgugcccuaucuuggcaaacgggaggaccaguggugcgggucccugauuggacucacagcuagagccaccugggccagcaauauccagguugcuaucaaccagguccggagacugauuggcaaugaaaacuaccuggauuacaugacaucuaugaagcgcuucaaaaaugagggggaccccgaaggcgcccucugguga

SEQ ID NO: 18924 - RNA, 9879 nt, Artificial Sequence
  derived and/or modified CDS sequence (opt5) from DENV-1__FJ461316__SS-prME
agcgugaccaugcugcugaugcugaugcccacagcccuugcuuuccaccugacgaccagaggcggggagccucauauggugguuuccaagcaggaacggggaaagucucuccuguuuaagaccagcgccggcgugaacaugugcacccuuaucgcgauggaccugggggagcucugugaagauacaaugaccuacaaaugcccccgcauuacagaggcugaacccgacgauguggacuguuggugcaaugccaccgauacgugggucaccuauggaacauguucccaaaccggcgagcacagacgggacaagcgcucuguggcccuggcuccucauguugggcugggacucgagacaagaaccgaaacguggaugagcuccgagggcgccuggaaacagauccagcggguggaaacaugggcucugcgccaccccggcuucaccgucauugcccuuuuucuggcgcaugccaucgggacaucuauuacccagaagggaaucaucuucauucuccugaugcuugugaccccuagcauggcuaugagaugcguuggcaucgggucccgggauuuuguggagggacugagcggcgccacaugggucgacguggugcucgagcacgggucuugugucacgaccauggcuaaggauaaacccacacuggacauugaacugcucaagaccgagguuacaaacccugccauccugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggcugggcgugcuucugaccuggcucggacucaauucuagauccacaagccugucuaugaccuguauugccguuggccuugugacacucuaccugggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcucucugcggccaucggcaaggcuugggaggagggggugugcggcauuagaagcgccacgcgccuggaaaacguuauguggaaacagaucuccaacgagcuuaaucauauccugcucgaaaacgacaugaaguucacaguggucgugggagauguggcuggcauucuggcccaggggaaaaagaugauccggccgcaacccauggaguacaaauauucuuggaaaagcuggggaaaggccaagauuaugggcgcugacguccagaauaccaccuuuaucauugaugggccuaacacacccgaauguccugacgaucagagagcguggaauaucugggagguugaggacuacggauucggcaucuuuaccacgaacauuuggcugaaacuucgcgauuccuauacacaggugugcgaccaccggcucaugagcgccgcuaucaaagauucuaaggccgugcacgccgacaugggcuacuggauugaauccgagaaaaaugaaaccuggaagcuggcuagagccagcuucaucgaggucaagacauguauuuggcccaaaucucauacccugugguccaacggggugcucgaaagcgagaugaucaucccgaagauuuauggaggcccuaucucucaacacaauuaccgccccggguacuucacacagaccgcgggaccuuggcaucugggcaaacuugagcuggauuuugaccucugcgaagggacgaccguuguggucgaugagcacugcggaaaccggggccccagccugagaacaaccacagugaccggcaagauuauccacgaaugguguugccgguccuguacgcugccuccccuucgcuucagaggggaggacggaugcugguauggcauggagauucggccgguuaaagaaaaggaggaaaaucucgucaagagcauggucucugcuggguccggagagguggacagcuuuucccugggccugcucuguaucucuaucaugauugaagagguuaugagaagccgcuggucccggaaaaugcugaugacagggacccuugccguguuccugcuccugaucaugggacagcugacauggaacgaucuuauuagacugugcaucauggucggcgccaaugcuucugaccgcaugggcauggggaccaccuaccucgcccugauggcgacauuuaagaugagaccuauguucgcugugggacuccuguuucggcgccuuacgagcagagaggugcugcuccugaccauuggccugucccuugucgccucuguugaacugcccaacagccucgaggaacugggggauggacucgccaugggcaucaugauucugaaacuucugacagacuuccaaucccaucagcucugggcuacccugcugagccuuacauuuaucaagaccacguucucucugcacuaugccuggaaaacaauggcuauggugcucuccaucgugagccuguuuccccucugucugucuaccaccucccagaagacaaccuggcuuccuguccugcuggggagccucggaugcaagccgcugacaauguuccuuauugccgagaauaaaaucuggggccggcgcucuuggccccugaacgaaggcauuauggcgguggggaucguuuccauucuccugagcucccuccugaagaacgaugugccucuugccggaccccugaucgcuggcgggaugcugaucgccuguuacgucauuagcggaucuagcgcugaccucucccuggagaaagccgccgaggugucuugggaagaggaagcugagcauagcggcgcgucccacaauauccuuguugaagugcaggaugacgggacgaugaagauuaaagaugaggagagagacgauacccugacaauccuccugaaggccacccuccuggcugucucuggaguguauccucuuagcauucccgccacacuguuugucugguacuucuggcagaagaagaagcagcgguccggcgugcugugggacaccccuucucccccggaaguugagcgcgccgugcucgaugacggcaucuauagaaucaugcagcgggggcugcuuggacgcagccaggucggcguggggguuuuccaagaaaacguguuucauacgauguggcacgucaccagaggagcugugcugauguaccagggcaaacggcucgagccuuccugggccagcgugaagaaagaccugauuucuuacgggggaggcuggagacuccagggcuccuggaauacaggggaggaaguucaggucaucgcgguggagcccggaaagaacccuaaaaaugugcaaaccgcucccggcacauucaagaccccggaaggggaggucggagccauugcccuggauuuuaagccuggcacaagcgggucucccaucgugaaccgcgaaggaaaaauuguuggccuuuauggcaaugggguggucacgaccuccggaacauacgugagcgcuaucgcccaggcgaaggcuucccaggagggcccucugcccgagauugaagacgagguuuuccggaaaagaaaccugaccaucauggaucuccaccccgggucuggaaagacccgccgguaucugccugccaucgugagagaagccauuaaacgcaaacuucggacacugauccucgcuccgacgagagucguggccagcgagauggcugaagcccugaagggcaugcccauucgcuaccaaaccacagcgguuaaauccgagcauaccgggaaggagaucguggaccugaugugccacgccacauuuaccaugcggcuccuuagcccugucagagugcccaauuauaacaugauuaucauggaugaagcucauuucacggacccuucuuccaucgccgcucggggcuacauuagcacacgcgugggaaugggcgaggccgccgcuaucuuuaugaccgcgacacccccugggucugucgaagccuucccgcagagcaaugcuguuauucaggaugaggaaagagacauccccgagcgguccuggaacucuggauaugaguggauuacagauuuuccuggcaaaaccgugugguucgugcccagcaucaaguccgggaaugacaucgccaacugucugcgcaaaaauggaaagagagucauucagcugucucggaagacauuugauaccgaauaccagaagacgaagaacaacgacugggacuacgugguuacaaccgauaucagcgagaugggcgccaauuucagagcugaccgcgugauugauccucggagaugccucaaacccgucauccugaaggacgggccggaacgcgugauucuugccggcccuaugcccguuacaguggcguccgcugcccagcggagaggacgcaucggccggaaccacaauaaagagggggaucaguauauuuacaugggacagccccugaacaaugacgaggaucaugcccacuggaccgaagcuaagaugcuccuggacaacaucaauacgccugagggcaucauucccgcccuguucgaaccugagagagaaaagagcgcggccaucgauggggaguaucgccucagaggagaggcucggaaaaccuuugucgaacuuaugcgcagaggcgaccugccgguguggcugucuuacaaggucgccuccgagggguuccaauauagcgaucggcgcuggugcuuugacggcgaaagaaacaaucaggugcucgaggaaaacauggauguugagauuuggacaaaagagggagaacggaagaaacugagaccccgcuggcuugacgcucggaccuacuccgacccucuggcccucagagaguucaaggaauuugcugccggccgccggucugugagcggggaucugauccuggagauuggaaaacucccccagcaccuuacacagagagcgcaaaaugcccuggacaaccuggugaugcuccauaauuccgaacagggcgggcgggcuuaucgccacgccauggaggagcugccugauaccaucgaaacacuuaugcugcucgcucugaucgccguccugaccggaggcguuacgcuguucuuucuuucuggcagagggcugggaaagacaagcauuggccugcucugugugauggccuccagcgugcugcuuuggauggcuucugucgagccccauuggaucgcggccuccauuauccuggaguucuuucucauggugcugcugauuccggagccugaccggcagcgcacaccccaagauaaccaacucgcuuacguugugaucgggcuucuguucaugauccugaccgucgccgccaaugagaugggacuccuggaaaccaccaagaaagaccuuggcauugggcacgcugccgugggaaaccaccaucacgcggccaugcuggaugucgaccuccauccugcuagcgccuggacacuguacgcuguggccacgaccaucauuacacccaugaugagacacaccaucgagaacacaaccgcgaauauuucucugacggccaucgcuaaccaggccgcuauucucaugggccuugauaagggcuggccuaucuccaaaauggacaucgggguuccccugcuggcccucggaugcuauagccaggugaauccgcugacccuuacagcugccguccugaugcucguggcgcauuacgccauuaucggcccugggcugcaagcuaaggccacccgggaagcucagaaacgcacagccgccggaauuaugaagaaccccaccguugauggcaucguggcgauugaccuggaucccgucguguaugacgcuaaguuugagaaacagcucgggcagaucaugcuucugauccuguguacgucucaaauucuccugaugagaacaaccugggcccuuugcgaaagcaucacacuggcuaccggaccucucaccacacugugggagggcuccccgggcaaguucuggaauacgaccauugccgugucuauggccaacaucuuucgggggagcuaccuggcuggagccggccucgcguucucccuuaugaaaagccucgggggaggccgcagagggacaggagcccagggcgagacccugggcgaaaaguggaaacggcagcucaaucagcuguccaagucugaguucaacacauauaagagaagcgggauuauggaaguugaccgcuccgaggcuaaagaaggacuuaagcggggcgagaccacgaaacacgccgucucuagagggacagcuaagcugcgcugguuuguggagcggaaucucgugaaacccgaaggaaaggucaucgaucugggcugugggagaggaggcuggagcuacuauugcgccggccugaagaaaguuaccgaggugaagggguacaccaaaggaggcccugggcacgaagaacccaucccuauggcgacauacggauggaaccucgugaaacuucauuccggcaaagacgucuucuuuauucccccugaaaagugugauacccugcugugcgacaucggggagucuagcccgaaucccacaauugaggaaggacgcacgcuccgggugcugaaaaugguugagccuuggcuuagaggcaaccaauucuguaucaagauucugaaucccuauaugccuuccguggucgaaacccucgagcagaugcagcgcaagcacggcgggaugcuggugcggaacccccugagcagaaauucuacacaugagauguacuggguuuccugcggaaccggcaacaucgugagcgccgucaauaugacaucucgcaugcuccugaaccgguuuaccauggcucacagaaaaccgacguaugaacgcgauguggaccuuggggccggaaccagacacguggcugucgagccugaaguugccaaccuggauauuaucggccagcggaucgagaauauuaagcaugaacacaaauccacauggcauuacgacgaggauaaccccuauaagaccugggcuuaccacgggagcuaugaggugaaacccucuggauccgccagcuccauggugaauggcgucgugaagcuccugacaaagccuugggacguuauccccauggugacccaaauugcgaugacagauaccacgccuuucggccagcagcgcgucuuuaaagaaaagguggacacaagaaccccgaaagccaagcgggggaccgcucaaaucauggagguuacagccaaauggcuuuggggauuccugagcagaaacaagaagccccggauuuguacgcgcgaagaguuuaccagaaaagugcggucuaaugcugccaucggcgccgucuucguggacgaaaaccaguggaauagcgcgaaggaggcuguugaggaugaacgcuuuugggaccucgugcauagagagcgggaacugcacaaacaggggaagugcgccacaugcgucuacaacaugaugggaaaacgcgagaagaagcugggcgaguucgggaaagccaagggcuccagagcuaucugguacauguggcucggagcccgguuucuggaguucgaggcucuuggcuucaugaaugaagaucacugguuuucucgcgagaacagccuguccgggguggaaggagagggccuccauaaacugggguauauucuuagagacaucucuaagauuccuggaggcaauauguacgccgaugacaccgcggggugggauacacggaucaccgaggacgaucugcagaacgaagcccgcauuacagacaucauggagcccgaacacgcucuccuggccaaaagcaucuucaagcugaccuaucaaaauaaagucgugagaguucagcggccugcuaagaacggcacggugauggaugucauuucccgcagagaccagcggggaucuggccagguggggaccuacggacucaauacauuuaccaacauggaggcccaacugaucagacagauggaaagcgagggcauuuucucccccagcgagcuugaaacaccgaaccuggcggagcgcgugcucgauuggcuggaaaaguaugggguugagcggcuuaaaagaauggccaucucuggagacgacuguguggucaagccuauugaugaccgcuuugcuaccgcccugacggcucucaaugauaugggcaaagugcggaaggacaucccccagugggaaccuuccaaaggguggaacgauuggcagcaaguucccuucugcagccaucacuuucaccagcugaucaugaaggacggcagagagauuguggucccuugucgcaaucaggaugagcuggugggacgggccagagucucucagggcgcuggguggucccuccgcgaaacagccugccugggaaagagcuacgcgcaaauguggcagcuuauguauuuccaucggagagaccugcgccucgccgcuaacgccaucuguuccgccgugcccguugauuggauuccgaccucucggacaaccuggagcauccacgcucaucaccaguggaugacgaccgaggacaugcuguccguguggaauagagucuggauugaagagaacccuuggauggaagauaaaacacauaucagcucuuggggcgacgugcccuaccuugggaagcgggaggaccaauggugcggaucccugauuggccucaccgccagagcgacaugggcuaccaauauccagguugccaucaaccaggugcgccggcugauugggaaugagaacuaccuggauuauaugacaagcaugaaaagauuuaagaaugaaucugaccccgagggcgcccucugguga

SEQ ID NO: 18925 - RNA, 9879 nt, Artificial Sequence
  derived and/or modified CDS sequence (opt5) from DENV-1__FJ410220__SS-prME
agcgugaccaugcugcucaugcugaugcccacggcccuugcuuuccaccugacgaccagaggaggggagccucauaugaucguguccaagcaggaacggggaaaaucucuccuguuuaagaccagcgccggaguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccagaccggcgagcacagacgggagaagcgcucugucgcccuggcuccucauguggggcugggacucgaaacaagaaccgagacguggaugagcuccgaaggcgccuggaaacagauucagcggguugagacaugggcucugcgccaccccggcuucaccgugaucgcccuuuuucuggcgcaugccauugggacaucuaucacccagaagggaaucgucuucauucuccugaugcuugugaccccuagcauggcuaugagaugcguuggcaucgggucccgggacuuuguggagggacugagcggcgccacaugggucgauguggugcucgaacacgggucuugugucacgaccauggcuaaggacaaacccacacuggauauugagcugcucaagaccgaaguuacaaacccugccgugcugcgcaaacuuugcaucgaggcgaagauuuccaauaccacgacagacagcagauguccgacccaaggagaagccacccugguggaggagcaggaugcuaacuucgucugccggcgcacauuuguggacagaggcuggggcaauggguguggacucuucggcaaagggucucugcuuaccugcgccaaguuuaagugcguuacaaaacuggaaggaaagaucgugcaguacgagaaccucaaauauuccgucauugugacgguucacaccggcgaucagcaucaaguggggaaugaaagcacagagcacggaaccacagcuaccaucacgccccaggccccuaccacagaaauccagcugaccgacuacggcgcccugacacucgacuguucuccccggaccggccuggauuucaacgagaugguccuucugacgaugaaggagaaauccuggcucgugcauaagcagugguuucuggaccuuccucugcccuggacaagcggggcuuccaccucucaagaaacauggaaucgccaggaucuccuggucaccuucaaaaccgcgcacgccaagaagcaggaggugguugugcugggaagccaagaaggcgcuaugcacacagcccucacgggggccaccgagauucagacauccggaaccacaaccaucuuugcuggccaucugaaaugcagacuuaagauggacaaacugacgcucaaggggaugagcuaugucauguguacaggcucuuucaaacuggaaaaggagguggccgagacccagcacggaaccguucuggugcagauuaaguacgaaggcacagaugcgccgugcaaaaucccuuucuccacccaagacgagaagggggucacacagaacggacggcuuauuacggcuaaucccaucgugaccgauaaagaaaagccugugaacaucgaggccgagccgcccuuuggcgaaagcuauauuguuaucggggccggagagaaagcucucaagcugucuugguucaagaaaggcagcuccauugggaagauguuugaagccacagcuagaggcgcccgccggauggcgauccugggagacaccgccugggauuucggcucuauugggggagucuuuacaagcgugggcaaacucgugcaucagaucuucgggaccgcuuacggaguccuguuuuccggcgugagcuggacgaugaagaucgggauuggcguucuucugaccuggcucggacucaauucuagauccacaagccugucuaugaccuguaucgccgugggccuugucacacucuaccugggggugaugguucaggcugacuccggaugcgugauuaacuggaaaggccgcgagcugaagugugggagcggaaucuucgucaccaaugaagugcacacauggaccgagcaauauaaguuucaggccgauuccccuaaacggcucucugcggccauuggcaaggcuugggaggaagggguuugcggcaucagaagcgccacgcgccuggagaacauuauguggaaacagaucuccaacgaacuuaaucauauccugcucgagaacgacaugaaguucacaguggucgugggagacguggcuggcauucugguccaggggaaaaagaugauccggccgcaacccauggaauacaaauauucuuggaaaagcuggggaaaggccaaaauuaucggcgccgauguucaaaauuccaccuuuauuaucgacgggccuaacacccccgaguguccugaugaccagagagcuuggaauaucugggagguggaagauuacggauucggcauuuuuacaaccaacaucuggcugaaacuucgcgacagcuauacacaggugugcgaucaccggcucaugucugcggccauuaaagacuccaaggcuguccacgccgauaugggcuacuggaucgagagcgagaagaaugagacauggaagcuggccagagcuucuuucauugaagugaagaccuguaucuggcccaaaucccauacacuguggagcaacgggguucucgagucugagaugaucauuccgaagauccacggaggcccuauuagccaacauaauuaucgccccggguacuucacccagacagccggaccuuggcaccugggcaaacuugaacuggacuuugaucucugcgaggggaccacgguggucguggacgaacacugcggaaaccggggccccucccugagaaccacaaccguuacaggcaagaucauucaugagugguguugccggagcuguacccugccuccccuucgcuucagaggggaggauggaugcugguacggcauggaaauccggccggugaaagagaaggaagagaaucucgucaagucuaugguguccgcggggagcggagaaguugacuccuuuucucugggccugcucuguaucagcauuaugaucgaggaggugaugagaucccgcuggucucggaaaaugcugaugacggggacacuugcugucuucuuucugcucauuaugggacagcugaccuggaacgaccugaucagacuuugcauuauggugggcgccaaugccagcgaucgcaugggcauggggacaaccuaucuggcucucauggccaccuucaagaugagaccuauguuugcggugggacugcuguuccggcgccugacauccagagaaguccuucugcucacgaucggccugucucugguugcuagcguggagcuucccaacucccuggaagaacugggggacggacuggccaugggcauuaugauccucaaacugcuuaccgauuuucaaagcuaccagcugugggccacacuccugucucugaccuucaucaagacaaccuuuucccuucacuaugcuuggaaaacgauggccauggugcugagcauugucucucucuucccccugugucucuccacaaccagccagaagaccacauggcugccugugcuucuggggucucugggaugcaagccgcucaccauguuucugaucgcugaaaauaaaauuuggggccggaaguccuggccccuuaacgagggcaucauggccguugggauugugagcauccugcucuccagccugcucaaaaacgacgucccucuggcgggaccccuuaucgccggcgggaugcugauugcuuguuacgugaucucuggaagcuccgccgaucugucucucgagaaggcugccgaaguuagcugggaggaagaggccgaacauuccggcgcuucucacaauauucugguggagguccaggacgaugggacaaugaaaaucaaggacgaggaacgcgaugacacgcuuaccauucugcucaaagcgacacugcucgccgugagcggagucuauccucuguccauccccgcuacccuuuucguguggcauuucuggcaaaagaagaaacagagaucuggcguucugugggauacaccuagcccucccgagguggaacgggccguccuggacgauggcaucuaccgcauuaugcagagagggcuccugggacggucccaggugggcguugggguguuucaagagaacgucuuccacaccauguggcacgugacgcgcggagccgugcuuauguaucagggcaagagacuggagcccagcugggcuucuguuaaaaaggaccucaucuccuacgggggaggcuggcgguuucagggcagcuggaauaccggggaagagguccaggugauugccguggaacccggcaagaacccuaagaauguccaaacagcgcccggcaccuucaagacaccggagggggaagugggagcuaucgcccuggacuuuaaaccuggcaccucugggucccccauuguuaacagagagggaaagaucgugggccucuacggcaauggggucgugacaacgagcggaaccuauguuuccgccauugcucaggccaaagcgucucaggagggcccucugcccgaaaucgaggaugaaguguuccgcaagcggaaccuuacaaucauggaccugcaucccgggagcggaaaaaccagacgcuaccugccugcuauuguccgggaggccaucaagagaaagcuccgcacccugauucuugccccgacacgggugguugcuuccgaaauggccgaggcucugaaaggcaugcccaucagauaucaaacgaccgccgucaagagcgagcacacagggaaagaaauugucgaucucaugugccaugcgaccuuuacaaugcgccugcugucuccugugcgggugcccaauuacaacaugaucaucauggacgaggcccacuucaccgauccuuccagcauugcugccagaggcuauaucucuacgcgggucggaaugggcgaagcugccgccauuuuuaugacagcuacacccccugggagcauggaggcguucccgcaguccaaugccguuauccaggacgaagaaagagauauucccgagagaucuuggaacagcggauacgaauggaucaccgacuuuccuggcaagacagugugguucgugcccuccaucaaagcugggaaugauauugccaacugucuccggaagaauggaaagcgcgucauccagcuuucuagaaaaaccuucgacacagaguaucaaaagaccaaaaacaacgauugggacuacgugguuacgacagacauuagcgaaaugggcgccaauuuucgggcugauagagugaucgacccucgccggugccugaagcccgucauucugaaagaugggccggagagagugauccucgccggcccuaugcccguuaccguggcguccgcugcccagcgccggggaagaauuggccgcaaccauaauaaggagggggaccaguacaucuauaugggacagccccugaacaaugaugaagaccacgcccacuggacagaggcuaagaugcuucuggauaacaucaauaccccugaaggcauuauccccgcccucuucgagccugaacgggagaaaagcgcggccauugacggggaguacagacugcgcggagaagcuagaaagacguuugucgagcugaugcggcgcggcgaucucccgguguggcuuucuuauaaagucgccuccgaaggguuccaauacagcgacagacgguggugcuuugauggcgagcgcaacaaucaggugcuggaagagaacauggacguugagaucuggaccaaggaaggagagcgcaaaaagcugcggcccagauggcucgaugcucgcacauauuccgacccucuggcccuucgggaguucaaagaguuugcugccggcagacgcucugugagcggggaccugauucucgaaaucggaaagcugccccagcaucugacccagcgggcgcaaaaugcccucgauaaccuugugaugcugcacaauuccgagcagggcgggagagcuuaccggcaugccauggaggaacugccugacacaaucgagacccucaugcugcuugcucugauugccguccucacaggaggcguuacccuguucuuucugucuggcaaggggcucggaaaaacgagcaucggccuucugugugugauggccuccagcgugcugcucuggauggcuucugucgaaccccacuggauugcggccuccaucauucuggaguucuuucuuauggugcugcucaucccggagccugaucgccagagaacaccccaggacaaccaacuggcuuauguugugaucgggcuccucuucaugauucuuaccgucgccgccaaugaaaugggacugcuggagaccacaaagaaagaucucggcaucgggcacguggcugucgaaaaccaucaccaugccgcgaugcuggacguggaucuucacccugccagcgcuuggacccuguacgccguugcuacaacgauuaucacccccaugaugcggcauacaauugagaacaccacagccaauaucucucucaccgcgauugccaaccaggcugccauccugaugggacuggacaagggcuggccuaucuccaaaauggauauuggcgugccccuccuugcucuggggugcuacagccaggucaauccgcugacgcucaccgccgcugugcugaugcuuguugcccacuaugcgaucauuggaccuggccugcaagccaaggcuacacgcgaagcccagaagagaaccgcugccgggaucaugaaaaaccccacaauugacggaaucguggccaucgaucucgaccccgucguguacgaugcgaaguuugagaaacagcugggccagauuaugcugcucauccuuuguaccucucaaauucugcugaugcggacgacaugggcucucugcgagagcaucacccuggccacagggccucuuaccacccugugggaaggauccccgggcaaguucuggaauacaacgauugcugugucuauggccaacaucuuccgcggcagcuaucucgccggggcuggacuggccuuuucccugaugaaaagccucggcgggggaagacggggcaccggggcgcagggagagacacuuggcgaaaaguggaagcgccagcugaaucagcuguccaaaucugaguucaacaccuacaagagaagcggcaucauggaaguugaccgguccgaggccaaagaggggcucaagagaggagaaacaaccaaacacgcugucucucgcggcacggccaagcugcggugguuuguggagagaaaucuugugaagcccgaagggaaagucauugaccugggauguggccgcgggggauggagcuauuacugcgcuggccucaagaaaguuacagaggugaagggcuauaccaaagggggaccuggccaugaggaacccaucccuauggccaccuacggguggaaccuggugaagcugcacuccggaaaagaugucuucuuuauucccccugagaagugugacacacuccuuugcgauaucggcgaaucuagcccgaaucccaccauugaggaagggcggacacugagagugcugaagaugguugagccuuggcuccgcggaaaccaauucuguaucaaaauucugaaucccuacaugccuuccguggucgagacgcuugaacagaugcagcggaagcauggcggcaugcuggugagaaacccccucagccgcaauucuacccacgagauguauuggguuuccugcgggacaggaaacaucgugagcgcggucaauaugaccucucggaugcugcugaacagauuuacaauggcccaccgcaaaccgaccuacgaacgggacguggaucucggcgcugggacgagacauguggccgucgagccugaaguugcuaaccuggacaucauuggacagcgcaucgagaauauuaagcacgagcauaaauccaccuggcacuaugaugaagacaaccccuacaagacaugggccuaucauggcagcuacgaggugaagcccucuggguccgcuagcuccauggugaauggagucgugaaacuucugaccaagccuugggauguuauccccauggugacacaaauugccaugaccgacacaaccccuuucggccagcagagagucuuuaaagaaaagguggauacgcggacaccgaaagcgaagcgcggcaccgcccaaaucauggagguuaccgcuagauggcucuggggguuccugagccggaacaagaaacccagaaucuguacacgggaagaguuuacgcgcaaggugagaucuaaugccgcuauuggagccgucuucguggacgagaaccaguggaauagcgccaaagaagcgguugaggacgaucgguuuugggaccuugugcaccgcgaaagagagcugcacaagcagggcaaaugcgcuaccugcgucuauaacaugauggggaagcgggaaaagaaacucggagaguucggcaaggccaaagggucccgcgccaucugguacauguggcugggcgcuagauuccuggaguuugaagcccucggauucaugaaugaggaucauugguuuucucgggaaaacagccuguccggcguggagggggagggacuucacaagcugggcuacauucuccgcgacaucucuaaaauuccugggggaaauauguaugcugaugacacagccggcugggauaccagaaucacagaagacgaucugcagaacgaggcgaagaucaccgacauuauggaacccgagcaugcccuucuggcuaaaagcaucuucaagcucacauaccaaaauaaggucgugcggguucagcgcccugccaaaaacgggaccgugauggaugucauuuccagacgggaccagcgcggcucuggacaggugggcacguaugggcugaauaccuuuacaaacauggaagcucaacugaucagacagauggagagcgagggaauuuuccuccccaacgaacuggagaccccgaaucuugccggccgggugcuggauuggcucgaaaaguacgggguugagagacugaaacgcauggcgaucuccggagacgacuguguggucaagccuaucgaugaccgguuugccacagcucuuaccgcccugaacgauaugggcaaagugagaaaggacauuccccagugggaaccuagcaagggguggaaugauuggcagcaaguucccuucugcucucaccacuuucaucagcucaucaugaaagacggccgcgagauuguggucccuugucggaaccaggaugagcuggugggcagagcucgcgucucccagggcgccggguggagccugcgggaaacggcuugccucggaaagucuuaugcccaaauguggcagcugauguacuuccacagacgcgaccuucggcuggcggccaaugcuaucuguuccgccgugcccguugauugggugccgacaagcagaaccacaugguccauucaugcccaccaucaguggaugaccacggaggacaugcucucugucuggaaccgcguguggaucgaagagaauccuuggauggaagauaaaacccggauuagcuccugggaggacguucccuaucugggcaagagagaggaccaauggugcgggagccuuaucggacugacagcucgggccaccugggcgacaaacauccagguggcuauuaaucaggucagacgccucaucggcaacgaaaauuacucugauuacaugaccuccaugaaacgguuuaagaacgagagcgaacccgagggggcccugugguga

SEQ ID NO: 18926 - RNA, 9879 nt, Artificial Sequence
  derived and/or modified CDS sequence (opt5) from DENV-1__JF937649__SS-prME
agcgugaccaugcugcucaugcugaugcccacggcccuugcuuuccaccugacgaccagaggcggggaaccucauaugaucgucuccaagcaggaacggggaaagucucuccuguuuaagaccagcgccggcguuaauaugugcacccuuaucgcgauggaccugggggagcucugugaagauacaaugaccuacaagugcccgagaaucacagagguggaacccgacgauguggacuguuggugcaauaccacggauaccugggucacauauggaaccuguucccaaacaggcgagcaccggcgggacaagcgcucuguggcucuggccccucauguugggcugggacucgagaccagagccgaaacguggaugagcuccgagggcgcuuggaagcagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaggauaagcccacacuggacaucgaacugcucaaaaccgagguuacaaacccugcugugcugcggaaacuuugcauugaagccaaaaucuccaauaccacgacagauagccgcuguccgacccaaggagaggcgacccugguggaagaacaggacgccaacuucgucugcagacggacauuuguggaucgcggcuggggcaauggguguggacucuucggcaaggggucucugauuaccugcgcuaaguuuaaaugcguuacaaaacuugagggaaaaaucgugcaguacgaaaaccugaaguauuccgucaucgugacgguucacaccggcgaccagcaucaaguggggaaugagagcacagaacacggaaccacagccaccauuacgccccaggcuccuaccucugagauccagcucacagacuacggcgcccugacccuggauuguucccccagaacaggccucgacuucaacgaaaugguccugcuuaccaugaaagaaaaguccuggcuggugcauaaacagugguuucucgaucugccucuucccuggacguccggggccucuacaagccaagagaccuggaaucggcaggaccugcucgucacauucaagaccgcucacgcgaagaaacaggaagugguugugcugggaucccaagagggcgccaugcacaccgcucugacaggggccacggaaauucagaccagcggaacaaccacaaucuuugccggccaucucaagugccgccugaaaauggauaaacuuacccugaaagggaugucuuaugucauguguacgggcuccuucaagcucgagaaggaaguggcugagacacagcacggaaccguucuggugcagauuaaauacgagggcaccgacgccccgugcaagaucccuuucagcacacaagaugaaaaaggggucacccagaacggaagacugaucacagcgaaucccauugugacggacaaggagaaaccugugaacaucgaagcugagccgcccuuuggcgagucuuauauuguuaucggggccggagaaaaggcccuuaagcucagcugguucaaaaagggcuccucuauugggaaaauguuugaggcuaccgcccggggcgcuagacgcauggccauccugggagauacagcgugggacuucggcagcaucgggggagucuuuaccuccgugggcaagcuggugcaucagauuuucgggacagccuacggaguccucuuuagcggcgugucuuggaccaugaaaaucgggauuggcguucugcuuacguggcugggacucaauucccggagcaccucucuguccaugacauguaucgcugugggccuggucacccuuuaccucggggugaugguucaggccgauagcggaugcgugauuaacuggaagggcagagaacugaaguguggguccggaaucuucgucacaaaugaggugcacaccuggacagaacaauauaaauuucaggcugacucuccuaagcgccugagcgccgcgauuggcaaagccugggaggaggggguuugcggcauccgguccgcuaccagacucgaaaacaucauguggcgccagauuucuaacgagcugaaucauauccuucuggaaaacgacaugaaguucacgguggucgugggagauguggucggcauucucgcccaggggaaaaagaugauccggccgcaacccauggagcacaaauacagcuggaaguccuggggaaaggcuaaaauuaucggcgccgacguucagaauacaaccuuuaucauugaugggccuaacacccccgaauguccugacgaucagagagccuggaauaucugggagguggaggacuauggauucggcauuuuuacaaccaacaucuggcugaagcugcgcgauagcuacacacaggugugcgaccaccggcuuaugucugcugcgauuaaagauuccaaggccguccaugcugacaugggcuauuggaucgaaagcgagaaaaaugaaacauggaagcucgccagagccucuuucaucgaggugaagaccuguauuuggcccaaaucccacacacuguggagcaacgggguucuggaaucugagaugaucauuccgaagaucuacggaggcccuauuagccaacauaauuaucgccccggguacuucacccagacagcuggaccuuggcaccucggcaaacuggagcuugauuuugaccugugcgaagggaccacgguggucguggaugagcacugcggaaaccggggccccucccucagaaccacaaccguuacaggcaagaucauccaugaaugguguugccggagcuguacccugccuccccugcgcuucaaaggggaggacggaugcugguacggcauggagauuagaccggugaaggaaaaggaggaaaaucuugucaaaucuaugguguccgccgggagcggagagguugacuccuuuucucucggccugcuguguaucagcauuaugaucgaagaggugaugcgguccagauggucucgcaagaugcucaugacggggacacuggcggucuucuuucuucugauuaugggacagcucaccuggaacgaucugauccggagcugcauuauggugggcgcuaaugccuccgacagaaugggcauggggacaaccuaucuggcccuuauggcuaccuucaaaaugcgcccuauguuugccgugggacuccuguucagacggcugacaucucgcgagguccuccugcuuacgaucggccugagccucguugcguccguggaacugcccaacagccuggaggaacuuggggauggacuggcuaugggcaucaugauucucaagcugcucaccgacuuucaaucuuaccagcugugggccacacuucugucccucaccuucaucaaaacaaccuuuagccugcacuaugccuggaagacgauggcuauggugcugucuauugucucccuucugccccucugucugagcacaaccucucagaagaccacauggcucccugugcugcuugggucccugggaugcaaaccgcugaccauguuccucaucgccgagaauaagauuuggggcagaaaaagcuggccccugaacgaaggcaucauggcuguugggaucguguccauucuucugagcucucuccugaagaacgaugucccucucgccggaccccugaucgcgggcgggaugcuuauugccuguuacgugaucagcggauccucugcugaccugagccuggagaaagccgcugagguuuccugggaagaggaagccgagcauucuggcgccagccacaauauucucguggaaguccaggaugacgggacaaugaagaucaaagaugaggagcgggacgauacgcugaccauccuucugaaggcuacacuccuggcgguguccggagucuauccucucucuauucccgccacccuguuugugugguacuucuggcaaaagaaaaagcagcgcagcggcguucuuugggacacaccuagcccucccgaaguggagagagcuguccuggaugacggcaucuaucggauuaugcagcgcgggcugcucggaagaagccaggugggcguugggguguuccaagaaaacgucuuucauaccauguggcacgugacgcggggagccgugcugauguaccagggcaaacgccuugagcccucuugggccuccguuaagaaagaccugaucagcuacgggggaggcuggagacuccagggcucuuggaauaccggggaggaaguccaggugauugcuguggagcccggaaagaacccuaagaauguccaaacagcccccggcaccuucaaaacaccggaaggggaggugggagcgaucgcucuggauuuuaagccuggcaccuccgggagccccauuguuaaccgggaaggaaaaaucgugggccucuauggcaauggggucgugacaacguccggaaccuacguuucugccaucgcccaggcuaaggccagccaggagggcccucugcccgagauugaagacgagguguucagaaaacgcaaccuuacaaucauggaucugcaccccggguccggaaagacccggagauaucugccugcgauuguccgcgaagcuaucaagcggaaacucagaacccugauucuugccccgacacgcgugguugccagcgagauggcugaagcccugaagggcaugcccauccgguaccaaacgaccgcugugaaaucugagcauacagggagagagaucgucgaccucaugugccacgccaccuuuacaaugcgccugcuguccccugugcgggugcccaauuauaacaugauuaucauggaugaagcgcauuucaccgacccuagcucuauugccgcuagaggcuacaucagcacgcgggucggaaugggcgaggccgcugccauuuuuaugacagccacacccccuggguccguugaggcuuucccgcagucuaaugcggugauccaggaugaggaacgcgacauccccgagagaagcuggaacuccggauaugaguggauuaccgauuuuccuggcaagacagugugguucguccccucuaucaaaagcgggaaugacauugccaacugucuccggaagaauggaaagcgcgugauccagcuuuccagaaaaaccuuugauacagaauaccaaaagaccaaaaacaacgacugggacuacguugugacgacagauauuagcgagaugggcgcuaauuuccgggccgacagagucaucgauccucgccggugccugaagcccgugauucugaaagacgggccggaaagaguuauccucgccggcccuaugcccgugaccgucgcuucugccgcgcagcgccggggaagaaucggccgcaaccacaauaaggagggggaucaguauauuuacaugggacagccccugaacaaugacgaggaucaugcucacuggacagaagccaagaugcuucuggacaacaucaauaccccugagggcauuauccccgcccucuucgaaccugagcgggaaaaauccgcugccauugauggggaguauagacugcgcggagaggcgagaaagacguuuguggaacugaugcggcgcggcgaccucccggucuggcuuagcuacaaaguggccuccgagggguuccaauauucugauagacgguggugcuuugacggcgaacgcaacaaucagguucuggaggaaaacauggauguggagaucuggaccaaggagggagaacgcaagaagcugcggcccagauggcucgacgcucgcacauacagcgacccucuggcccuucgggaguucaaagaauuugcugccggcagacgcuccgugucuggggaucugauccucgagauuggaaagcugccccagcaccugacccagcgggcucaaaaugcccucgacaaccuugucaugcugcauaauagcgaacagggcgggagagcguaucggcacgccauggaggagcugccugauacaaucgaaacccucaugcugcuugcucugauugccguucucacaggaggcgugacccuguucuuucuguccggcaaggggcucggaaaaacgagcaucggccuucugugugugauggcuucuuccgcccugcucuggauggccagcgucgagccccauuggauugcugcgucuaucauccuggaguucuuucuuauggugcugcucauuccggagccugaccgccagagaacaccccaggauaaccaacuggccuacguugugaucgggcuccuguucaugauucuuaccgucgcugccaaugagaugggacugcuggaaaccacaaagaaagaccucggcaucgggcacguggccgucgagaaccaccaucacgcuaccaugcuggauguggaccuucauccugccuccgcguggacacuguacgccguugcuacgaccauuaucacacccaugaugcggcacaccauugaaaacacaaccgccaauaucagccucacggcuaucgccaaccaggcggccauucugaugggacuggauaagggcuggccuaucucuaaaauggacauuggcgugccccuccuugcucuggggugcuauagccaggucaauccgcugacccucacagccgcugugcugaugcuuguugcccauuacgcuaucauuggaccuggccugcaagccaaggcgacccgcgaggcccagaagagaacagcugccgggaucaugaaaaaccccaccguggauggaaucgucgcuauugaccucgaucccgugguguaugacgccaaguuugaaaaacagcugggccagaucaugcugcucauucuuuguacgucccaaauccugcugaugcggacaaccugggcccucugcgagucuauuacacuggcgaccgggccucuuaccacacugugggagggaagcccgggcaaguucuggaauacgaccaucgcuguuuccauggccaacaucuuucgcggcagcuaccucgcuggggccggacuggccuucucccugaugaaaucucucggcgggggaagacggggcacaggggcucagggagaaacccuuggcgagaaguggaagcgccagcugaaucagcugagcaaauccgaguucaacacauauaagagaucuggcauuauggaggucgaccggagcgaagccaaagaggggcucagacgcggagagaccacgaagcacgcggugucccggggcacagccaaacugagaugguuuguggaacgcaaucuugucaagcccgaggggaagguuaucgaucugggauguggcagaggcggguggucuuacuauugcgcugggcucaaaaaggugaccgaagugaaaggcuacaccaaagggggaccuggccacgaggaacccauuccuauggccacauacggguggaaccuggucaaacugcauagcggaaaggacguguucuuuauucccccugagaaaugugauacccuccuuugcgacauuggcgaguccagcccgaaucccacaaucgaagaggggagaacgcugcgcguucugaagaugguggaaccuuggcuccggggaaaccaauucuguauuaagauccugaaucccuauaugccuucugucguggagacccuugagcagaugcagagaaaacacggcggcaugcugguucgcaacccccucucccggaauagcacacaugaaauguacugggugucuugcgggaccggaaacaucgucuccgcugugaauaugacaagcagaaugcugcugaaccgcuuuaccauggcccaccggaagccgacguaugagagagauguggaccucggcgcggggacccgccacgucgccguugaaccugagguggcuaaccuggauauuaucggacagagaauugaaaauaucaaacaugagcacaagucuacauggcauuacgacgaggauaaccccuauaaaaccugggccuaccacggcuccuaugaagugaagcccagcggguccgcuagcucuauggucaauggagugguuaaacuucugacaaaaccuugggacgugauucccauggucacccaaaucgccaugacagauaccacgccuuucggccagcagcggguguuuaaggagaaaguugacacacgcaccccgaaggcuaaaagaggcaccgcccaaaucauggaagugacagcgcgguggcucuggggguuccugagcagaaacaagaagccccggauuuguacgcgcgaggaauuuaccagaaaaguccgguccaaugccgcuaucggagccguguucguugacgagaaccaguggaacucugcuaaggaggccguggaagaugagcgcuuuugggaccuuguccauagagaacgggagcugcacaaacagggcaagugcgccacaugcguguacaacaugauggggaaacgcgaaaagaagcucggagaguucggcaaagcgaaggggagcagagcuauuugguacauguggcugggcgcccgguuucuggaguucgaagcccucggauucaugaaugaggaucacugguuuucccgcgaaaacucucugagcggcgucgagggggagggacuucauaaacugggcuauauccucagagacauuuccaagaucccugggggaaauauguacgcugaugacaccgccggcugggauacacggaucaccgaagacgaucugcagaacgaggcuaaaauuacagacaucauggaacccgagcacgcccuucuggcgaccucuauuuucaagcucacguaucaaaauaaagugguucgcgugcagagaccugcccggaacgggaccgucauggaugugaucagccgcagagaccagcggggcuccggacaggugggcacauacgggcugaauaccuuuacaaacauggaagcucaacugauuagacagauggagagcgagggaaucuucucucccuccgaacucgagaccccgaaccuggccgaacgcguucuugauuggcuggagaagcauggcguggaacggcucaagagaauggcuaucagcggggacgacugugucgugaaaccuauugaugaccgcuuugccacggcgcugucugcccuuaaugauaugggaaagguucggaaagacaucccccagugggagccuuccaagggcuggaacgauuggcagcaagugcccuucugcagccaccacuuucaucagcugauuaugaaagacgggagagagaucgucgugccuugucgcaaucaggaugaacucgucggccgggcuagagugucccagggagccggcuggucucugcgcgagacagcuugccugggaaagagcuaugcccaaauguggcagcucauguacuuccaccggagagaccugcgccuugcugccaacgcgauuuguuccgccguucccguggauugggucccgaccagccggacaaccuggucuauccaugcucaccaucaguggaugacgaccgaagacaugcuguccguguggaauagaguuuggauugaggaaaacccuuggauggaggauaagacacacaucagcucuuggggagacgugcccuaucucggcaaacgggaggaccaauggugcgggagccugaucggacuuaccgccagagccacaugggcuaccaauauucaggucgccaucaaccaggugcgccggcugauuggcaaugaaaacuaccucgauuacaugacauccaugaagagauuuaaaaaugagucugaccccgaaggggcgcugugguga

SEQ ID NO: 18927 - RNA, 9879 nt, Artificial Sequence
  derived and/or modified CDS sequence (opt5) from DENV-1__FJ410222__SS-prME
agcgugaccaugcugcucaugcugaugcccacagcccuugcuuuccaccugacgaccagaggcggggaaccucauaugaucguguccaagcaggaacggggaaagucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggagguggaggacuacggauucggcauuuuuacgacaaacaucuggcugaaacuucgcgauuccuauacccaggucugcgaccaccggcucaugagcgcggccauuaaagauucuaaggcuguucacgccgacaugggcuacuggaucgaauccgagaaaaaugaaacauggaagcuggccagagcuagcuucaucgaggugaagaccuguauuuggcccaaaucucauacacugugguccaacggggugcucgaaagcgagaugaucauuccgaagaucuauggaggcccuauuucucaacacaauuaccgccccggguacuucacccagacggccggaccuuggcaucugggcaaacuugagcuggauuuugaccucugcgaagggaccacagucgugguugaugagcacugcggaaaccggggccccagccugagaaccacaaccgugacgggcaagaucauccacgaaugguguugccgguccuguacacugccuccccuucgcuucagaggggaggacggaugcugguauggcauggagauucggccggucaaagaaaaggaggaaaaucucgucaagagcaugguuucugcgggguccggagagguggacagcuuuucccugggccugcucuguaucucuauuaugaucgaagaggucaugagaagccgcuggucccggaaaaugcugaugaccgggacacuugcuguguucuuucugcucauuaugggacagcugaccuggaacgaucugaucagacuuugcauuaugguuggcgccaaugccucugaccgcaugggcauggggaccacauaccuggcucucauggccacguucaagaugagaccuauguuugcggugggacugcuguuccggcgccugaccagcagagagguccuucugcucacaaucggccugucccugguggcuucuguggaacuucccaacagccuggaggaacucggggauggacuggccaugggcaucaugauucucaaacugcuuaccgacuuucaaucccaucagcugugggccacacuccugagccugaccuucaucaagacgacauuuucucuucacuaugcuuggaaaaccauggccaugguccuguccauuguuagccuccugccccucugucugucuaccacaucccagaagaccacauggcuuccugugcugcuggggagccucggaugcaagccgcugacgauguuccuuaucgcugagaauaaaauuuggggccggcgcucuuggccccugaacgaaggcaucauggccguggggaucgucuccauucuccugagcucccuccugaagaacgaugugccucuugcgggaccccugaucgccggcgggaugcugauugcuuguuacguuaucagcggaucuagcgccgaccucucccuggagaaagcugccgaggugucuugggaagaggaagccgagcauagcggcgcuucccacaauauucuugucgaagugcaggaugacgggaccaugaagaucaaagaugaggagagagacgauacacugaccauccuccugaaggcgacacuccuggccguuucuggaguguauccucuuagcauucccgcuacccuguuugucugguacuucuggcagaagaagaagcagcgguccggcgugcugugggacacgccuucucccccggaagucgagcgcgccgugcucgaugacggcaucuauagaauuaugcagcgggggcugcuuggacgcagccagguuggcgugggggucuuccaagaaaacguguuucauaccauguggcacguuacaagaggagccgugcugauguaccagggcaaacggcucgagccuuccugggcuagcgucaagaaagaccugaucucuuacgggggaggcuggagacuccagggcuccuggaauaccggggaggaaguccaggugauugccguugagcccggaaagaacccuaaaaauguccaaacagcgcccggcaccuucaagacaccggaaggggaggugggagcuaucgcccuggauuuuaagccuggcacgagcgggucucccauugugaaccgcgaaggaaaaaucgucggccuuuauggcaauggggugguuaccacauccggaaccuacgugagcgccaucgcucaggccaaggcgucccaggagggcccucugcccgagauugaagacgaggucuuccggaaaagaaaccugaccaucauggaucuccaccccgggucuggaaagacacgccgguaucugccugcuauugugagagaagccaucaaacgcaaacuucggacgcugauucucgccccgaccagaguuguggcuagcgagauggccgaagcucugaagggcaugcccauccgcuaccaaacaaccgccgucaaauccgagcauacagggaaggagaucguggaccugaugugccacgcgaccuuuacgaugcggcuccuuagcccuguuagagugcccaauuauaacaugauuaucauggaugaagcccauuucacagacccuucuuccauugcugcccggggcuacaucagcacccgcgucggaaugggcgaggcugccgccauuuuuaugaccgcuacacccccugggucuguggaagcguucccgcagagcaaugccgugauccaggaugaggaaagagacauccccgagcgguccuggaacucuggauaugaguggauuaccgauuuuccuggcaaaacagucugguucguucccagcaucaaguccgggaaugacauugcuaacugucugcgcaaaaauggaaagagagugauccagcugucucggaagaccuuugauacggaauaccagaagaccaagaacaacgacugggacuacguggucaccacagauauuagcgagaugggcgccaauuucagagccgaccgcgugaucgauccucggagaugccucaaacccguuauucugaaggacgggccggaacgcgugauccuugcuggcccuaugcccgucaccguggccuccgcggcucagcggagaggacgcaucggccggaaccacaauaaagagggggaucaguauauuuacaugggacagccccugaacaaugacgaggaucaugcccacuggacggaagccaagaugcuccuggacaacaucaauaccccugagggcauuauccccgcucuguucgaaccugagagagaaaagagcgccgcgauugauggggaguaucgccucagaggagaggcccggaaaacauuuguugaacuuaugcgcagaggcgaccugccgguguggcugucuuacaaggucgcuuccgagggguuccaauauagcgaucggcgcuggugcuuugacggcgaaagaaacaaucaggugcucgaggaaaacauggaugucgagaucuggaccaaagagggagaacggaagaaacugagaccccgcuggcuugacgcccggacauacuccgacccucuggcucucagagaguucaaggaauuugccgcuggccgccggucugugagcggggaucugauccuggagauuggaaaacucccccagcaccuuacccagagagcccaaaaugcgcuggacaaccugguuaugcuccauaauuccgaacagggcgggcgggccuaucgccacgcuauggaggagcugccugauacaaucgaaacccuuaugcugcucgcccugauugcugugcugacgggaggcgugacacucuucuuucuuucuggcagagggcugggaaagaccagcaucggccugcucugugucauggccuccagcguucugcuuuggauggccucuguggagccccauuggauugcugcguccaucauccuggaguucuuucucauggugcugcugauuccggagccugaccggcagcgcacaccccaggauaaccaacucgccuacgucgugaucgggcuucuguucaugauucugacaguugcugccaaugagaugggacuccuggaaaccacaaagaaagaccuuggcaucgggcacguggccgucgagaaccaccaucacgcugccaugcuggauguggaccuccauccugcgagcgccuggacgcuguacgcugucgccaccacaauuaucacccccaugaugagacacacaauugaaaacaccacggcuaauaucucucugaccgccaucgcgaaccaggccgcuauucucaugggacuugauaagggcuggccuaucuccaaaauggacauuggcgugccccugcuggcccucgggugcuauagccagguuaauccgcugacacuuaccgcugccgugcugaugcucgucgcucauuacgccaucauuggaccuggccugcaagcgaaggccacacgggaggcucagaaacgcaccgccgcugggaucaugaagaaccccacgguggauggaaucguugccauugaccuggaucccguggucuaugacgccaaguuugaaaaacagcucggccagaucaugcuucugauucuguguacaucucaaauccuccugaugagaaccacaugggcgcuuugcgagagcauuacccuggcuaccgggccucucacaacgcugugggagggauccccgggcaaguucuggaauaccacaaucgccgugucuauggcuaacaucuuucggggcagcuaccuggccggggccggacucgcuuucucccuuaugaaaagccugggcgggggacgcagaggcaccggggcccagggagaaacacugggcgagaaguggaaacggcagcucaaucagcuguccaagucugaguucaacaccuauaagagaagcggcauuauggagguggaccgcuccgaagcgaaagaggggcuuaagcggggagagacgacaaaacacgccguuucuagaggcaccgcuaagcugcgcugguuugucgaacggaaucucgugaaacccgaggggaaggugaucgaucugggauguggcagagggggauggagcuacuauugcgccggccugaagaaagucaccgaaguuaagggcuacacaaaagggggaccuggccacgaggaacccauuccuauggcuaccuacggguggaaccucgugaaacuucauuccggaaaagacguguucuuuauucccccugagaagugugauacacugcugugcgacaucggcgagucuagcccgaaucccacgaucgaagaggggcgcacccuccggguccugaaaaugguggaaccuuggcuuagaggaaaccaauucuguauuaagauccugaaucccuauaugccuuccguuguggagacacucgagcagaugcagcgcaagcacggcggcaugcugguccggaacccccugagcagaaauucuacccaugaaauguacuggguguccugcgggacaggaaacaucguuagcgccgugaauaugaccucucgcaugcuccugaaccgguuuacgauggcgcacagaaaaccgaccuaugagcgcgaugucgaccuuggcgccgggacaagacacguggcuguggaaccugaggucgccaaccuggauauuaucggacagcggauugaaaauaucaagcaugagcacaaauccaccuggcauuacgacgaggauaaccccuauaagacaugggcuuaccacggcagcuaugaaguuaaacccucuggguccgccagcuccauggugaauggaguggucaagcuccugaccaagccuugggacgugauucccaugguuacacaaaucgcuaugaccgauacgacaccuuucggccagcagcgcguguuuaaagagaaggucgacaccagaaccccgaaagccaagcggggcacagcgcaaaucauggaagugacggccaaauggcuuuggggguuccugagcagaaacaagaagccccggauuuguacccgcgaggaauuuacaagaaaaguucggucuaaugcugccaucggagcuguguucgucgacgagaaccaguggaauagcgccaaggaggccguggaagaugagcgcuuuugggaccucguucauagagaacgggagcugcacaaacagggcaagugcgcgaccugcguguacaacaugauggggaaacgcgaaaagaagcugggagaguucggcaaagcuaagggguccagagccauuugguacauguggcucggcgcccgguuucuggaguucgaagcucuuggauucaugaaugaggaucacugguuuucucgcgaaaacagccuguccggcgucgagggggagggacuccauaaacugggcuauauccuuagagacauuucuaagaucccugggggaaauauguacgccgaugacacagcuggcugggauacccggaucacagaagacgaucugcagaacgaggcccgcauuaccgacaucauggaacccgagcacgcgcuccuggccaaaagcauuuucaagcugacguaucaaaauaaaguggucagagugcagcggccugcuaagaacgggaccguuauggaugugaucucccgcagagaccagcggggcucuggacaggucggcacauacgggcucaauaccuuuacaaacauggaagcccaacugauuagacagauggagagcgagggaaucuucucccccagcgaacuugagaccccgaaccuggcuaagcgcgugcucgauuggcuggaaaaauauggcguggagcggcuuaagagaauggccaucucuggggacgacuguguugugaaaccuauugaugaccgcuuugcgacggcccugacagcucucaaugauaugggaaagguccggaaagacaucccccagugggaaccuuccaagggcuggaacgauuggcagcaagugcccuucugcagccaucacuuucaccagcugauuaugaaggacgggagagagaucguugugccuugucgcaaucaggaugagcuggucggccgggccagagugucucagggagcuggcuggucccuccgcgaaaccgccugccuggggaaaagcuacgcucaaauguggcagcuuauguauuuccaucggagagaccugcgccucgccgcgaacgccauuuguuccgcuguccccguggauuggaucccgacaucucggaccacguggagcauucacgcccaucaccaguggaugaccacagaggacaugcuguccguuuggaauagaguguggaucgaagagaacccuuggauggaagauaagacccauaucagcucuuggggagacguccccuaccuuggcaaacgggaggaccaauggugcgggucccugauuggacucacagccagagcuaccugggccacaaauauccagguggcgauuaaccagguucgccggcugaucggcaaugagaacuaccuggauuauaugaccagcaugaagagauuuaaaaaugaaucugaccccgagggggcucucugguga

SEQ ID NO: 18928 - RNA, 9879 nt, Artificial Sequence
  derived and/or modified CDS sequence (opt5) from DENV-1__FJ461319__SS-prME
agcgugaccaugcugcugaugcugaugcccacagcccuugcuuuccaccugacgaccagaggcggggagccucauauggugguuuccaagcaggaacggggaaagucucuccuguuuaagaccagcgccggcgugaacaugugcacccuuaucgccauggaccugggggagcucugugaagauacaaugaccuacaaaugcccccgcauuacagaggcugaacccgacgauguggacuguuggugcaaugccaccgauacgugggucaccuauggaacauguucccaaaccggcgagcacagacgggacaagcgcucuguggcccuggcuccucauguugggcugggacucgagacaagaaccgaaacguggaugagcuccgagggcgccuggaaacagauccagcggguggaaacaugggcucugcgccaccccggcuucaccgucauugcccuuuuucuggcgcaugccaucgggacaucuauuacccagaagggaaucaucuucauucuccugaugcuugugaccccuagcauggcuaugagaugcguuggcaucgggucccgggauuuuguggagggacugagcggcgccacaugggucgacguggugcucgagcacgggucuugugucacgaccauggcuaaggauaaacccacacuggacauugaacugcucaagaccgagguuacaaacccugccauccugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggcugggcgugcuucugaccuggcucggacucaauucuagauccacaagccugucuaugaccuguauugccguuggccuugugacacucuaccugggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcucucugcggccaucggcaaggcuugggaggagggggugugcggcauuagaagcgccacgcgccuggaaaacguuauguggaaacagaucuccaacgagcuuaaucauauccugcucgaaaacgacaugaaguucacaguggucgugggagauguggcuggcauucuggcccaggggaaaaagaugauccggccgcaacccauggagcacaaauacucuuggaaaagcuggggaaaggccaagauuaucggcgcugacguccagaauaccaccuuuauuaucgaugggccuaacacacccgaauguccugacgaucagagagcguggaauaucugggagguugaggacuauggauucggcauuuuuaccacgaacaucuggcugaaacuucgcgauuccuacacacaggugugcgaccaccggcucaugagcgccgcuauuaaagauucuaaggccgugcaugccgacaugggcuauuggaucgaauccgagaaaaaugaaaccuggaagcuggcuagagccagcuucauugaggucaagacauguaucuggcccaaaucucacacccugugguccaacggggugcucgaaagcgagaugaucauuccgaagaucuacggaggcccuauuucucaacauaauuaucgccccggguacuucacacagaccgcgggaccuuggcaccugggcaaacuugagcuggauuuugaccucugcgaagggacgaccguuguggucgaugagcacugcggaaaccggggccccagccugagaacaaccacagugaccggcaagaucauucaugaaugguguugccgguccuguacgcugccuccccuucgcuucagaggggaggacggaugcugguacggcauggagauccggccgguuaaagaaaaggaggaaaaucucgucaagagcauggucucugcuggguccggagagguggacagcuuuucccugggccugcucuguaucucuauuaugaucgaagagguuaugagaagccgcuggucccggaaaaugcugaugacagggacccuugccguguuccugcuccugauuaugggacagcugacauggaacgaucuuaucagacugugcauuauggucggcgccaaugcuucugaccgcaugggcauggggaccaccuaucucgcccugauggcgacauuuaagaugagaccuauguucgcugugggacuccuguuucggcgccuuacgagcagagaggugcugcuccugaccaucggccugucccuugucgccucuguugaacugcccaacagccucgaggaacugggggauggacucgccaugggcauuaugauccugaaacuucugacagacuuccaaucccaccagcucugggcuacccugcugagccuuacauuuaucaagaccacguucucucugcauuacgccuggaaaacaauggcuauggugcucuccauugugagccuguuuccccucugucugucuaccaccucccagaagacaaccuggcuuccuguccugcuggggagccucggaugcaagccgcugacaauguuccuuaucgccgagaauaaaauuuggggccggcgcucuuggccccugaacgaaggcaucauggcgguggggauuguuuccauccuccugagcucccuccugaagaacgaugugccucuugccggaccccugaucgcuggcgggaugcugauugccuguuaugucaucagcggaucuagcgcugaccucucccuggagaaagccgccgaggugucuugggaagaggaagcugagcacagcggcgcgucccauaauauucuuguugaagugcaggaugacgggacgaugaagaucaaagaugaggagagagacgauacccugacaauucuccugaaggccacccuccuggcugucucuggaguguacccucuuagcauccccgccacacuguuugucugguauuucuggcagaagaagaagcagcgguccggcgugcugugggacaccccuucucccccggaaguugagcgcgccgugcucgaugacggcaucuacagaauuaugcagcgggggcugcuuggacgcagccaggucggcguggggguuuuccaagaaaacguguuucacacgauguggcacgucaccagaggagcugugcugauguaucagggcaaacggcucgagccuuccugggccagcgugaagaaagaccugaucucuuacgggggaggcuggagacuccagggcuccuggaauacaggggaggaaguucaggucauugcgguggagcccggaaagaacccuaaaaaugugcaaaccgcucccggcacauucaagaccccggaaggggaggucggagccaucgcccuggauuuuaagccuggcacaagcgggucucccauugugaaccgcgaaggaaaaaucguuggccuuuacggcaaugggguggucacgaccuccggaacauaugugagcgcuauugcccaggcgaaggcuucccaggagggcccucugcccgagaucgaagacgagguuuuccggaaaagaaaccugaccaucauggaucuccaucccgggucuggaaagacccgccgguaccugccugccauugugagagaagccaucaaacgcaaacuucggacacugauucucgcuccgacgagagucguggccagcgagauggcugaagcccugaagggcaugcccauccgcuaucaaaccacagcgguuaaauccgagcacaccgggaaggagauuguggaccugaugugccaugccacauuuaccaugcggcuccuuagcccugucagagugcccaauuacaacaugaucaucauggaugaagcucacuucacggacccuucuuccauugccgcucggggcuauaucagcacacgcgugggaaugggcgaggccgccgcuauuuuuaugaccgcgacacccccugggucugucgaagccuucccgcagagcaaugcuguuauccaggaugaggaaagagacauucccgagcgguccuggaacucuggauacgaguggaucacagauuuuccuggcaaaaccgugugguucgugcccagcaucaaguccgggaaugacauugccaacugucugcgcaaaaauggaaagagagucauccagcugucucggaagacauuugauaccgaauaucagaagacgaagaacaacgacugggacuacgugguuacaaccgauauuagcgagaugggcgccaauuucagagcugaccgcgugaucgauccucggagaugccucaaacccgucauucugaaggacgggccggaacgcgugauccuugccggcccuaugcccguuacaguggcguccgcugcccagcggagaggacgcauuggccggaaccauaauaaagagggggaucaguacaucuauaugggacagccccugaacaaugacgaggaucacgcccacuggaccgaagcuaagaugcuccuggacaacaucaauacgccugagggcauuauccccgcccuguucgaaccugagagagaaaagagcgcggccauugauggggaguaccgccucagaggagaggcucggaaaaccuuugucgaacuuaugcgcagaggcgaccugccgguguggcugucuuauaaggucgccuccgagggguuccaauacagcgaucggcgcuggugcuuugacggcgaaagaaacaaucaggugcucgaggaaaacauggauguugagaucuggacaaaagagggagaacggaagaaacugagaccccgcuggcuugacgcucggaccuauuccgacccucuggcccucagagaguucaaggaauuugcugccggccgccggucugugagcggggaucugauucuggagaucggaaaacucccccagcaucuuacacagagagcgcaaaaugcccuggacaaccuggugaugcuccacaauuccgaacagggcgggcgggcuuaccgccaugccauggaggagcugccugauaccaucgaaacacuuaugcugcucgcucugauugccguccugaccggaggcguuacgcuguucuuucuuucuggcagagggcugggaaagacaagcaucggccugcucugugugauggccuccagcgugcugcuuuggauggcuucugucgagccccacuggauugcggccuccaucauucuggaguucuuucucauggugcugcugaucccggagccugaccggcagcgcacaccccaagauaaccaacucgcuuauguugugaucgggcuucuguucaugauucugaccgucgccgccaaugagaugggacuccuggaaaccaccaagaaagaccuuggcaucgggcacgcugccgugggaaaccaucaccaugcggccaugcuggaugucgaccuccacccugcuagcgccuggacacuguacgcuguggccacgaccauuaucacacccaugaugagacauaccauugagaacacaaccgcgaauaucucucugacggccauugcuaaccaggccgcuauccucaugggccuugauaagggcuggccuaucuccaaaauggacauugggguuccccugcuggcccucggaugcuacagccaggugaauccgcugacccuuacagcugccguccugaugcucguggcgcacuaugccaucauuggcccugggcugcaagcuaaggccacccgggaagcucagaaacgcacagccgccggaaucaugaagaaccccaccguugauggcauuguggcgaucgaccuggaucccgucguguacgacgcuaaguuugagaaacagcucgggcagaucaugcuucugauucuguguacgucucaaauccuccugaugagaacaaccugggcccuuugcgaaagcauuacacuggcugccggaccucucaccacccugugggagggcuccccgggcaaguucuggaauacaacgaucgccgugucuauggcuaacauuuuucgggggagcuaucuggccggagcgggccucgccuucucccuuaugaaaagccucgggggaggccgcagagggaccggagcucagggcgagacacugggcgaaaaguggaaacggcagcucaaucagcuguccaagucugaguucaacaccuacaagagaagcgggaucauggaaguugaccgcuccgaggccaaagaaggacuuaagcggggcgagacaaccaaacacgcugucucuagagggacggccaagcugcgcugguuuguggagcggaaucucgugaaacccgaaggaaaggucaucgaucugggcugugggagaggaggcuggagcuauuacugcgcgggccugaagaaaguuacagaggugaagggguauaccaaaggaggcccugggcaugaagaacccauuccuauggccaccuacggauggaaccucgugaaacuucacuccggcaaagacgucuucuuuauucccccugaaaagugugauacacugcugugcgacaucggggagucuagcccgaaucccaccaucgaggaaggacgcacacuccgggugcugaaaaugguugagccuuggcuuagaggcaaccaauucuguauuaagauccugaaucccuacaugccuuccguggucgaaacgcucgagcagaugcagcgcaagcauggcgggaugcuggugcggaacccccugagcagaaauucuacccacgagauguauuggguuuccugcggaacaggcaacauugugagcgcugucaauaugaccucucgcaugcuccugaaccgguuuacaauggcccacagaaaaccgaccuacgaacgcgauguggaccuuggggcuggaacgagacauguggccgucgagccugaaguugcuaaccuggauaucaucggccagcggauugagaauaucaagcacgaacauaaauccaccuggcacuaugacgaggauaaccccuacaagacaugggccuaucaugggagcuacgaggugaaacccucuggauccgcgagcuccauggugaauggcgucgugaagcuccugaccaagccuugggacguuauucccauggugacacaaaucgccaugaccgauacaaccccuuucggccagcagcgcgucuuuaaagaaaagguggacacgagaacaccgaaagcuaagcgggggaccgcccaaauuauggagguuaccgcuaaauggcuuuggggauuccugagcagaaacaagaagccccggaucuguacacgcgaagaguuuacgagaaaagugcggucuaaugccgccaucggcgcggucuucguggacgaaaaccaguggaauagcgcuaaggaggccguugaggaugaacgcuuuugggaccucgugcacagagagcgggaacugcacaaacaggggaagugcgcgaccugcgucuauaacaugaugggaaaacgcgagaagaagcugggcgaguucgggaaagcuaagggcuccagagccauuugguacauguggcucggagcucgguuucuggaguucgaggcccuuggcuucaugaaugaagaucauugguuuucucgcgagaacagccuguccgggguggaaggagagggccuccacaaacugggguacauccuuagagacauuucuaagaucccuggaggcaauauguaugcggaugacacagccgggugggauacccggauuacagaggacgaucugcagaacgaagcucgcaucaccgacaucauggagcccgaacaugcccuccuggcuaaaagcauuuucaagcugacauaccaaaauaaagucgugagaguucagcggccugccaagaacggcaccgugauggaugucaucucccgcagagaccagcggggaucuggccagguggggacguauggacucaauaccuuuacaaacauggaggcgcaacugauuagacagauggaaagcgagggcaucuucucccccagcgagcuugaaaccccgaaccuggccgagcgcgugcucgauuggcuggaaaaguacgggguugagcggcuuaaaagaauggcuauuucuggagacgacuguguggucaagccuaucgaugaccgcuuugccacagcucugaccgcccucaaugauaugggcaaagugcggaaggacaucccccagugggaaccuuccaaaggguggaacgauuggcagcaaguucccuucugcagccaccacuuucaucagcugauuaugaaggacggcagagagaucguggucccuugucgcaaucaggaugagcuggugggacgggcuagagucucucagggcgccggguggucccuccgcgaaacggcgugccugggaaagagcuaugcccaaauguggcagcuuauguacuuccaccggagagaccugcgccucgcugccaacgccauuuguuccgcugugcccguugauuggaucccgacaucucggaccacauggagcauucaugcccaccaucaguggaugaccacggaggacaugcuguccguguggaauagagucuggaucgaagagaacccuuggauggaagauaaaacccacauuagcucuuggggcgacgugcccuaucuugggaagcgggaggaccaauggugcggaucccugaucggccucacagcgagagcuaccugggccacaaauguucagguggccaucaaccagguccgccggcugauugggaaugagaacuaccuggauuacaugaccagcaugaaaagauuuaagaaugaaucugaccccgagggcgcucucugguga

SEQ ID NO: 18929 - RNA, 9879 nt, Artificial Sequence
  derived and/or modified CDS sequence (opt5) from DENV-1__FJ461320__SS-prME
agcgugaccaugcugcucaugcugaugcccaccgcccuugcuuuccaccugacgacccggggcggggaaccucauaugaucgugacaaagcaggaacggggaaaaucccuccuguuuaagaccucugccggcguuaacaugugcacacuuauugcgauggaccugggggaacucugugaagauaccaugacauacaaaugcccccgcaucaccgaagcugaacccgacgauguggacuguuggugcaaugccacggauaccugggugacauauggaaccuguagccaaacaggcgagcaccggcgggacaagcgcuccguggcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacguccagaauaccaccuuuaucaucgaugggccuaacacacccgaauguccugacgaucagagagcuuggaauauuugggagguugaggacuauggauucggcaucuuuaccacgaacauuuggcugaagcugcgcgauuccuacacacaggugugcgaccaccggcuuaugagcgcggccaucaaagauucuaaggcugugcaugccgacaugggcuauuggauugaauccgagaaaaaugaaaccuggaagcucgccagagcuagcuucaucgaggucaagacauguaucuggcccaaaucucacacccugugguccaacggggugcuggaaagcgagaugauuaucccgaagauuuacggaggcccuaucucucaacauaauuaucgccccggguacuucacacagaccgccggaccuuggcaccucggcaaacuggagcuugauuuugaccugugcgaagggacgaccguuguggucgaugagcacugcggaaaccggggccccagccucagaacaaccacagugaccggcaagauuauccaugaaugguguugccgguccuguacgcugccuccccugcgcuucaaaggggaggacggaugcugguacggcauggagaucagaccgguuaaggaaaaggaggaaaaucuugugaaaagcauggucucugcgggguccggagagguggacagcuuuucccucggccugcuguguauuucuaucaugguugaagaggugaugcggagcagauggucccgcaagaugcucaugacagggacccuggcugucuuccuucugcucauuaugggacagcugacauggaacgaucugauccggcuuugcauuauggugggcgccaaugccucugacagaaugggcauggggaccaccuaucuggcucucauggccacauuuaaaauccgcccuauguucgcggugggacugcucuuuagacggcugacgagccgcgagguccuucugcucaccauuggccugucccugguugcuucuguggaacuucccaacagccuggaggaacucggggauggacuggccaugggcaucaugauccucaagcugcuuacagacuuccaaucccaccagcugugggccacccuccugagccugacauuuauuaaaaccacgcuuucucugcauuacgcuuggaagacaauggccauggugcucuccaucgucagccuguucccccucugucugucuaccaccucccagaagacaaccuggcuuccugugcugcuggggagccucggaugcaaaccgcugacaauguuucuuauuacggagaauaagaucuggggcagaaaaucuuggccccugaacgaaggcauuauggcuguugggguggucuccauccuccugagcucccuccugaagaacgaugugccucuugccggaccccugaucgcgggcgggaugcugauugccuguuauguuaucagcggaucuagcgcugaccucucccuggagaaagccgcugaggugucuugggaagaggaagccgagcacagcggcgccucccauaauauucuugucgaagugcaggaugacgggaccaugaagaucaaagaugaggagcgggacgauacacugaccauucuccugaaggcuacacuccuggcggucucuggaguguacccucuuagcauccccgccacccuguucguuugguauuuuuggcaaaagaaaaagcagcgcuccggcgugcugugggacacgccuucucccccggaagucgagagagcugugcucgaugacggcaucuaccggauuaugcagcgcgggcugcuuggaagaagccagguuggcgugggggucuuccaagaaaacguguuccacaccauguggcacgugacacggggagccguucugauguaucagggcaaacgccucgagccuuccugggccagcgucaagaaagaccugaucucuuacgggggaggcuggagacuccagggcuccuggaauaccggggaggaaguccaggugauugcugucgagcccggaaagaacccuaagaaugugcaaacagcccccggcaccuuuaaaacaccggaaggggagguuggagcgaucgcucuggauuucaagccuggcacgagcgggucucccauugugaaccgggaaggaaaaaucgucggccuuuacggcaauggggugguuaccacauccggaaccuaugugagcgccauugcccaggcuaaggccucccaggagggcccucugcccgagaucgaagacgaggucuuuagaaaacgcaaccugaccaucauggaucuccaucccgggucuggaaagacacggagauaccugccugcgauugugcgcgaagcuaucaagcggaaacuuagaacgcugauucucgccccgacccgcguuguggccagcgagauggcugaagcccugaagggcaugcccauccgguaucaaacaaccgcugucaaauccgagcacacagggaaggagauuguggaccugaugugccaugccaccuucacgaugagacuccuuagcccugugcgcguccccaauuacaacaugaucaucauggaugaagcgcacuuuacagacccuucuuccauugccgcucggggcuauaucagcaccagaguuggaaugggcgaggccgcugccauuuucaugaccgccacacccccugggucuguggaggcuuuuccgcagagcaaugcggugauccaggaugaggaacgggacauucccgagcgcuccuggaacucuggauacgaguggaucaccgauuucccuggcaaaacagucugguuugugcccagcaucaaguccgggaaugacauugccaacugucugagaaagaauggaaaacggguuauccagcugucucgcaagaccuucgauacggaauaucagaagaccaagaacaacgacugggacuacguggucaccacagauauuagcgagaugggcgcuaauuuuagagccgaccgggugaucgauccuagacgcugccucaaacccguuauucugaaggacgggccggaacgggugauccuugccggcccuaugcccgucaccguggcuuccgccgcgcagagacgcggacggauuggcagaaaccauaauaaggagggggaucaguacaucuauaugggacagccccugaacaaugacgaggaucacgcucacuggacggaagccaaaaugcuccuggacaacaucaauaccccugagggcauuauccccgcccuguucgaaccugagcgcgaaaagagcgcugccauugauggggaguaccggcucagaggagaggcgcgcaaaacauucgucgaacuuaugagacggggcgaccugccgguguggcugucuuauaagguugccuccgagggguuucaauacagcgaucgcagauggugcuucgacggcgaacggaacaaucaggugcucgaggaaaacauggauguggagaucuggaccaaagagggagaacgcaagaaacugagaccccgguggcuugacgcuagaacauauuccgacccucuggcccuccgcgaguuuaaggaguucgcugccggccggagaucugucagcggggaucugauucuggagaucggaaagcucccccagcaucuuacccagcgcgcucaaaaugcccuggacaaccugguuaugcuccacaauuccgaacagggcgggcgggcguacagacaugccauggaggagcugccugauacaaucgaaacccuuaugcugcucgcucugauugccgugcugacgggaggcgugacacucuuuuuccuuucuggccgggggcugggaaaaaccagcaucggccugcucugugucauggcuuccagcgugcugcuuuggauggccucuguugagccccacuggauugccgcuuccaucauucuggaauuuuuccucauggugcugcugaucccggagccugaccgccagagaacaccccaggauaaccaacucgcguaugucgugaucgggcuucuguuuaugauucugacagucgccgcuaaugagaugggacuccuggaaaccacaaagaaagaccuuggcaucgggcacguggccguugagaaccaucaccaugccacgaugcuggauguggaccuccacccugcuagcgccuggacccuguacgcggucgccacaaccauuaucacacccaugaugcggcauaccauugaaaacacgaccgcuaauaucucucugacagccauugcuaaccaggccgcgauccucaugggacuugauaagggcuggccuaucuccaaaauggacauuggcgugccccugcuggcccucgggugcuacagccagguuaauccgcugacccuuacagcugccgugcugaugcucgucgcucacuaugccaucauuggaccuggccugcaagcuaaggccacccgcgaggcgcagaagagaacggccgcugggaucaugaaaaaccccacaguggauggaauuguggccaucgaccuggaucccguugucuacgacgcuaaguucgaaaaacagcucggccagaucaugcuucugauucuguguaccucucaaauccuccugaugcggacaaccugggcccuuugcgagagcauuacccuggccacagggccucucacgacccugugggagggauccccgggcaaguuuuggaauacaaccaucgcggugucuauggcuaacauuuuccgcggcagcuaucuggccggggcuggacucgccuuuucccuuaugaaaagccugggcgggggaagacggggcacaggggcccagggagaaacccugggcgagaaguggaagcgccagcucaaucagcuguccaaaucugaguucaacaucuacaagagaagcggcaucauggagguggaccgguccgaagcuaaagaggggcuuaagagaggagagacgacacgccacgccgucucucggggcaccgcgaaacugagaugguucguugaacgcaaucucgugaagcccgaggggaaggugauugaucugggauguggcagagggggauggagcuauuacugcgccggccugaaaaaggucaccgaagugaaaggcuauacaaaagggggaccuggccaugaggaacccaucccuauggcuaccuacggguggaaccucguuaaacuucacuccggaaaggacguguuuuucacacccccugagaaaugugauacgcugcugugcgacauuggcgagucuagcccgaaucccaccaucgaagaggggagaacacuccgcguccugaagaugguggaaccuuggcuucggggaaaccaauuuuguauuaagauccugaaucccuacaugccuuccguuguggagacccucgagcagaugcagagaaaacauggcggcaugcugguccgcaacccccugagcagaaauucuacacacgaaauguauuggguguccugcgggaccggaaacauugugagcgccgucaauaugacgucuagaaugcuccugaaccgcuucaccauggcucaccggaagccgacauacgagagagauguugaccuuggcgccgggacccgccauguggcgguggaaccugaggucgccaaccuggauaucaucggacagagaauugaaaauaucaaacacgagcauaaguccacauggcacuaugacgaggauaaccccuacaaaaccugggcuuaucauggcagcuacgaagugaagcccucuggguccgccagcuccaugguuaauggaguggucaagcuccugacaaaaccuugggacgugauucccaugguuacccaaaucgcuaugacggauacaaccccuuuuggccagcagcggguguucaaggagaaagucgacacccgcacaccgaaggccaaaagaggcacggcucaaauuauggaagugaccgcccgguggcuuuggggguuucugagcagaaacaagaagccccggaucuguacacgcgaggaguucaccagaaaaguucggucuaaugcggccaucggagcuguguuugucgacgagaaccaguggaauagcgccaaggaggcuguggaagaugagcgcuucugggaccucguccagaaagaaagagagcugcacaagcagggcaaaugcgccacaugcguguauaacaugauggggaagcgggaaaagaaacugggagaguuuggcaaggccaaagggucccgcgcgauuugguacauguggcucggcgcuagauuccuggaguuugaagcccuuggauucaugaaugaggaucacugguucucucgggaaaacagccuguccggcguugagggggagggacuccauaagcugggcuacauccuucgcgacauuucuaaaaucccugggggaaauauguaugccgaugacaccgcuggcugggauacaagaauuaccgaagacgaucugcaaaacgaggccaagaucacggacaucauggaacccgagcacgcucuccuggccaccagcauuuuuaaacugacauaccagaauaaggugguccgggugcagcgcccugcgaagaacgggaccgugauggauguuaucuccagacgggaccagcgcggcucuggacaagugggcacauaugggcucaauaccuucacgaacauggaagcccagcugauuagacagauggagagcgagggaaucuuucuucccuccgaacuggagacaccgaaccucgcugaacggguccuggauuggcuugagaaauacggcguggaaagacugaagcgcauggccauuagcggggacgacuguguugugaaaccuaucgaugaccgguucgcuaccgcccucacagcgcugaaugauaugggaaaggucagaaaagacaucccccagugggagccuucuaagggcuggaacgauuggcaacaggugcccuuuugcucccaucacuuccaccagcugauuaugaaggacgggcgcgagaucgucgugccuugucggaaucaggaugaacucguuggcagagcccgcgugagccaaggagcuggcuggucucugcgggagaccgccugccuugggaaauccuaugcucagauguggcagcugauguacuuucauagacgcgaccuccggcuggccgcuaacgccauuuguagcgcgguccccguggauuggguuccgacguccagaaccacauggucuauccacgcccaucaccaauggaugaccacagaagacaugcuuagcguguggaaucgcgucuggauugaggaaaacccuuggauggaggauaagacccauguguccagcuggggagacgugcccuaucugggcaaacgggaggaccaguggugcgggucucucaucggacugacagcuagagccaccugggccuccaauauucagguugcuaucaaccagguccggagacugaucggcaaugaaaacuaccucgauuacaugacgagcaugaagcgcuucaaaaaugagggggaccccgaaggcgcccugugguga

SEQ ID NO: 18930 - RNA, 9879 nt, Artificial Sequence
  derived and/or modified CDS sequence (opt5) from DENV-1__FJ410225__SS-prME
agcgugaccaugcugcucaugcugaugcccaccgcucuugcuuuccaccugacgaccagaggaggggaaccucauaugaucgucuccaagcaggaacggggaaaaucucuccuguuuaagaccagcgccggcguuaacaugugcacccuuauugcgauggaccugggggaacucugugaagauaccaugaccuacaaaugcccccgcaucacagaaaccgaacccgacgauguggacuguuggugcaaugcuacggauaccugggugacauauggaaccuguucccaaacaggcgagcacagacgggacaagcgcucuguugcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcauuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauuccuauacccaggucugcgaccaccggcuuaugagcgcggccaucaaagauucuaaggcuguucacgccgacaugggcuacuggaucgaauccgagaaaaaugaaacauggaagcucgccagagcuagcuucauugaggugaagaccuguaucuggcccaaaucucauacacugugguccaacggggugcuggaaagcgagaugauuaucccgaagauuuauggaggcccuaucucucaacacaauuaccgccccggguacuucacccaggccgcgggaccuuggcaucucggcaaacuggagcuugauuuugaccugugcgaagggacgaccgucgugguugaugagcacugcggaaaccggggccccagccucagaacaaccacagugaccggcaagaucauucacgaaugguguugccgguccuguacgcugccuccccugcgcuucagaggggaggacggaugcugguauggcauggagauccggccggucaaagaaaaggaggaaaaucuugugaaaagcaugguuucugcuggguccggagagguggacagcuuuucccucggccugcuguguauuucuaucaugauugaagaggucaugagaagccgcuggucccggagaaugcucaugacagggacccuggccguguucuuucuucugaucaugggacagcucacauggaacgaucugauucgccugugcaucaugguuggcgccaaugcuucugacagaaugggcauggggaccaccuaccuugcccugauggcgacauucaaaaugcggccuauguuugcugugggacuccuguuccgcagacucacgagccgggagguccugcuucugaccaucggccucucccugguggccucuguggaacugcccaacagccuugaggaacugggggauggacucgccaugggcauuaugauccugaagcuccugacagacuuucaaucccaucagcuuugggcuacccugcucagccugacauucauuaaaaccacguuuucucugcacuaugccuggaagacaauggcuaugguccuuuccaucguuagccuguucccccucugucugucuaccaccucccagaaaacaaccuggcucccugugcugcuugggagccugggaugcaagccgcugacaauguuucucauugccgagaauaagaucuggggccgcagaucuuggccccugaacgaaggcaucauggcgguggggauugucuccauccuucugagcucccuccugaaaaacgaugugccucucgccggaccccugauugcuggcgggaugcuuaucgccuguuacguuauuagcggaucuagcgcugaccugucccuggagaaggccgccgagaucucuugggaagaggaagcugagcauagcggcgcgucccacaauauccucguggaaguccaggaugacgggacgaugaaaauuaaggaugaggagcgggacgauacccugacaauccuucugaaagccacccuccuggcugugucuggaguuuauccucucagcauucccgccacacuguucgugugguacuucuggcaaaagaaaaagcagcgcuccggcguccuuugggacaccccuucucccccggaaguggagagagccguccuggaugacggcaucuaucggauuaugcagcgcgggcugcucggaagaagccaggugggcguugggguguuucaagaaaacgucuuccauacgauguggcacgugacccggggagcuguucugauguaccagggcaagagacuugagccuuccugggccagcgugaaaaaggaccugaucucuuacgggggaggcuggcgccuccagggcuccuggaauacaggggaggaaguccaggugauugcgguggagcccggcaagaacccuaagaauguucaaaccgcucccggcacauuuaaaaccccggaaggggaggucggagccaucgcccuggauuucaagccuggcacaagcgggucucccaucgugaaccgggaaggaaagauugugggccucuauggcaauggggucgugacgaccuccggaacauacguuagcgcuaucgcccaggcgaaggcuucccaggagggcccucugcccgagauugaagacgagguguuuagaaagcgcaaccuuaccaucauggaucugcaccccgggucuggaaaaacccggagauaucugccugccauuguccgcgaagccaucaagcggaaacucagaacacugauccuugcuccgacgcgcgugguugccagcgagauggcugaagcccugaagggcaugcccauucgguaccaaaccacagcggugaaguccgagcauaccgggaaagagaucgucgaccucaugugccacgccacauucaccaugagacugcugagcccugcucgggugcccaauuauaacaugauuaucauggaugaagcccauuuuacggacccuucuuccauugcugcccgcggcuacaucagcacaagaguuggaaugggcgaggccgcugcgaucuucaugaccgccacacccccugggucuguggaggcuuuuccgcagagcaaugccgucauucaggaugaggaacgggacauccccgagcgcuccuggaacucuggauaugaguggauuacagauuucccuggcaagaccgugugguuugugcccagcaucaaauccgggaaugacauugccaacugucucagaaagaauggaaaacgggucauccagcuuucuagaaagacauucgauaccgaauaccaaaagacgaaaaacaacgacugggacuacguugugacaaccgauauuagcgagaugggcgcuaauuuccgcgccgaccgggugaucgauccuagacgcugccugaagcccgucauccugaaagacgggccggaacgggugauucucgcgggcccuaugcccguuacaguggcuuccgccgcccagagacgcggacggaucggcagaaaccacaauaaggagggggaucaguauauuuacaugggacagccccugaacaaugacgaggaucaugcucacuggaccgaagccaaaaugcuucuggacaacaucaauacgccugagggcauuauccccgcgcucuuugaaccugagcgcgaaaagagcgccgcuaucgauggggaguauagacugcggggagaggcccgcaagaccuucgucgaacugaugagacggggcgaccucccgguguggcuuucuuacaaaguugcuuccgagggguuucaauauagcgaucgcagauggugcuucgacggcgaacggaacaaucaggugcuggaggaaaacauggaugucgagauuuggacaaaggagggagaacgcaagaagcugcgcccccgguggcucgacgccagaaccuacuccgacccucuggcucuuagagaguuuaaagaguucgccgcgggccggagaucugugagcggggaucugauccucgagauuggaaagcugccccagcaccugacacagcgggcccaaaaugcucucgacaaccuugucaugcugcauaauuccgaacagggcgggcgcgccuauagacacgcuauggaggagcugccugauaccaucgaaacacucaugcugcuugcccugauugccgugcucaccggaggcguuacgcuguuuuuccugucuggccgggggcucggaaaaacaagcaucggccuucugugugugauggcuuccagcgugcugcucuggauggcgucugucgagccccauuggaucgccgcuuccauuauccuggaauuuuuccuuaugguucugcucauuccggagccugaccgccagagaacaccccaggauaaccaacuggccuacguggugaucgggcugcucuuuaugauucuuaccgucgccgcuaaugagaugggacugcuggaaacaaccaagaaggaccucggcaucgggcacguggccguugagaaccaccaucacgcggccaugcuggauguggaccuucauccugcuagcgccuggacacuguacgcugucgccacgaccauuaucacacccaugaugcggcacaccaucgaaaacacaaccgcgaauauuucucucacggccaucgcuaaccaggccgcuauucugaugggacuggauaaaggcuggccuaucuccaagauggacauuggcgugccccuccuugcccuggggugcuauagccaggucaauccgcugacccucacagcugccgugcugaugcuuguugcgcauuacgccaucaucggaccuggccugcaagcuaaagccacccgcgaggcucagaagagaacagccgccgggauuaugaaaaaccccaccguggauggaaucgucgcgauugaccucgaucccgugguuuaugacgcuaaguucgaaaagcagcugggccagaucaugcugcucauucuuuguacgucucaaauccugcugaugcggacaaccugggcccucugcgagagcaucacacuggcuaccgggccucuuaccacacugugggagggauccccgggcaaauuuuggaauacgaccauugccgugucuauggccaacaucuuccgcggcagcuaccucgcuggggccggacuggcguucucccugaugaaaagccucggcgggggaagacggggcacaggggcccagggagaaacccuuggcgagaaauggaagagacagcugaaucagcuguccaaaucugaauuuaacacauauaagcgcagcggcauuauggaggucgaccgguccgaagcuaaggaggggcucaaaagaggagagaccacgaagcacgccgugucucgcggcacagcuaaacugcggugguucguggaaagaaaucuuguuaagcccgaggggaaagucaucgaucugggauguggccgcgggggauggagcuacuauugcgccggccucaagaaggugaccgaagugaaaggcuacaccaaaggcgggccugggcacgaggaacccauuccuauggcgacauacggguggaaccuggucaaacugcauuccggaaaggacgucuuuuucauucccccugagaaaugugauacccuccuuugcgacauuggcgagucuagcccgaaucccacaaucgaagaggggcggacgcugagagugcugaagaugguggaaccuuggcuccgcggaaaccaauuuuguaucaaaauucugaaucccuauaugccuuccgucguggagacccuugagcagaugcagcggaagcacggcggcaugcugguuagaaacccccucagccgcaauucuacacaugaaauguacuggguguccugcgggaccggaaacaucgucagcgccgugaauaugacaucucggaugcugcugaacagauucaccauggcucaccgcaagccgacguaugagagagauguugaccucggcgccgggacccggcacguggcugucgaaccugagguggccaaccuggauauuaucggacagcgcauugaaaauaucaaacaugagcacaaguccacauggcauuacgacgaggauaaccccuauaaaaccugggcuuaccacggcagcuaugaagugaagcccucuggguccgccagcuccauggucaauggaguugugaaacuucugacaaagccuugggacgugauccccauggucacccaaauugcgaugacagauaccacgccuuuuggccagcagagaguguucaaggagaaaguugacacacggaccccgaaggccaaaagaggcaccgcucaaaucauggaagugacagccaaguggcucuggggguuucugagccggaacaaaaagccccgcauuuguacgagagaggaguucacccggaagguccgcucuaaugcugccaucggagccguguuuguugacgagaaccaguggaauagcgcgaaagaggcuguggaagaugagagauucugggaccuuguccaucgggaacgcgagcugcacaagcagggcaaaugcgccacaugcguguacaacaugauggggaagagagagaaaaagcucggagaguuuggcaaggccaaagggucccgggcuauuugguacauguggcugggcgcccgcuuccuggaguucgaagcucucggauuuaugaaugaggaucacugguucucuagagaaaacagccuguccggcguugagggggagggacuucauaagcugggcuauauccuccgggacaucucuaaaauuccugggggaaauauguacgccgaugacaccgcgggcugggauacacgcaucaccgaagacgaucugcagaacgaggccagaauuacagacaucauggaacccgagcacgcccuucuggccaagagcauuuuuaaacucaccuaucaaaauaaggugguccgggugcagcgcccugcuaaaaacgggacggucauggaugugaucuccagacgggaccagagaggcucuggacagguuggcaccuacgggcugaauacauucaccaacauggaagcccaacugauccgccagauggagagcgagggaaucuuuucccccagcgaacucgagacaccgaaccuggcggaacgggugcuugauuggcuggagaaguauggcgucgaaagacucaagcgcauggccaucucuggggacgacuguguggugaaaccuauugaugaccgguucgcuaccgcccugacggcucuuaaugauaugggaaagguuagaaaagacaucccccagugggagccuuccaagggcuggaacgauuggcagcaagugcccuuuugcagccaucacuuccaccagcugauuaugaaagacgggcgcgagaucgucgugccuugucggaaucaggaugaacucguuggcagagcccgcgugucucagggagcuggcuggucccugcgggagacagccugccugggaaagagcuacgcgcaaauguggcagcucauguauuuucauagacgcgaccugcggcuugccgcuaacgccauuuguuccgccguccccguggauuggaucccgaccucuagaacaaccuggagcauccacgcucaucaccaguggaugacgaccgaagacaugcuguccgucuggaaucggguguggauugaggaaaacccuuggauggaggauaagacacauaucagcucuuggggagacguucccuaccucggcaaaagagaggaccaauggugcgggucccugauuggacuuaccgcccgcgcgacaugggcuaccaauauccagguggccauuaaccagguccggagacugaucggcaaugaaaacuaccucgauuauaugacaagcaugaagcgcuucaaaaaugagucugaccccgaaggggcccugugguga

SEQ ID NO: 18931 - RNA, 9879 nt, Artificial Sequence
  derived and/or modified CDS sequence (opt5) from DENV-1__FJ410226__SS-prME
agcgugaccaugcugcugaugcugaugcccacggcccuugcuuuccaccugacgaccagaggcggggagccucauaugaucgucuccaagcaggaacggggaaagucucuccuguuuaagacaagcgccggcguuaauaugugcacccuuauugcgauggaccugggggaguucugugaagauacaaugaccuacaagugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagauaagccugugaacaucgaggccgaaccgcccuucggcgagucuuauauugugaucggggccggagagaaagcucugaaacuuagcugguuuaagaaaggcuccucuauugggaagauguucgaagccaccgcuagaggcgcccgccggauggcgauccucggagacacagccugggauuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugacagcggaugcguugugaacuggaaaggccgcgagcucaaguguggguccggaauuuuugucacaaaugaagugcacaccuggacagagcaauauaaguuccaggccgacucuccuaaacggcugagcgcggccaucggcaaggcuugggaagaggggguuugcggcauuagauccgccacccgccuggagaacaucauguggaaacagaucucuaacgaacucaaucauauucugcuugagaacgauaugaaguuuacgguggucgugggagacguggcuggcauccuggcccaggggaaaaagaugauucggccgcaacccauggaauacaaauauagcuggaaguccuggggaaaggccaaaaucauuggcgcugauguccagaauacaaccuucaucaucgacgggccuaacacccccgaguguccugaugaccagagagcguggaauauuugggaaguugaggauuacggauuuggcaucuucacaaccaacauuuggcucaagcugcgcgacagcuauacacaggugugcgaucaccggcugaugucugccgcuaucaaagacuccaaggccgugcacgccgauaugggcuacuggauugagagcgagaagaaugagacauggaaacuugcuagagccucuuucaucgaagucaagaccuguaucuggcccaaaucccauacacucuggagcaacggggugcuggagucugaaaugauuaucccgaagauuuauggaggcccuaucagccaacacaauuaccgccccggguacuuuacccagacagcgggaccuuggcaucugggcaaacucgagcuggacuucgaucuuugcgaggggaccacgguuguggucgacgaacacugcggaaaccggggccccucccugagaaccacaaccgugacaggcaagauuauccacgagugguguugccggagcuguacccucccuccccugcgcuuuaaaggggaagacggaugcugguauggcauggagaucagaccgguuaaggagaaggaagagaaucuggugaaaucuauggucuccgcugggagcggagaaguggauuccuucucucuuggccuccuguguauuagcaucaugauugaggaaguuaugcgguccagauggucucgcaagaugcugaugacggggacacucgccguguuuuuccugcuuaucaugggacagcugaccuggaacgaccucauucggcugugcaucauggucggcgccaaugcuagcgauagaaugggcauggggacaaccuaccuggcccuuauggcgaccuuuaaaaugcgcccuauguucgcugugggacugcucuuuagacggcugacaucccgcgaggugcuccugcuuacgauuggccugucucucgucgccagcguugagcugcccaacucccuggaagaacuuggggacggacuggccaugggcaucaugauccucaagcugcucaccgauuuccaaagccaucagcugugggcuacacuucugucucucaccuuuauuaaaacaaccuucucccugcacuaugccuggaagacgauggcuauggugcugagcaucgugucucuuuuuccccuguguauguccacaaccagccagaagaccacauggcucccuguccugcucgggucucugggaugcaaaccgcuuaccauguuccugauugccgaaaauaagaucuggggcagaaaauccuggccccugaacgagggcauuauggcgguggggaucguuagcauccuccuguccagccuucugaagaacgacgugccucucgccggaccccugauugcuggcgggaugcucaucgccuguuacgucauuucuggaagcuccgcugaucugucucuugaaaaagccgccgaggugagcugggaggaagaggcugaacauuccggcgcgucucacaauauccugguugaggugcaggacgaugggacaaugaagauuaaagacgaagaacgggaugacacgcugaccauccuccugaaggccacacuucuggcugucagcggaguguauccucucuccauccccgccacccuguucgucugguacuuuuggcaaaagaaaaagcagcgcucuggcgugcucugggauacaccuuccccucccgagguugaaagagccgugcuggacgacggcauuuaucggaucaugcagcgcgggcuucugggaagaucccaggucggcguggggguuuuccaagagaacguguuucauaccauguggcacgucacgcggggagcugugcugauguaccagggcaaacgccucgaacccagcugggccucugugaagaaagaucugauuuccuacgggggaggcuggagacuucagggcagcuggaauaccggggaggagguucaggucaucgcgguggaacccggaaagaacccuaagaaugugcaaacagcucccggcaccuucaaaacaucugagggggaagucggagccauugcccuggacuuuaagccgggcaccuccgggagcccuaucgugaaccgggagggaaaaauuguuggccucuauggcaaugggguggucacaacguccggaaccuacgugucugcuaucgcccaggcgaaggcuagccaggaaggcccccugccugagaucgaggaugaaguuuucagaaaacgcaaccucacaauuauggaccugcaccccggguccggaaagacccggagauaucuucccgccaucgugcgcgaggccauuaagcggaaacugagaacccugauccucgcuccuacacgcgucguggccagcgaaauggcugaggcccugaagggcaugccgauucgguaccaaacgaccgcgguuaaaucugaacauacagggaaggagaucguggaucuuaugugccacgccaccuuuacaaugagacugcucucccccguccgcgugccuaauuauaacaugaucauuauggacgaggcucauuucaccgaucccagcucuaucgccgcucggggcuacauuagcacgagagugggaaugggcgaagccgccgcuaucuuuaugacagcgaccccucccggguccgucgaggccuucccucagucuaaugcuguuauucaggacgaggaacgggauaucccggaacgcagcuggaacuccggauaugaguggaucaccgacuuucccggcaaaacagugugguucgugccuucuauuaagagcgggaaugauaucgccaacugucugagaaagaauggaaaacgggucauucagcugucccgcaagaccuucgacacagaguaccagaagaccaagaacaacgacugggauuacgugguuacgacagacaucagcgaaaugggcgccaauuuuagagcugaucgggugauugaccccagacgcugccucaaaccugucauccuuaaggaugggcccgagcgggugauucuggccggcccgaugccuguuaccguggcgucugcugcccagagacgcggacggaucggcagaaaccacaauaaggaaggggaccaguaugucuacaugggacagccccugaacaaugaugaggaccaugcccacuggacagaggcuaaaaugcuccuggauaacaucaauacccccgaaggcauuaucccugcccuuuucgagcccgaacgcgagaaguccgcggccauugacggggaauaucggcugagaggagaggcucgcaaaacguuuguggagcucaugagacggggcgaucugccugucuggcugagcuacaagguggccuccgaaggguuccaauauucugaccgcagauggugcuuugauggcgagcggaacaaucagguucucgaagagaacauggacguggaaaucuggaccaaagagggagagcgcaagaaacuuagaccgcgguggcuggacgcuagaacauacagcgauccccuggcccuccgcgaguucaaggaguuugcugccggccggagauccgugucuggggaccugauucuugaaaucggaaagcugccucagcaccucacccagcgcgcgcaaaaugcccuggauaaccuggucaugcuccauaauagcgagcagggcgggcgggcuuauagacacgccauggaggaacuucccgacacaaucgagacccugaugcugcucgcucugauugccguucuuacaggaggcgugacccuguucuuucucuccggccgggggcugggaaaaacgagcaucggccugcucugugugauggccucuuccguccuucuguggauggcuagcguggaaccucauuggauugcggccucuaucauucuggaguucuuucucaugguucugcuuauccccgaaccggaucgccagagaacaccucaggacaaccaacuggcuuacguggucaucgggcuccuguucaugauucugaccguggccgccaaugagaugggacuccuugagaccacaaagaaagaucugggcaucgggcacgucgcuguggaaaaccaccaucacgccgcgaugcuggacguugaucuccaucccgccuccgcuuggacccuguacgccguggcuacaacgauuaucaccccuaugaugcggcacacaauugagaacaccacagccaauaucagccuuaccgcgauugccaaccaggcugccauccugaugggacucgacaagggcuggcccaucucuaaaauggauauuggcgucccucugcuggcucucgggugcuauagccaggugaauccccuuacgcugaccgccgcuguucugaugcucguggcccauuacgcgaucauuggaccgggccugcaagccaaggcuacacgcgaagcccagaagagaaccgcugccgggaucaugaaaaacccuacagucgacggaauuguggccaucgaucuugaccccgugguuuaugacgcgaaguuugagaaacagcugggccagaucaugcuccugauucuguguaccucccaaauccuccuuaugcggacgacaugggcucugugcgaaucuauuacccuggccacagggccccucaccacccugugggagggaagcccuggcaaguucuggaauacaacgaucgcugucuccauggccaacauuuuccgcggcagcuaccuugccggggcuggacuggccuuuucccucaugaaaucucugggcgggggaagacggggcaccggggcgcagggagagacacugggcgaaaaguggaagcgccagcucaaucagcuuagcaaauccgaguucaacaccuauaagagaucuggcaucauggaaguggaucggagcgaggccaaagaagggcugaagagaggagagacaaccaaacacgcugugucccgcggcacggccaagcugcggugguuugucgagagaaaucucguuaagccggaagggaaagugaucgaccugggauguggccgcgggggauggucuuacuauugcgcuggccuuaagaaagugacagaggucaagggcuacaccaaagggggacccggccacgaggaaccuauucccauggccaccuacggguggaaccuggugaagcuccauagcggaaaagauguuuucuuuaucccucccgaaaagugugacacacugcugugcgauauuggcgaguccagcccuaauccgaccaucgaggaagggcggacacucagagugcuuaagauggucgagcccuggcugcgcggaaaccaauucuguauuaaaauccugaauccuuauaugcccucugugguugaaacgcucgagcagaugcagcggaagcacggcggcaugcuggugagaaacccucuuucccgcaauagcacccaugagauguacugggucucuugcgggacaggaaacauuguguccgcggugaauaugaccagccggaugcugcucaacagauuuacaauggcccaccgcaaacccaccuaugaacgggacgucgaucugggcgcugggacgagacacguugccguggagccggaaguggcuaaccuggacaucaucggacagcgcauugagaauaucaagcaugaacacaaaucuaccuggcauuacgaugaggacaacccuuauaagacaugggccuaccacggcuccuaugaggucaagcccagcggguccgcuagcucuauggugaauggaguugugaaacuccugaccaagcccugggaugucauuccuauggugacacaaaucgccaugaccgacacaacccccuucggccagcagagaguuuuuaaagaaaagguggacacgcggacaccuaaagcgaagcgcggcaccgcccaaauuauggaggucaccgcuaaguggcuuuggggguuccugagcagaaacaaaaagccgcggaucuguacaagagaagaguuuacgcggaaagugcgcuccaaugccgcuaucggagccguuuucguggaugaaaaccaguggaacucugccaaggaggcggucgaggacgaaagauuuugggaucucgugcaucgggagcgcgaacugcacaaacagggcaagugcgcuaccugcgucuacaacaugauggggaagagagagaagaaacuuggagaguucggcaaagccaaagggagccgggccauuugguacauguggcugggcgcucgcuuccucgaguuugaggcccugggauucaugaaugaagaccacugguuuuccagagagaacucucugagcggcguggaaggggagggacuccauaaacugggcuauauccuucgggauauuuccaagauccccgggggaaauauguacgcugacgauacagccggcugggacacccgcauuacagaggaugaccugcagaacgaagcgaaaaucaccgauaucauggagccugaacacgcccuccuggcuaagucuauuuucaaacuuacauaucaaaauaaaguugugagaguccagcggcccgccaagaacgggaccgugauggacgugaucagccgcagagaucagcggggcuccggacagguuggcacguacgggcugaauaccuuuacaaacauggaggcucaacucauucgccagauggaaagcgagggaaucuucucuccuuccgagcuggaaacccccaaccuggccggcagagugcucgacuggcuggagaaacauggggucgaacggcuuaagagaauggcgauuagcggagacgauugugugguuaaaccgaucgacgaucgcuuugccacagcucugaccgcccucaaugacaugggcaaggugcggaaggauaucccucagugggagcccucuaaaggguggaacgacuggcagcaagucccuuucugcucccaccacuuucaucagcugauuaugaaggauggcagagaaaucgugguccccugucgcaaucaggacgagcuugugggacgggcuagaguuagccagggcgccggguggucccugcgcgagacggcuugccucggaaaaucuuaugcccaaauguggcagcugauguacuuccaccggagagaucugcgccucgcggccaacgcuauuuguagcgccgugccugucgacugggugcccacaucccggaccacauggagcauccaugcccaccaucaguggaugaccacggaagauaugcugucuguuuggaauagaguguggauugaggaaaacccguggauggaggacaagacccacaucuccagcuggggcgacgucccuuaucuugggaaacgcgaagaucaauggugcggaucucugauuggccucacagcucgggccaccugggcgacaaauauccagguggcuaucaaccaggugagacggcugauugggaaugagaacuaccuugacuacaugaccagcaugaagagauuuaagaaugaguccgaucccgaaggcgcccugugguga

SEQ ID NO: 18932 - RNA, 9879 nt, Artificial Sequence
  derived and/or modified CDS sequence (opt5) from DENV-1__FJ410227__SS-prME
agcgugaccaugcugcucaugcugaugcccacagcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacagaacaguauaaauuccaagccgacucuccuaagcggcugagcgcggccauuggcaaggcuugggaggagggggugugcggcaucagauccaccacgcgccuggaaaacaucauguggaagcagauuucuaacgagcucaaucauauccugcuugaaaacgacaugaaauuuacaguuguggucggagauguggccggcauucuggcucaggggaagaaaaugauccggccgcagcccauggaguacaaguauagcuggaaguccuggggaaaagccaagauuaucggcgccgacgugcaaaauaccaccuucaucauugaugggccuaacacacccgaauguccugacgaucagagagcuuggaauaucugggaggucgaggacuacggauuuggcauuuucaccacgaacaucuggcucaaacugcgcgauagcuauacacagguuugcgaccaccggcugaugucugcggccauuaaggauuccaaagcugugcacgccgacaugggcuacuggaucgaaagcgagaagaaugaaaccuggaaacuugccagagcuucuuucaucgaggugaaaacauguauuuggcccaagucccauacccucuggagcaacgggguccuggaaucugagaugaucauuccgaaaaucuauggaggcccuauuagccagcacaauuaccgccccggguacuuuacacaaaccgccggaccuuggcaucugggcaagcucgagcuggauuucgaccuuugcgaagggacgaccgugguuguggaugagcacugcggaaaccggggccccucccugagaacaaccacagucaccggcaaaaucauccacgaaugguguugccggagcuguacgcucccuccccugcgcuuuaagggggaggacggaugcugguauggcauggagauuagaccggugaaggaaaaagaggaaaaucugguuaagucuaugguguccgcggggagcggagaggucgacuccuucucucuuggccuccuguguaucagcauuaugaucgaagaggugaugcgguccagauggucucgcaaaaugcugaugacagggacccucgcugucuuuuuccugcuuauuaugggacagcugacauggaacgaucucauccggcugugcauuauggugggcgccaaugccagcgacagaaugggcauggggaccaccuaccuggcucuuauggccacauuuaagaugcgcccuauguucgcggucggacugcucuuuagacggcugacgucccgcgaggugcuccugcuuaccaucggccugucucucguggcuagcgucgaacugcccaacucccuggaggaacuuggggauggacuggccaugggcaucaugauucucaaacugcucacagacuuccagagccaucaacugugggccacccuucugucucucacauuuaucaagaccacguucucccugcacuaugcuuggaagacaauggccaugguucugagcauugugucucuuuuuccccugugucucuccaccaccagccagaaaacaaccuggcugccugugcuccuggggucucuuggaugcaagccgcugacaauguuccugaucgcugagaauaaaauuuggggcagaaaguccuggccccucaacgaaggcaucauggccgucgggaucgugagcauucugcuuuccagccugcucaaaaacgauguuccucuggcgggaccccucaucgccggcgggaugcugauugcuuguuacgugaucucuggaagcuccgccgaccuuucucuggagaaggcugccgaggucagcugggaagaggaagccgagcauuccggcgcuucucacaauauucugguggaaguucaggaugacgggacgaugaaaaucaaggaugaggagcgggacgauacccucacaauccugcuuaaggcgacccugcucgccgugagcggagucuauccucuguccauucccgcuacacucuucgugugguacuuuuggcagaaaaagaaacaacgcucuggcguccugugggacaccccuuccccucccgaaguggagagagccguucuugaugacggcaucuaucggauuaugcagcgcgggcugcugggaagaucccaggugggcgucgggguguuccaggaaaacguuuuucauacgauguggcacgugacccggggagccguccucauguaccaaggcaagcgccuggagcccagcugggcuucugugaaaaaggaccuuaucuccuacgggggaggcuggagacugcagggcagcuggaauacaggggaggaagugcagguuauugccgucgagcccggaaagaacccuaaaaaugugcagaccgcgcccggcacauucaagaccucugaaggggaggugggagcuaucgcccucgauuuuaaaccgggcacauccgggagcccuauugucaaccgggaaggaaagaucgugggccuguauggcaaugggguugugacgaccuccggaacauacgucucugccaucgcucaagccaaagcgagccaggagggcccccucccugagauugaagacgagguguucagaaagcgcaaccugaccaucauggaucuucaccccggguccggaaagacccggagauaucugcccgcuauuguucgcgaagccaucaaacggaagcugagaacacucauucuggccccuacgcgcguggucgcuagcgagauggccgaagcucuuaaaggcaugccgauccgguaccagaccacagccgugaagucugagcauaccgggaaagagaucguugaccugaugugccacgcgacauuuaccaugagacuccugucccccgugcgcgucccuaauuauaacaugauuaucauggaugaagcccauuucacggaccccagcucuauugcugcccggggcuacaucagcacaagagugggaaugggcgaggcugccgccauuuuuaugaccgcuaccccucccggguccguggaagcguucccucaaucuaaugccgucauccaggaugaggaacgggacaucccggagcgcagcuggaacuccggauaugaguggauuacagauuuucccggcaagaccguuugguucgugccuucuaucaagagcgggaaugacauugcuaacugucugcgcaagaauggaaagcgggugauccagcucucccgcaaaacauucgauaccgaauaccagaagacgaaaaacaacgacugggacuacgucgugacaaccgauauuagcgagaugggcgccaauuuuagagccgaccggguuaucgaucccagacgcugccuuaagccugugauucugaaggacgggcccgaacgggucauccuggcuggcccgaugccugugacaguugccucugcggcucaaagacgcggacggaucggcagaaaccacaauaaagagggggaucaguauauuuacaugggacagccccucaacaaugacgaggaucaugcccacuggaccgaagccaagaugcugcuugacaacaucaauacgcccgagggcauuaucccugcucuguucgaacccgagcgcgaaaaauccgccgcgauugauggggaguaucggcucagaggagaggcccgcaagaccuuuguggaacugaugagacggggcgaccugccugucuggcucagcuacaaaguggcuuccgagggguuccaguauucugaucgcagauggugcuuugacggcgaacggaacaaucaaguccuugaggaaaacauggauguggagaucuggacaaaggagggagaacgcaaaaagcugagaccgcgguggcuggacgccagaaccuacagcgacccccucgcucugcgcgaguucaaggaauuugccgcuggccggagauccguuucuggggaucuuauccuggagauuggaaaacucccucagcaccugacacagcgcgcccagaaugcgcuggacaaccucgugaugcuucauaauagcgaacaaggcgggcgggccuauagacacgcuauggaggagcugcccgauaccaucgaaacacugaugcuccuggcccuuauugcugugcugaccggaggcgucacgcuguucuuucuguccggccgggggcugggaaagacaagcaucggccuccuuuguguuauggccucuuccgugcugcuguggauggccagcguggagccucauuggauugcugcgucuaucauccucgaguucuuucugaugguccuucugauucccgagccggaccgccagagaaccccucaggauaaccagcucgccuacgugguuaucgggcugcuguucaugauucucaccguggcugccaaugagaugggacuucuggaaacaaccaaaaaggaccugggcaucgggcacgucgccgcugagaaccaccaucacgccgcgaugcucgauguggaccugcaucccgccuccgcuuggacacuuuacgccgucgcuacgaccauuaucacaccuaugaugcggcacaccauugaaaacacaaccgccaauaucagccugacggcgaucgccaaccaagcugccauucucaugggacuggauaaaggcuggcccaucucuaagauggacauuggcgugccucugcucgcucuugggugcuauagccagguuaauccccugacccugacagccgcugugcucaugcuggucgcccauuacgcgaucauuggaccgggccuucaggccaaggcuacccgcgaggcccagaagagaacagcugccgggaucaugaagaacccuaccguggauggaaucguugccauugaccuggaucccguggucuaugacgcgaaauuugaaaagcagcucggccagaucaugcugcugauucucuguacgucccagauccuucugaugcggacaaccugggcucugugcgagucuauuacacucgccaccgggccccugaccacacuuugggagggaagcccuggcaaauucuggaauacgaccaucgcuguguccauggccaacaucuuccgcggcagcuaccuggccggggcuggacucgccuuuucccugaugaagucucugggcgggggaagacggggcacaggggcgcaaggagaaacccucggcgagaaguggaaacgccagcuuaaucagcugagcaaguccgaguucaacacauauaaaagaucuggcauuauggagguggaccggagcgaagccaaggaggggcugaaaagaggagagaccacgaagcacgcuguuucccgcggcacagccaagcuccggugguuugucgaaagaaaucuggugaaaccggaggggaaggugaucgaucuuggauguggccgcgggggauggucuuacuauugcgcuggccugaaaaaggucaccgaaguuaaaggcuacaccaaagggggacccggccacgaggaaccuauucccauggccacauacggguggaaccucgugaaacugcauagcggaaaggacguguucuuuaucccucccgagaagugugauacccugcucugcgacauuggcgaguccagcccuaauccgacaaucgaagaggggcggacgcuuagaguccugaaaaugguggaacccuggcugcgcggaaaccaguucuguauuaagauccucaauccuuauaugcccucuguuguggagacccuggagcaaaugcagcggaaacacggcggcaugcuugucagaaacccucugucccgcaauagcacacaugaaauguacugggugucuugcgggaccggaaacaucguuuccgcggugaauaugacaagccggaugcuccugaacagauuuaccauggcccaccgcaagcccacguaugagcgggaugucgaccugggcgcugggaccagacacguggccguggaaccggaggucgcuaaccucgauauuaucggacagcgcauugaaaauaucaaacaugagcacaagucuacauggcauuacgacgaggauaacccuuauaagaccugggccuaccacggcuccuaugaaguuaaacccagcggguccgcuagcucuauggugaauggaguggucaagcugcuuacaaaacccugggacgugauuccuaugguuacccagaucgccaugacagauaccacgcccuucggccaacagagaguguuuaaggagaaagucgacacacggaccccuaaggcgaagcgcggcaccgcccagaucauggaagugacagcuaaauggcuguggggguuccucagcagaaacaagaaaccgcggauuuguacgagagaggaauuuacccggaagguucgcuccaaugccgcuaucggagccguguucgucgacgagaaccaauggaacucugccaaagaggcgguggaagaugagagauuuugggaccugguucaucgggaacgcgagcuucacaagcagggcaagugcgcuacaugcguguacaacaugauggggaaaagagaaaagaaacugggagaguucggcaaggccaaagggagccgggccauuugguacauguggcucggcgcucgcuuccuggaguuugaagcccugggauucaugaaugaggaucacugguuuuccagagaaaacucucucagcggcgucgagggggagggacugcauaaacuuggcuauauccugcgggacauuuccaaaauccccgggggaaauauguacgcugaugacaccgccggcugggauacacgcaucaccgaagacgaucuccagaacgaggcgaagauuacagacaucauggaaccugagcacgcccugcuugcuaagucuauuuucaaacugaccuaucagaauaagguggucagagugcaacggcccgccaaaaacgggacgguuauggaugugaucagccgcagagaccagcggggcuccggacaggucggcaccuacgggcucaauacauuuaccaacauggaagcucagcugauucgccaaauggagagcgagggaaucuucucuccuuccgaacuggagacacccaaccucgccggcagagugcuggauuggcuugaaaagcaugggguggagcggcugaaaagaauggcgaucagcggagacgacuguguugugaagccgauugaugaccgcuuugccaccgcucucacggcccugaaugauaugggcaagguccggaaagacaucccucagugggaacccucuaagggguggaacgauuggcaacaggugccuuucugcucccaccacuuucaucaacuuauuaugaaagacggcagagagaucguugugcccugucgcaaucaggaugagcuggucggacgggcuagagugagccagggcgccggguggucccuccgcgaaacagcuugccugggaaagucuuaugcccagauguggcaacugauguacuuccaccggagagaccuccgccuggcggccaacgcuauuuguagcgccgucccuguggauuggguucccaccucccggacaaccuggagcauccaugcccaccaucaguggaugacgaccgaggacaugcuuucuguguggaauagagucuggauugaagagaacccguggauggaagauaaaacacacaucuccagcuggggcgacgugccuuaucuggggaagcgcgaggaccaguggugcggaucucucaucggccugaccgcucgggccacaugggcgaccaauauucaaguugcuaucaaccaggugagacggcuuauugggaaugagaacuaccuggauuacaugacaagcaugaagagauuuaaaaaugaauccgaccccgagggcgcccucugguga

SEQ ID NO: 18933 - RNA, 9879 nt, Artificial Sequence
  derived and/or modified CDS sequence (opt5) from DENV-1__FJ859029__SS-prME
agcgugaccaugcugcugaugcugaugcccaccgcccuugcuuuccaccugacgaccagaggaggggaaccucauaugaucgucuccaagcaggaacggggaaaaucucuccuguuuaagacaagcgccggcguuaacaugugcacccuuauugccauggaccugggggaguucugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucugucgcccucgcuccucauguggggcugggacuggagacaagaaccgaaacguggaugagcuccgagggcgccuggaaacagauucagaagguugaaacaugggcucuccggcaccccggcuuuaccgugaucgcccuguuccuugcgcaugccauugggacaucuaucacccagaagggaaucauuuuuauccugcucaugcuggucaccccuagcauggcuaugcgcugcgugggcauuggguccagagauuucguugagggacuuagcggcgccacauggguggacgucgugcuggagcacgggucuugugugacgaccauggcuaaagauaagcccacacucgacaucgaacugcugaaaaccgaggucacaaacccugccguucuccggaagcugugcauugaagcgaaaaucuccaauaccacgacagauagccgcuguccgacccaaggagaggccacccuuguggaagaacaggacgcuaacuuugugugcagacggacauucgucgaucgcggcuggggcaauggguguggacuguuuggcaaggggucucucauuaccugcgccaaguucaaaugcgugacaaagcuggagggaaaaacgguucagcacgaaaaccuuaaguacuccgugaucgucaccgugcauacaggcgaccagcaccaaguugggaaugagagcaccgaacauggaacaaccgcuacgaucacaccccaggccccuucuacagagauucagcugaccgacuauggcgcccucacacuggauuguucccccagaaccggccuggacuuuaacgaaauggugcuccugacgaugaaagaaaagagcuggcuuguccacaaacagugguuccuggaucucccucugcccuggacauccggggcuucuaccagccaagagacauggaaucggaaggaccuucuggugaccuuuaagaccgcgcacgccaaaaagcaggaagucgugguucucggaucccaggagggcgcuaugcauacagcccugacgggggccaccgaaauccaaacaagcggaaccacaaccauuuucgcuggccaccugaaaugccgccucaagauggauaaacugacgcuuaaggggacaucuuacgugauguguaccggcuccuucaagcuggagaaagaagucgccgagacccagcauggaacagugcucguucagaucaaguaugagggcaccgacgcgccgugcaaaauuccuuuuagcacacaggaugaaaagggggugacgcaaaacggaagacugaucaccgcuaaucccaucgucacagacaaagagaagccugugaacauugaagccgagccgcccuucggcgagucuuacaucgugauuggggccggagaaaaggcucugaaacuuagcugguuuaagaaaggcuccucuaucgggaagauguucgaggccaccgcucggggcgccagacgcauggcgauucucggagauacagccugggacuuuggcagcaucgggggaguuuucaccuccgucggcaaacuggugcaccagaucuuugggacggcuuauggagugcuguucagcggcgucucuuggaccaugaagauugggaucggcgugcuccugacauggcuuggacucaauucccggagcaccucucucuccaugacauguauugccguuggccuggugacccuguaccuuggggucauggugcaggcugauagcggaugcguuaucaacuggaagggcagagaacucaaauguggguccggaauuuuugugacaaaugagguccauaccuggacggaacaguacaaguuccaagccgacucuccuaaacgccugagcgcggccaucggcaaggcuugggaggagggggugugcggcauucgguccgccacaagacuggaaaacaucauguggaaacagaucucuaacgagcucaaucacauucugcuugaaaacgacaugaaguuuaccguuguggucggagauguggcuggcauccuggcccaggggaaaaagaugauucgcccgcagcccauggaguauaaguacagcuggaaauccuggggaaaggccaaaaucauuggcgcugacgugcaaaauaccacauucaucaucgaugggccuaacacccccgaauguccugacgaucagcgggcguggaauauuugggaggucgaggacuauggauuuggcaucuucacgacaaacauuuggcucaagcugagagauagcuacacccagguuugcgaccaccgccugaugucugccgcuaucaaagauuccaaggccgugcaugccgacaugggcuauuggauugaaagcgagaagaaugaaacauggaaacuugcucgggccucuuucaucgaggugaagaccuguaucuggcccaaaucccacacacucuggagcaacgggguccuggaaucugagaugauuaucccgaagauuuacggaggcccuaucagccagcauaauuauagacccggguacuuuacccaaacggcgggaccuuggcaccugggcaaacucgagcuggauuucgaccuuugcgaagggaccacagugguuguggaugagcacugcggaaaccgcggccccucccugcggaccacaaccgucacgggcaagauuauccaugaaugguguugcagaagcuguacacucccuccccugcgguuuaagggggaggacggaugcugguacggcauggagauccgcccggugaaagaaaaggaggaaaaucugguuaaaucuaugguguccgcugggagcggagaggucgacuccuucucucuuggccuccuguguauuagcaucaugauugaagaggugaugagaucccgguggucuagaaagaugcugaugaccgggacacucgccguuuuucugcuucugaucaugggacagcucaccuggaacgaucugauucgccugugcaucauggugggcgccaaugcuagcgaccggaugggcauggggaccacauaucuugcccugauggcgacguucaaaaugagaccuauguuugcugucggacuccuguuccgcagacucaccucccgggaggugcugcuucugacaauuggccucucucugguggccagcgucgaacugcccaacucccuugaggaacugggggauggacucgccaugggcaucaugauccugaagcuccugaccgacuuucagagccaccaacuuugggcuacacugcucucucugaccuucauuaagacgacauuuucccugcauuacgccuggaaaaccauggcuaugguucuuagcaucgugucucuguucccccucugucuguccaccacaagccagaagaccacauggcucccugugcugcuugggucucugggaugcaaaccgcugacgauguuucucauugccgagaauaagaucuggggccgcaaauccuggccccugaacgaaggcauuauggcggucgggaucgugagcauccuucuguccagccuccugaagaacgauguuccucucgccggaccccugauugcuggcgggaugcuuaucgccuguuaugugauuucuggaagcuccgcugaccugucucuggagaaagccgccgaggucagcugggaagaggaagcugagcacuccggcgcgucucauaauauccucguggaaguucaggaugacgggaccaugaagauuaaggaugaggagagagacgauacacugaccauccuucugaaagccacacuccuggcugugagcggagucuacccucucuccauccccgccacccuguucgugugguauuucuggcagaagaaaaagcaacggucuggcguccuuugggacacgccuagcccucccgaaguggagcgcgccguucuggaugacggcauuuacagaaucaugcagcgggggcugcucggacgcucccaggugggcgucgggguguuucaggaaaacguuuuccacaccauguggcacgugacaagaggagcuguccugauguaucaaggcaaacggcuugagcccagcugggccucugugaagaaggaccugauuuccuacgggggaggcuggcgccuccagggcagcuggaauaccggggaggaagugcagguuaucgcggucgagcccggcaaaaauccuaagaaugugcagacagcucccggcaccuuuaaaacaucugaaggggaggugggagccauugcccuggauuucaagccgggcacguccgggagcccuaucgucaacagagaaggaaaaauugugggccucuacggcaaugggguugugaccacauccggaaccuaugucucugcuaucgcccaagcgaaggcuagccaggagggcccccugccugagaucgaagacgagguguuucggaagagaaaccuuaccauuauggaucugcaucccggguccggaaaaacacgccgguaccugcccgccaucguuagagaagccauuaagcgcaaacuccggacgcugauccuugcuccuaccagaguggucgccagcgagauggcugaagcccugaagggcaugccgauucgcuaucagacaaccgcggugaaaggggagcacacaggcaaggagaucguugaccucaugugccaugccaccuucacgaugcggcugcugucucccgugagagucccuaauuacaacaugaucauuauggaugaagcucacuuuacagaccccuccagcaucgccgcucgcggauauauuucuacccgggugggcaugggggaggccgccgcuaucuucaugaccgcgacaccucccggaagcguggaagccuuuccucaauccaaugcugucauucaggaugaggaaagagacaucccggagcggucuuggaacagcggcuacgaguggaucaccgauuuccccgggaagacaguuugguuugugccuuccauuaaaucuggaaaugacaucgccaacugucuccgcaagaauggcaaaagagugauucagcuuagccggaagaccuucgauacggaauaucagaaaacaaagaacaacgacugggacuacgucgugaccacagauaucuccgagaugggggccaauuuccgcgcugacagaguuauugauccccggagaugccugaagccugugauccugaaagacggccccgaacgcgucauucucgccggaccgaugccugugaccguugcgagcgcugcccaacggagaggccgcaucgggcggaaccauaauaaggagggagaucaguacaucuauaugggccagccccugaacaaugacgaggaucacgcccacuggacggaagcuaaaaugcuucuggacaacauuaauacccccgaggggaucauuccugcccucuuugaacccgagagagaaaagucugcggccaucgauggagaguaccgccugcggggcgaggcuagaaaaacauucguggaacugaugcgcagaggggaccucccugucuggcuuuccuauaagguggccagcgagggcuuucaguacuccgaucggcgcuggugcuucgacggagaaagaaacaaucaaguccuggaggaaaacauggauguggagauuuggaccaaagagggcgaacggaagaagcugcgcccgagauggcucgacgcucggacauauucugacccccuggcccuuagagaguuuaaagaguucgcugccgggcgccggagcguuuccggagaucugauccucgagaucggcaagcugccucagcaucugacccagagagcgcagaaugcccucgacaaccuugugaugcugcacaauucugaacaagggggacgcgcuuaccggcaugccauggaggagcugcccgauacaauugaaacccucaugcugcuugcucugaucgccgugcucacgggcggcgucacacuguuuuuccugagcgggagaggacucggcaaaaccuccauugggcuucuguguguuauggccagcucugcucugcucuggauggcguccguggagccucacuggaucgccgcuagcauuauccuggaauuuuuccuuauggugcugcucauccccgagccggaccggcagcgcaccccucaggauaaccagcuggccuaugucgugauuggacugcucuuuaugauccuuacaguugccgcuaaugagaugggccugcuggaaaccacaaagaaagaccucgggauuggacacguggccgucgagaaccaucaccaugcggccaugcuggauguggaccuucaccccgcuucugccuggacgcuguacgcugucgccaccacaaucauuaccccuaugaugagacauacaaucgaaaacaccacggcgaauauuucccucaccgccaucgcuaaccaagccgcuauccugaugggccuggauaagggcuggcccauuagcaagauggacaucggggugccucuccuugcccugggaugcuacucucagguuaauccccugacacucaccgcugccgugcugaugcuugucgcgcacuaugccauuaucggcccggggcugcaggcuaaagccacacgggaggcucaaaagcgcaccgccgccggaauuaugaaaaacccuacgguggauggcaucguugcgaucgaccucgaucccguggucuacgacgcuaaguucgaaaaacagcuggggcagauuaugcugcucgugcuuuguacaagccagauccugcugaugagaaccacaugggcccucugcgaguccauuacccuggcuaccggaccccuuacaacgcugugggagggcucuccuggcaaguuuuggaauaccacaaucgccgugagcauggccaacauuuuccggggguccuaucucgcuggagccggccuggcguucagccugaugaagucccucgggggaggccgcagagggaccggagcccaaggcgaaacacuuggcgagaaauggaagcggcagcugaaucagcugucuaaaagcgaauuuaacaccuacaagcgcuccgggaucauggagguugacagaucugaagcuaaagagggacucaagcggggcgagacgacaaagcacgccgucagcagagggaccgcuaaacugcgcugguucguggaacggaaucuugugaagccggagggaaaagucaucgaucugggcugugggagaggaggcugguccuauuacugcgccggccucaagaaaguuaccgaagugaagggguauacaaaaggaggccccgggcaugaggaaccuauucccauggcgaccuacggauggaaccuggugaagcugcacucuggcaaggacgucuuuuucaucccucccgagaaaugugauacacuccuuugcgacauuggggagagcuccccuaauccgacgaucgaagagggacgcacccugcgggugcugaagaugguugaacccuggcucagaggcaaccaguuuuguauuaaaauccugaauccuuacaugcccagcguggucgagacacuugagcaaaugcagcgcaagcauggcgggaugcuggugcggaacccucucucuagaaauuccacccacgaaauguauuggguuagcugcggaacaggcaacauugugucugccgucaauaugaccucccgcaugcugcugaaccgguucacgauggcucacagaaaacccaccuacgagcgcgauguggaccucggggccggaacacggcauguggcugucgaaccggagguugccaaccuggauaucaucggccagagaauugaaaauaucaagcacgagcauaagagcaccuggcacuaugacgaggauaacccuuacaaaacaugggcuuaucaugggucuuacgaagccaagcccuccggaagcgcguccagcauggugaauggcguggucaaacuucugaccaagcccugggacgugauuccuaugguuacacagaucgccaugaccgauacgacacccuuuggccaacagcgcguguucaaagagaaggucgacaccagaaccccuaaggcuaaacgggggacagcccagauuauggaagugacggcuaaguggcucuggggauuucugucucgcaacaaaaagccgagaaucuguacccgggaggaguucacaagaaaaguucggagcaaugccgccaucggcgcgguguuugucgacgagaaccaauggaacuccgcuaaggaggccguggaagaugagcgcuucugggaccuuguucacagagaacgggagcugcacaagcaggggaaaugcgcgaccugcguguauaacaugaugggaaagcgcgagaaaaagcucggcgaguuugggaaagcuaagggcucuagagccauuugguacauguggcugggagcucgguuccuggaguucgaagcccucggcuuuaugaaugaggaucauugguucagccgcgaaaacucccugucuggggucgagggagagggccuucacaaacugggguacauccucagagacauuagcaagauccccggaggcaauauguaugcggaugacacagccgggugggauacccggauuacagaagacgaucugcagaacgaggcuaagaucaccgacaucauggaaccugagcaugcccuucuggcuaaauccauuuuuaagcucacguaccagaauaaagugguccgcgugcaaagacccgccaagaacggcaccguuauggaugugaucucucggcgcgaccagagaggaagcggccaggucgggacauauggacugaauaccuucacaaacauggaagcgcagcugauucggcaaauggaguccgaggaaaucuuuagcccuucugagcucgaaacccccaaccuggccggccgcgugcuugauuggcuggagaaacacgggguggaaagacucaagcggauggcuauuuccggagacgacuguguugugaagccgaucgaugacagauucgccacggcucugacagcccuuaaugauaugggcaaaguccgcaaggacaucccucagugggagcccagcaaaggguggaacgauuggcaacaggugccuuuuugcucucaccauuuccaccaacugauuaugaaggacggccgggagaucguugugcccuguagaaaucaggaugaacucgucggacgcgcucgggugucccagggcgccggguggagccugagagagaccgcgugccugggaaaauccuacgcccagauguggcaacucauguauuuucaucgccgggaccugagacuugcugccaacgccauuuguucugcugucccuguggauuggguucccacaagccgcaccacgugguccauccacgcccaucaccaguggaugaccacagaagacaugcugagcguguggaaucgggucuggauugaggaaaacccguggauggaggauaagacccacaucucuuccuggggcgacgugccuuaccucgggaagagagaggaccaguggugcggaagccugauuggccuuacagcgcgcgcuaccugggccacaaauauccaaguugccaucaaccaggugcggagacugauugggaaugaaaacuaucucgauuacaugaccucuaugaaacgguucaagaaugagagcgaccccgaaggcgcucugugguga

SEQ ID NO: 18934 - RNA, 9879 nt, Artificial Sequence
  derived and/or modified CDS sequence (opt5) from DENV-1__FJ547065__SS-prME
agcgugaccaugcugcucaugcugaugcccaccgcccuugcuuuccaccugacgaccagaggaggggaaccucauaugaucgucuccaagcaggaacggggaaaaucucuccuguuuaagaccagcgccggcguuaacaugugcacccuuauugcgauggaccugggggaacucugugaagauaccaugaccuacaaaugccccagaaucacagaaaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucugagagcuuggaauaucugggaggucgaggacuacggauucggcauuuuuacgacaaacaucuggcugaaacuucgcgauuccuauacccagguuugcgaccaccggcucaugagcgcggccauuaaagauucuaaggcugugcacgccgacaugggcuacuggaucgaauccgagaaaaaugaaacauggaagcuggccagagcuagcuucaucgaggugaagaccuguauuuggcccaaaucucauacacugugguccaacgggguccucgaaagcgagaugaucauuccgaagaucuauggaggcccuauuucucagcacaauuaccgccccggguacuucacccaagccgcgggaccuuggcaucugggcaaacuugagcuggauuuugaccucugcgaagggacgaccgugguuguggaugagcacugcggaaaccggggccccagccugagaacaaccacagucaccggcaagaucauccacgaaugguguugccgguccuguacgcugccuccccuucgcuucagaggggaggacggaugcugguauggcauggagauucggccggugaaagaaaaggaggaaaaucucguuaagagcauggugucugcuggguccggagaggucgacagcuuuucccugggccugcucuguaucucuauuaugaucgaagaggugaugagaagccgcuggucccggagaaugcugaugacagggacccuugccguuuucuuucugcucauuaugggacagcugacauggaacgaucugauccgccuuugcauuauggugggcgccaaugcuucugacagaaugggcauggggaccaccuaccuggcccucauggcgacauucaaaaugcggccuauguuugcugucggacuccuguuccgcagacugacgagccgggaggugcuucugcucaccaucggccugucccugguggccucugucgaacuucccaacagccuggaggaacucggggauggacuggccaugggcaucaugauucucaagcugcuuacagacuuucagucccaucaacugugggcuacccuccugagccugacauucaucaaaaccacguuuucucuucacuaugccuggaagacaauggcuaugguucuguccauugugagccucuucccccugugucucucuaccaccucccagaaaacaaccuggcugccugugcuucuggggagccugggaugcaagccgcucacaauguuucugaucgccgagaauaagauuuggggccgcagaucuuggccccuuaacgaaggcaucauggcggucgggaucguguccauucugcucagcucccugcucaaaaacgauguuccucuggccggaccccuuaucgcuggcgggaugcugauugccuguuacgugaucagcggaucuagcgcugaccugucccucgagaaggccgccgaggucucuugggaagaggaagcugagcauagcggcgcgucccacaauauucugguggaaguucaggaugacgggacgaugaaaaucaaggaugaggagcgggacgauacccuuacaauccugcucaaagccacccugcucgcugugucuggagucuauccucugagcauucccgccacacuuuucgugugguacuucuggcagaagaaaaagcaacgcuccggcguccugugggacaccccuucucccccggaaguggagagagccguucuggaugacggcaucuaucggauuaugcagcgcgggcuccugggaagaagccaggugggcgucgggguguuucaggaaaacguuuuccauacgauguggcacgugacccggggagcuguccuuauguaccaaggcaagagacuggagccuuccugggccagcgugaaaaaggaccucaucucuuacgggggaggcuggcgccugcagggcuccuggaauacaggggaggaagugcagguuauugcggucgagcccggcaagaacccuaagaaugugcagaccgcucccggcacauuuaaaaccccggaaggggaggugggagccaucgcccucgauuucaagccuggcacaagcgggucucccauugucaaccgggaaggaaagaucgugggccuguauggcaaugggguugugacgaccuccggaacauacgucagcgcuaucgcccaagcgaaggcuucccaggagggcccucuucccgagauugaagacgagguguuuagaaagcgcaaccugaccaucauggaucugcaccccgggucuggaaaaacccggagauaucucccugccauuguucgcgaagccaucaagcggaaacugagaacacuuauucuggcuccgacgcgcguggucgccagcgagauggcugaagcccucaagggcaugcccauccgguaccagaccacagcggugaaguccgagcauaccgggaaagagaucguugaccugaugugccacgccacauucaccaugagacugcucagcccugugcggguccccaauuauaacaugauuaucauggaugaagcucauuuuacggacccuucuuccauugccgcucgcggcuacaucagcacaagagugggaaugggcgaggccgccgcuauuuucaugaccgcgacacccccugggucuguggaagccuuuccgcaaagcaaugcugucauccaggaugaggaacgggacauccccgagcgcuccuggaacucuggauaugaguggauuacagauuucccuggcaagaccguuugguuugugcccagcaucaaauccgggaaugacauugccaacugucuuagaaagaauggaaaacgggugauccagcugucuagaaagacauucgauaccgaauaccagaagacgcgcaacaacgacugggacuacgucgugacaaccgauauuagcgagaugggcgccaauuuccgggcugacagaguuaucgauccucgccggugccugaaacccgugauucucaaggacgggccggaaagagucauccuggccggcccuaugcccgugacaguugcguccgcugcccaacgccggggaagaaucggccgcaaccacaauaaagagggggaucaguauauuuacaugggacagccccuuaacaaugacgaggaucaugcccacuggaccgaagcuaagaugcugcucgacaacaucaauacgccugagggcauuauccccgcccuguuugaaccugagagagaaaagagcgcggccauugauggggaguaucggcugcgcggagaggcuagaaagaccuucguggagcucaugcggcgcggcgaccuuccggucuggcugucuuacaagguggccuccgagggguuucaguauagcgauagaaaauggugcuucgacggcgaacggaacaaucaaguccuggaggaaaacauggauguggagaucuggacaaaggagggagaacgcaaaaagcuccgcccccgguggcuggacgcuagaaccuacuccgacccucuugcccugcgcgaguuuaaagaguucgcugccggccggagaucuguuagcggggaucucauccuggagauuggaaagcugccccagcaccucacacagcgggcgcagaaugcccuugacaaccuggugaugcugcauaauuccgaacaaggcgggcgcgcuuauagacacgccauggaggagcucccugauaccaucgaaacacugaugcuucuggcucucauugccgugcugaccggaggcgucacgcuguuuuuccucucuggccgggggcuuggaaaaacaagcaucggccugcuguguguuauggccuccagcgugcuccuguggauggcuucuguggagccccauuggauugcggccuccaucauccuugaauuuuuccugaugguccuccugauuccggagccugaccgccagagaacaccccaggauaaccagcuggcuuacgugguuaucgggcuccuuuuuaugauucugaccguggccgccaaugagaugggacugcucgaaacaaccaagaaggaccugggcaucgggcacgucgcuguggagaaccaccaucacgccgcgaugcuugaugucgaccugcauccugccagcgcuuggacacucuacgccguggcuacgaccauuaucacacccaugaugcggcacaccauugaaaacacaaccgccaauaucucucugacggcgaucgccaaccaagcugccauucugaugggacucgauaaaggcuggccuaucuccaagauggacauuggcguuccccuucuggcucuggggugcuauagccaggugaauccgcucacccugacagccgcuguccuuaugcugguggcccauuacgcgaucauuggaccuggccuccaggccaaagcuacccgcgaggcccaaaagagaacagcugccgggaucaugaaaaaccccaccguugauggaaucguggccauugaccuggaucccgucguguaugacgcgaaguucgaaaagcagcugggccagaucaugcuccuuauucuguguacgucucagauccugcucaugcggacaaccugggcucugugcgagagcauuacacuugccaccgggccucugaccacacucugggagggauccccgggcaaauuuuggaauacgaccaucgcugugucuauggccaacaucuuccgcggcagcuaccuggccggggcuggacuggccuucucccucaugaaaagccuuggcgggggaagacggggcacaggggcgcaaggagaaacccugggcgagaaauggaagagacagcugaaucagcucuccaaaucugaauuuaacacauauaagcgcagcggcauuauggagguugaccgguccgaagccaaggaggggcugaaaagaggagagaccacgaagcacgcugucucucgcggcacagccaaacuucggugguucguggaaagaaaucuggugaagcccgaggggaaagucaucgaucucggauguggccgcgggggauggagcuacuauugcgcuggccugaagaagguuaccgaagugaaaggcuacaccaaaggcgggccugggcacgaggaacccauuccuauggccacauacggguggaaccuggugaaacuccauuccggaaaggacgucuuuuucauucccccugagaaaugugauacccuucugugcgacaucggcgagucuagcccgaaucccacaaucgaagaggggcggacgcugagagugcucaagaugguugaaccuuggcugcgcggaaaccaguuuuguauuaaaauccuuaaucccuauaugccuuccguggucgagacccuggagcaaaugcagcggaagcacggcggcaugcucgugagaaacccccugagccgcaauucuacacaugaaauguacuggguuuccugcgggaccggaaacaucgugagcgcggucaauaugacaucucggaugcugcucaacagauucaccauggcccaccgcaagccgacguaugagagagauguggaccugggcgcugggacccggcacguggccgucgaaccugagguugcuaaccuugauauuaucggacagcgcauugaaaauaucaaacaugagcacaaguccacauggcauuacgacgaggauaaccccuauaaaaccugggccuaccacggcagcuaugaagugaagcccucuggguccgcuagcuccauggugaauggagucgugaaacugcucacaaagccuugggacguuauucccauggugacccagaucgccaugacagauaccacgccuuuuggccaacagagagucuucaaggagaaaguggacacacggaccccgaaggcgaaaagaggcaccgcccagaucauggaaguuacagcuaaguggcuguggggguuucuuagccggaacaaaaagccccgcauuuguacgagagaggaguucacccggaaggugcgcucuaaugccgcuaucggagccgucuuuguggacgagaaccaauggaauagcgccaaagaggcgguugaagaugagagauucugggaccuggugcaucgggaacgcgagcuccacaagcagggcaaaugcgcuacaugcgucuacaacaugauggggaagagagagaaaaagcugggagaguuuggcaaggccaaagggucccgggccauuugguacauguggcugggcgcucgcuuccucgaguucgaagcccugggauuuaugaaugaggaucacugguucucuagagaaaacagccuuuccggcguggagggggagggacugcauaagcucggcuauauccugcgggacauuucuaaaaucccugggggaaauauguacgcugaugacaccgccggcugggauacacgcaucaccgaagacgaucuucagaacgaggcgagaauuacagacaucauggaacccgagcacgcccugcucgcuaagagcauuuuuaaacugaccuaucagaauaaggucgugcggguucaacgcccugccaaaaacgggacggugauggaugucaucuccagacgggaccagagaggcucuggacaggugggcaccuacgggcugaauacauucaccaacauggaagcucagcucauucgccaaauggagagcgagggaaucuuuucccccagcgaacuggagacaccgaaccuugccgaacgggugcuggauuggcucgagaaguauggcguugaaagacugaagcgcauggcgaucucuggggacgacuguguggucaaaccuauugaugaccgguucgccaccgcucuuacggcccugaaugauaugggaaaggugagaaaagacaucccccagugggagccuuccaagggcuggaacgauuggcagcagguucccuuuugcagccaucacuuccaccaacucauuaugaaagacgggcgcgagaucguggucccuugucggaaucaggaugaacuggugggcagagcucgcgucucucagggagccggcuggucccugcgggagacagcuugccucggaaagagcuacgcccagauguggcaacugauguauuuucauagacgcgaccuucggcuggcggccaacgcuauuuguuccgccgugcccguugauuggaucccgaccucuagaacaaccuggagcauucacgcccaucaccaguggaugacgaccgaagacaugcucuccguguggaaucgggucuggaucgaggaaaacccuuggauggaggauaagacacauaucagcucuuggggagacgugcccuaccugggcaaaagagaggaccaguggugcgggucccuuauuggacugaccgcucgcgccacaugggcgaccaauauccaaguugcuauuaaccaggugcggagacucaucggcaaugaaaacuaccuggauuauaugacaagcaugaagcgcuucaaaaaugagucugaccccgaaggggcccugugguga

SEQ ID NO: 18935 - RNA, 9879 nt, Artificial Sequence
  derived and/or modified CDS sequence (opt5) from DENV-1__FJ410230__SS-prME
agcgugaccaugcugcucaugcugaugcccaccgcccuugcuuuccaccugacgaccagaggcggggaaccucauaugaucguguccaagcaggaacggggaaaaucucuccuguuuaagaccagcgccggcguuaauaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugauuggggccaccgaaauccagacauccggaaccacaaccauuuuugccggccaucucaaaugcagacugaagauggauaaacuuacgcugaaggggaugagcuaugugauguguacaggcucuuucaaacucgagaaggaacuggcugagacccagcacggaaccguccuggugcagaucaaguacgagggcacagacgccccgugcaaaaucccuuucuccacccaagaugaaaaggggguuacacagaacggacggcuuauuacggcgaaucccaucgugaccgacaaagagaagccugucaacauugaagcugagccgcccuuuggcgagagcuauaucgugauuggggccggagaaaaagcccucaagcugucuugguucaagaaaggcagcuccaucgggaagauguuugaggcuacagccagaggcgcucgccggauggccauccugggagauaccgcgugggacuucggcucuauugggggaguguuuacaagcguuggcaaacucguccaucagaucuucgggaccgccuacggagugcuguuuuccggcgugagcuggacgaugaagauugggaucggcguccuucugaccuggcucggacucaauucuagauccacaagccugucuaugaccuguauugcugugggccuuguuacacucuaccugggggugaugguccaggccgauuccggaugcgugaucaacuggaaaggccgcgaacugaagugugggagcggaauuuucguuaccaaugaggugcacacauggaccgaacaauauaaguuucaggcugacuccccuaaacggcucucugccgcgaucggcaaggccugggaggagggggucugcggcaucagaagcgcuacgcgccuggaaaacauuauguggaaacagaucuccaacgagcuuaaucauauucugcucgaaaacgacaugaaguucacagugguugugggagaugucgccggcauccuggcucaggggaaaaagaugauucggccgcaacccauggagcacaaauacucuuggaaaagcuggggaaaggccaagaucaucggcgccgacgugcagaauaccaccuuuauuaucgaugggccuaacacacccgaauguccugacgaucagagagcuuggaauauuugggagguggaggacuauggauucggcaucuuuaccacgaacauuuggcugaaacuucgcgauuccuacacacaggucugcgaccaccggcucaugagcgcggccaucaaagauucuaaggcuguucaugccgacaugggcuauuggaucgaauccgagaaaaaugaaaccuggaagcuggccagagcuagcuucauugaggugaagacauguaucuggcccaaaucucacacccugugguccaacggggugcucgaaagcgagaugauuaucccgaagauuuacggaggcccuaucucucaacauaauuaucgccccggguacuucacacagaccgccggaccuuggcaccugggcaaacuugagcuggauuuugaccucugcgaagggacgaccgucgugguugaugagcacugcggaaaccggggccccagccugagaacaaccacagugaccggcaagaucauucaugaaugguguugccgguccuguacgcugccuccccuucgcuucagaggggaggacggaugcugguacggcauggagauccggccggucaaagaaaaggaggaaaaucucgucaagagcaugguuucugcgggguccggagagguggacagcuuuucccugggccugcucuguauuucuaucaugauugaagaggucaugagaagccgcuggucccggaaaaugcugaugacagggacccuugcuguguucuuucugcucaucaugggacagcugacauggaacgaucugauuagacuuugcaucaugguuggcgccaaugccucugaccgcaugggcauggggaccaccuaucuggcucucauggccacauucaagaugagaccuauguuugcggugggacugcuguuccggcgccugacgagcagagagguccuucugcucaccaucggccugucccugguggcuucuguggaacuucccaacagccuggaggaacucggggauggacuggccaugggcauuaugauccucaaacugcuuacagacuuucaaucccaccagcugugggccacccuccugagccugacauucauuaagaccacguuuucucuucauuacgcuuggaaaacaauggccaugguccuguccaucguuagccucuucccccugugucucucuaccaccucccagaagacaaccuggcugccugugcuucuggggagccugggaugcaagccgcucacaauguuucugauugcugagaauaaaaucuggggccggcgcucuuggccccuuaacgaaggcaucauggccguggggauugucuccauccugcucagcucccugcucaagaacgaugugccucuggcgggaccccuuauugccggcgggaugcugaucgcuuguuauguuauuagcggaucuagcgccgaccugucccucgagaaagcugccgaggugucuugggaagaggaagccgagcacagcggcgcuucccauaauauccuggucgaagugcaggaugacgggacgaugaagaucaaagaugaggagagagacgauacccuuacaauucugcucaaggcgacccugcucgccguuucuggaguguacccucugagcauccccgcuacacuuuucgucugguauuucuggcagaagaagaagcagcgguccggcgugcugugggacaccccuucucccccggaagucgagcgcgccgugcuggaugacggcauuuacagaaucaugcagcgggggcuccugggacgcagccagguuggcgugggggucuuucaagaaaacguguuccacacgauguggcacguuaccagaggagccgugcuuauguaucagggcaaacggcuggagccuuccugggcuagcgucaagaaagaccucauuucuuacgggggaggcuggagacugcagggcuccuggaauacaggggaggaaguccaggugaucgccguugagcccggaaagaacccuaaaaauguccaaaccgcgcccggcacauuuaagaccccggaaggggaggugggagcuauugcccucgauuucaagccuggcacaagcgggucucccaucgugaaccgcgaaggaaaaaucgucggccuguacggcaauggggugguuacgaccuccggaacauaugugagcgccauugcucaggccaaggcgucccaggagggcccucuucccgagaucgaagacgaggucuuucggaaaagaaaccugaccauuauggaucugcaucccgggucuggaaagacccgccgguaccucccugcuaucgugagagaagccauuaaacgcaagcugcggacacuuauccuggccccgacgagaguuguggcuagcgagauggccgaagcucucaagggcaugcccauccgcuaucaaaccacagccgucaaauccgagcacaccgggaaggagauuguggaccugaugugccaugcgacauucaccaugcggcugcucagcccuguuagagugcccaauuacaacaugaucauuauggaugaagcccacuuuacggacccuucuuccaucgcugcccggggcuauauuagcacacgcgucggaaugggcgaggcugccgccaucuucaugaccgcuacacccccugggucuguggaagcguuuccgcagagcaaugccgugauccaggaugaggaaagagacauucccgagcgguccuggaacucuggauacgaguggaucacagauuucccuggcaaaaccgucugguuuguucccagcauuaaguccgggaaugacaucgcuaacugucuucgcaaaaauggaaagagagugauucagcugucucggaagacauucgauaccgaauaucagaagacgaagaacaacgacugggacuacguggucacaaccgauaucagcgagaugggcgccaauuucagagccgaccgcgugauugauccucggagaugccugaaacccguuauccucaaggacgggccggaacgcgugauccuggcuggcccuaugcccgucacaguggccuccgcggcucagcggagaggacgcauuggccggaaccauaauaaagagggggaucaguacaucuauaugggacagccccuuaacaaugacgaggaucacgcccacuggaccgaagccaagaugcugcucgacaacauuaauacgccugagggcaucauucccgcucuguuugaaccugagagagaaaagagcgccgcgaucgauggggaguaccgccugagaggagaggcccggaaaaccuucguugaacucaugcgcagaggcgaccuuccgguguggcugucuuauaaggucgcuuccgagggguuucaauacagcgaucggcgcuggugcuucgacggcgaaagaaacaaucaggugcuggaggaaaacauggaugucgagaucuggacaaaagagggagaacggaagaaacucagaccccgcuggcuggacgcccggaccuauuccgacccucuugcucugagagaguuuaaggaguucgccgcuggccgccggucugugagcggggaucucauucuggagaucggaaaacugccccagcaucucacacagagagcccaaaaugcgcuugacaaccugguuaugcugcacaauuccgaacagggcgggcgggccuaccgccaugcuauggaggagcucccugauaccauugaaacacugaugcuucuggcccucaucgcugugcugaccggaggcgugacgcuguuuuuccucucuggcagagggcuuggaaagacaagcauuggccugcugugugucauguccagcucuguucuccuguggauggccuccguggagccccacuggaucgccgcuagcaucauucuugaauuuuuccugauggugcuccugaucccggagccugaccggcagcgcacaccccaggauaaccaacuggcguaugucgugauugggcuccuuuuuaugauccugaccguugccgcuaaugagaugggacugcucgaaacaaccaagaaagaccugggcauugggcacguggccgucgagaaccaucaccaugccgcuaugcuugauguggaccugcacccugccucugcguggacacucuacgccgucgcuacgaccaucauuacacccaugaugagacauaccaucgaaaacacaaccgccaauaucucccugacggcuauugccaaccaggcggccauccugaugggacucgauaagggcuggccuauuagccggauggacaucggcgugccccuucuggcucuggggugcuacucucagguuaauccgcucacccugacagccgcugugcuuaugcuggucgcccacuaugcuauuaucggaccuggccuccaagccaaagcgacccgcgaggcccagaagagaacagcugccgggaucaugaaaaaccccaccguggauggaauuguugcuaucgaccuggaucccguggucuacgacgccaaguucgaaaagcagcugggccagauuaugcuccuuauccuguguacgagccaaauucugcucaugcggacaaccugggcccugugcgaguccaucacacuugcgaccgggccucugaccacacucugggagggaucuccgggcaaauuuuggaauacgaccaucgcugugagcauggccaacauuuuccgcggcuccuaucuggcuggggccggacuggccuucagccucaugaagucccuuggcgggggaagacggggcacaggggcucagggagaaacccugggcgagaaauggaagagacagcugaaucagcucucuaaaagcgaauuuaacacauacaagcgcuccggcaucauggagguggaccggucugaagccaaggaggggcugaaaagaggagagaccacgaagcacgcgguuagccgcggcacagccaaacuucggugguucgucgaaagaaaucuggugaagcccgaggggaaagugauugaucucggauguggccgcgggggaugguccuauuacugcgcuggccugaagaaggucaccgaaguuaaaggcuauaccaaagggggaccuggccaugaggaacccaucccuauggccacauacggguggaaccuggugaaacuccacucuggaaaggacguguuuuucauucccccugagaaaugugauacccuucugugcgacaucggcgagagcuccccgaaucccacaauugaagaggggcggacgcugagaguccucaagaugguggaaccuuggcugcgcggaaaccaauuuuguaucaaaauccuuaaucccuacaugccuagcguuguggagacccuggagcagaugcagcggaagcauggcggcaugcucgucagaaacccccugucucgcaauuccacacacgaaauguauugggugagcugcgggaccggaaacauuguuucugcugugaauaugacaucccggaugcugcucaacagacugaccauggcccaccgcaagccgacguacgagagagaugucgaccuuggcgcggggacccggcauguggccguggaaccugaggucgcuaaccuggauaucauuggacagcgcaucgaaaauauuaaacacgagcauaagagcacauggcacuaugacgaggauaaccccuacaaaaccugggccuaucauggcucuuacgaaguuaagcccuccgggagcgcuuccagcauggugaauggaguggucaaacuccugacaaagccuugggacgugauccccaugguuacccaaaucgccaugacagauaccacgccuuucggccagcagagaguguuuaaggagaaagucgacacacggaccccgaaggcuaaaagaggcaccgcccaaauuauggaagugacagcgaaguggcuuuggggguuccugucucggaacaaaaagccccgcaucuguacgagagaggaauuuacccggaagguucgcagcaaugccgcuauuggagccguguucgucgacgagaaccaguggaacuccgcuaaagaggccguggaagaugagagauuuugggaccucguucaccgggaacgcgagcugcacaagcagggcaaaugcgccacaugcguguauaacaugauggggaagagagagaaaaagcugggagaguucggcaaggcgaaagggucucgggcuaucugguacauguggcucggcgcccgcuuucuggaguucgaagcccuuggauucaugaaugaggaucauugguuuagcagagaaaacucccugucuggcgucgagggggagggacuccacaagcugggcuacauucuucgggacaucagcaaaaucccugggggaaauauguaugcugaugacaccgccggcugggauacacgcauuaccgaagacgaucugcagaacgaggcuagaaucacagacauuauggaacccgagcaugcccuccuggcgaaguccaucuucaaacugaccuaccaaaauaaggugguccgggugcagcgcccugccaaaaacgggacgguuauggaugugauuucuagacgggaccagagaggcagcggacaggucggcaccuaugggcucaauacauuuaccaacauggaagcucaacugauccgccagauggaguccgagggaaucuucagccccucugaacuugagacaccgaaccuggccgaacgggugcucgauuggcuggagaaguacggcguggaaagacuuaagcgcauggcuauuuccggggacgacuguguugugaaaccuaucgaugaccgguuugccaccgcgcugacggcccucaaugauaugggaaaggucagaaaagacauuccccagugggagccuagcaagggcuggaacgauuggcagcaagugcccuucugcucucaccacuuucaucagcugaucaugaaagacgggcgcgagauuguugugccuugucggaaucaggaugaacuggucggcagagcucgcgugucccagggagccggcuggagccuccgggagacagcuugccuggggaaguccuaugcccaaauguggcagcuuauguacuuccacagacgcgaccugcggcucgcugccaacgcgaucuguucugccguccccguggauuggauuccgaccagcagaacaaccugguccauccaugcucaccaucaguggaugacgaccgaagacaugcugagcguuuggaaucggguguggaucgaggaaaacccuuggauggaggauaagacacacauuucuuccuggggagacguccccuaucuuggcaaaagagaggaccaauggugcgggagccugaucggacucaccgcccgcgccacaugggcuaccaauauucagguggccaucaaccagguucggagacugauuggcaaugaaaacuaccuggauuacaugacaucuaugaagcgcuuuaaaaaugagagcgaccccgaaggggcgcucugguga

SEQ ID NO: 18936 - RNA, 9879 nt, Artificial Sequence
  derived and/or modified CDS sequence (opt5) from DENV-1__FJ410231__SS-prME
agcgugaccaugcugcucaugcugaugcccacggcccuugcuuuccaccugacgaccagaggcggggaaccucauaugaucgucuccaagcaggaacggggaaagucucuccuguuuaagaccagcgccggcguuaauaugugcacccuuaucgcgauggaccugggggagcucugugaagauacaaugaccuacaagugcccgagaaucacagagguggaacccgacgauguggacuguuggugcaauaccacggauaccugggucacauauggaaccuguucccaaacaggcgagcaccggcgggacaagcgcucuguggcucuggccccucauguugggcugggacucgagaccagagccgaaacguggaugagcuccgagggcgcuuggaagcagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaggauaagcccacacuggacaucgaacugcucaaaaccgagguuacaaacccugcugugcugcggaaacuuugcauugaagccaaaaucuccaauaccacgacagauagccgcuguccgacccaaggagaggcgacccugguggaagaacaggacgccaacuucgucugcagacggacauuuguggaucgcggcuggggcaauggguguggacucuucggcaaggggucucugauuaccugcgcuaaguuuaaaugcguuacaaaacuugagggaaaaaucgugcaguacgaaaaccugaaguauuccgucaucgugacgguucacaccggcgaccagcaucaaguggggaaugagagcacagaacacggaaccacagccaccauuacgccccaggcuccuaccucugagauccagcucacagacuacggcgcccugacccuggauuguucccccagaacaggccucgacuucaacgaaaugguccugcuuaccaugaaagaaaaguccuggcuggugcauaaacagugguuucucgaucugccucuucccuggacguccggggccucuacaagccaagagaccuggaaucggcaggaccugcucgucacauucaagaccgcucacgcgaagaaacaggaagugguugugcugggaucccaagagggcgccaugcacaccgcucugacaggggccacggaaauucagaccagcggaacaaccacaaucuuugccggccaucucaagugccgccugaaaauggauaaacuuacccugaaagggaugucuuaugucauguguacgggcuccuucaagcucgagaaggaaguggcugagacacagcacggaaccguucuggugcagauuaaauacgagggcaccgacgccccgugcaagaucccuuucagcacacaagaugaaaaaggggucacccagaacggaagacugaucacagcgaaucccauugugacggacaaggagaaaccugugaacaucgaagcugagccgcccuuuggcgagucuuauauuguuaucggggccggagaaaaggcccuuaagcucagcugguucaaaaagggcuccucuauugggaaaauguuugaggcuaccgcccggggcgcuagacgcauggccauccugggagauacagcgugggacuucggcagcaucgggggagucuuuaccuccgugggcaagcuggugcaucagauuuucgggacagccuacggaguccucuuuagcggcgugucuuggaccaugaaaaucgggauuggcguucugcuuacguggcugggacucaauucccggagcaccucucuguccaugacauguaucgcugugggccuggucacccuuuaccucggggugaugguucaggccgauagcggaugcgugauuaacuggaagggcagagaacugaaguguggguccggaaucuucgucacaaaugaggugcacaccuggacagaacaauauaaauuucaggcugacucuccuaagcgccugagcgccgcgauuggcaaagccugggaggaggggguuugcggcauccgguccgcuaccagacucgaaaacaucauguggcgccagauuucuaacgagcugaaucauauccuucuggaaaacgacaugaaguucacgguggucgugggagauguggucggcauucucgcccaggggaaaaagaugauccggccgcaacccauggagcacaaauacagcuggaaguccuggggaaaggcuaaaauuaucggcgccgacguucagaauacaaccuuuaucauugaugggccuaacacccccgaauguccugacgaucagagagccuggaauaucugggagguggaggacuauggauucggcauuuuuacaaccaacaucuggcugaagcugcgcgauagcuacacacaggugugcgaccaccggcuuaugucugcugcgauuaaagauuccaaggccguccaugcugacaugggcuauuggaucgaaagcgagaaaaaugaaacauggaagcucgccagagccucuuucaucgaggugaagaccuguauuuggcccaaaucccacacacuguggagcaacgggguucuggaaucugagaugaucauuccgaagaucuacggaggcccuauuagccaacauaauuaucgccccggguacuucacccagacagcuggaccuuggcaccucggcaaacuggagcuugauuuugaccugugcgaagggaccacgguggucguggaugagcacugcggaaaccggggccccucccucagaaccacaaccguuacaggcaagaucauccaugaaugguguugccggagcuguacccugccuccccugcgcuucaaaggggaggacggaugcugguacggcauggagauuagaccggugaaggaaaaggaggaaaaucuugucaaaucuaugguguccgccgggagcggagagguugacuccuuuucucucggccugcuguguaucagcauuaugaucgaagaggugaugcgguccagauggucucgcaagaugcucaugacggggacacuggcggucuucuuucuucugauuaugggacagcucaccuggaacgaucugauccggagcugcauuauggugggcgcuaaugccuccgacagaaugggcauggggacaaccuaucuggcccuuauggcuaccuucaaaaugcgcccuauguuugccgugggacuccuguucagacggcugacaucucgcgagguccuccugcuuacgaucggccugagccucguugcguccguggaacugcccaacagccuggaggaacuuggggauggacuggcuaugggcaucaugauucucaagcugcucaccgacuuucaaucuuaccagcugugggccacacuucugucccucaccuucaucaaaacaaccuuuagccugcacuaugccuggaagacgauggcuauggugcugucuauugucucccuucugccccucugucugagcacaaccucucagaagaccacauggcucccugugcugcuugggucccugggaugcaaaccgcugaccauguuccucaucgccgagaauaagauuuggggcagaaaaagcuggccccugaacgaaggcaucauggcuguugggaucguguccauucuucugagcucucuccugaagaacgaugucccucucgccggaccccugaucgcgggcgggaugcuuauugccuguuacgugaucagcggauccucugcugaccugagccuggagaaagccgcugagguuuccugggaagaggaagccgagcauucuggcgccagccacaauauucucguggaaguccaggaugacgggacaaugaagaucaaagaugaggagcgggacgauacgcugaccauccuucugaaggcuacacuccuggcgguguccggagucuauccucucucuauucccgccacccuguuugugugguacuucuggcaaaagaaaaagcagcgcagcggcguucuuugggacacaccuagcccucccgaaguggagagagcuguccuggaugacggcaucuaucggauuaugcagcgcgggcugcucggaagaagccaggugggcguugggguguuccaagaaaacgucuuucauaccauguggcacgugacgcggggagccgugcugauguaccagggcaaacgccuugagcccucuugggccuccguuaagaaagaccugaucagcuacgggggaggcuggagacuccagggcucuuggaauaccggggaggaaguccaggugauugcuguggagcccggaaagaacccuaagaauguccaaacagcccccggcaccuucaaaacaccggaaggggaggugggagcgaucgcucuggauuuuaagccuggcaccuccgggagccccauuguuaaccgggaaggaaaaaucgugggccucuauggcaauggggucgugacaacguccggaaccuacguuucugccaucgcccaggcuaaggccagccaggagggcccucugcccgagauugaagacgagguguucagaaaacgcaaccuuacaaucauggaucugcaccccggguccggaaagacccggagauaucugccugcgauuguccgcgaagcuaucaagcggaaacucagaacccugauucuugccccgacacgcgugguugccagcgagauggcugaagcccugaagggcaugcccauccgguaccaaacgaccgcugugaaaucugagcauacagggagagagaucgucgaccucaugugccacgccaccuuuacaaugcgccugcuguccccugugcgggugcccaauuauaacaugauuaucauggaugaagcgcauuucaccgacccuagcucuauugccgcuagaggcuacaucagcacgcgggucggaaugggcgaggccgcugccauuuuuaugacagccacacccccuggguccguugaggcuuucccgcagucuaaugcggugauccaggaugaggaacgcgacauccccgagagaagcuggaacuccggauaugaguggauuaccgauuuuccuggcaagacagugugguucguccccucuaucaaaagcgggaaugacauugccaacugucuccggaagaauggaaagcgcgugauccagcuuuccagaaaaaccuuugauacagaauaccaaaagaccaaaaacaacgacugggacuacguugugacgacagauauuagcgagaugggcgcuaauuuccgggccgacagagucaucgauccucgccggugccugaagcccgugauucugaaagacgggccggaaagaguuauccucgccggcccuaugcccgugaccgucgcuucugccgcgcagcgccggggaagaaucggccgcaaccacaauaaggagggggaucaguauauuuacaugggacagccccugaacaaugacgaggaucaugcucacuggacagaagccaagaugcuucuggacaacaucaauaccccugagggcauuauccccgcccucuucgaaccugagcgggaaaaauccgcugccauugauggggaguauagacugcgcggagaggcgagaaagacguuuguggaacugaugcggcgcggcgaccucccggucuggcuuagcuacaaaguggccuccgagggguuccaauauucugauagacgguggugcuuugacggcgaacgcaacaaucagguucuggaggaaaacauggauguggagaucuggaccaaggagggagaacgcaagaagcugcggcccagauggcucgacgcucgcacauacagcgacccucuggcccuucgggaguucaaagaauuugcugccggcagacgcuccgugucuggggaucugauccucgagauuggaaagcugccccagcaccugacccagcgggcucaaaaugcccucgacaaccuugucaugcugcauaauagcgaacagggcgggagagcguaucggcacgccauggaggagcugccugauacaaucgaaacccucaugcugcuugcucugauugccguucucacaggaggcgugacccuguucuuucuguccggcaaggggcucggaaaaacgagcaucggccuucugugugugauggcuucuuccgcccugcucuggauggccagcgucgagccccauuggauugcugcgucuaucauccuggaguucuuucuuauggugcugcucauuccggagccugaccgccagagaacaccccaggauaaccaacuggccuacguugugaucgggcuccuguucaugauucuuaccgucgcugccaaugagaugggacugcuggaaaccacaaagaaagaccucggcaucgggcacguggccgucgagaaccaccaucacgcuaccaugcuggauguggaccuucauccugccuccgcguggacacuguacgccguugcuacgaccauuaucacacccaugaugcggcacaccauugaaaacacaaccgccaauaucagccucacggcuaucgccaaccaggcggccauucugaugggacuggauaagggcuggccuaucucuaaaauggacauuggcgugccccuccuugcucuggggugcuauagccaggucaauccgcugacccucacagccgcugugcugaugcuuguugcccauuacgcuaucauuggaccuggccugcaagccaaggcgacccgcgaggcccagaagagaacagcugccgggaucaugaaaaaccccaccguggauggaaucgucgcuauugaccucgaucccgugguguaugacgccaaguuugaaaaacagcugggccagaucaugcugcucauucuuuguacgucccaaauccugcugaugcggacaaccugggcccucugcgagucuauuacacuggcgaccgggccucuuaccacacugugggagggaagcccgggcaaguucuggaauacgaccaucgcuguuuccauggccaacaucuuucgcggcagcuaccucgcuggggccggacuggccuucucccugaugaaaucucucggcgggggaagacggggcacaggggcucagggagaaacccuuggcgagaaguggaagcgccagcugaaucagcugagcaaauccgaguucaacacauauaagagaucuggcauuauggaggucgaccggagcgaagccaaagaggggcucagacgcggagagaccacgaagcacgcggugucccggggcacagccaaacugagaugguuuguggaacgcaaucuugucaagcccgaggggaagguuaucgaucugggauguggcagaggcggguggucuuacuauugcgcugggcucaaaaaggugaccgaagugaaaggcuacaccaaagggggaccuggccacgaggaacccauuccuauggccacauacggguggaaccuggucaaacugcauagcggaaaggacguguucuuuauucccccugagaaaugugauacccuccuuugcgacauuggcgaguccagcccgaaucccacaaucgaagaggggagaacgcugcgcguucugaagaugguggaaccuuggcuccggggaaaccaauucuguauuaagauccugaaucccuauaugccuucugucguggagacccuugagcagaugcagagaaaacacggcggcaugcugguucgcaacccccucucccggaauagcacacaugaaauguacugggugucuugcgggaccggaaacaucgucuccgcugugaauaugacaagcagaaugcugcugaaccgcuuuaccauggcccaccggaagccgacguaugagagagauguggaccucggcgcggggacccgccacgucgccguugaaccugagguggcuaaccuggauauuaucggacagagaauugaaaauaucaaacaugagcacaagucuacauggcauuacgacgaggauaaccccuauaaaaccugggccuaccacggcuccuaugaagugaagcccagcggguccgcuagcucuauggucaauggagugguuaaacuucugacaaaaccuugggacgugauucccauggucacccaaaucgccaugacagauaccacgccuuucggccagcagcggguguuuaaggagaaaguugacacacgcaccccgaaggcuaaaagaggcaccgcccaaaucauggaagugacagcgaaguggcucuggggguuccugagccggaacaagaaacccagaauuuguacgcgggaggaauuuacccgcaaggucagauccaaugccgcuaucggagccguguucguugacgagaaccaguggaacucugcuaaagaggccguggaagaugagcgguuuugggaccuuguccaucgcgaaagagagcugcacaagcagggcaaaugcgccacaugcguguacaacaugauggggaagcgggaaaagaaacucggagaguucggcaaggcgaaagggagccgcgcuauuugguacauguggcugggcgccagauuucuggaguucgaagcccucggauucaugaaugaggaucacugguuuucccgggaaaacucucugagcggcgucgagggggagggacuucauaagcugggcuauauccuccgcgacauuuccaaaaucccugggggaaauauguacgcugaugacaccgccggcugggauacaagaaucaccgaagacgaucugcagaacgaggcuaagauuacagacaucauggaacccgagcacgcccuucuggcgaccucuauuuucaaacucacguaucaaaauaaggugguucgggugcagcgcccugccagaaacgggaccgucauggaugugaucagccggcgcgaccagagaggcuccggacaggugggcacauacgggcugaauaccuuuacaaacauggaagcucaacugauucggcagauggagagcgagggaaucuucucucccuccgaacucgagaccccgaaccuggccgaaagaguucuugauuggcuggagaagcauggcguggaacgccucaaacggauggcuaucagcggggacgacugugucgugaagccuauugaugacagauuugccacggcgcugucugcccuuaaugauaugggaaaaguucgcaaggacaucccccagugggagccuuccaaaggcuggaacgauuggcagcaagugcccuucugcagccaccacuuucaucagcugauuaugaaggacgggcgggagaucgucgugccuuguagaaaucaggaugaacucgucggccgcgcucgggugucccagggagccggcuggucucugagagagacagcuugccugggaaagagcuaugcccaaauguggcagcucauguacuuccaccgccgggaccugagacuugcugccaacgcgauuuguuccgccguucccguggauugggucccgaccagccgcacaaccuggucuauccaugcucaccaucaguggaugacgaccgaagacaugcuguccguguggaaucggguuuggauugaggaaaacccuuggauggaggauaaaacacacaucagcucuuggggagacgugcccuaucucggcaagagagaggaccaauggugcgggagccugaucggacuuaccgcccgggccacaugggcuaccaauauucaggucgccaucaaccaggugagacgccugauuggcaaugaaaacuaccucgauuacaugacauccaugaaacgguuuaagaaugagucugaccccgaaggggcgcugugguga

SEQ ID NO: 18937 - RNA, 9879 nt, Artificial Sequence
  derived and/or modified CDS sequence (opt5) from DENV-1__FJ461323__SS-prME
agcgugaccaugcugcucaugcugaugcccaccgcccuugcuuuccaccugacgaccagaggaggggaaccucauaugaucgucuccaagcaggaacggggaaaaucucuccuguuuaagaccagcgccggcguuaacaugugcacccuuauugccauggaccugggggaacucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucuguugcccuggcuccucauguggggcugggacucgagacaagaaccgaaacguggaugagcuccgagggcgccuggaaacagauucagcggguugaaacaugggugcugcgccaccccggcuucaccgucaucgcucuuuuucuggcccaugcgauugggacaucuaucacccagaagggaaucauuuucauccuccugaugcuugugaccccuagcauggccaugagaugcguuggcauugggucccgggauuuuguggagggacugagcggcgcuacaugggucgacguggugcucgagcacgggucuugugucacgaccauggccaaggauaaacccacacuggacaucgaacugcucaagaccgagguuacaaacccugcugugcugcgcaaacuuugcauugaagccaagaucuccaauaccacgacagauagcagauguccgacccaaggagaggcgacccugguggaagaacaggacgccaacuucgucugccggcgcacauuuguggauagaggcuggggcaauggguguggacucuucggcaaagggucucugauuaccugcgcuaaguuuaagugcguuacaaaacuugagggaaagaucgugcaguacgaaaaccugaaauauuccgucaucgugacgguucacaccggcgaccagcaucaaguggggaaugagagcacagaacacggaaccacagccaccauuacgccccaggcuccuaccacagagauccagcucaccgacuacggcgcccugacacuggauuguucuccccggaccggccucgacuucaacgaaaugguccugcuuacgaugaaggagaaauccuggcuggugcauaagcagugguuucucgaucugccucuucccuggacaagcggggccuccaccucucaagagacauggaaucgccaggaccugcucgucaccuucaaaaccgcucacgcgaagaagcaggaagugguugugcugggaagccaagagggcgccaugcacacagcucugacgggggccaccgaaauucagacauccggaaccacaaccaucuuugccggccaucucaaaugcagacugaagauggauaaacuuacgcugaaggggaugagcuaugucauguguacaggcucuuucaaacucgagaaggaaguggcugagacccagcacggaaccguucuggugcagauuaaguacgagggcacagacgccccgugcaaaaucccuuucuccacccaagaugaaaagggggucacacagaacggacggcugaucacggcgaaucccauugugaccgacaaagagaagccugugaacaucgaagcugagccgcccuuuggcgagagcuauauuguuaucggggccggagaaaaagcccuuaagcucucuugguucaagaaaggcagcuccauugggaagauguuugaggcuacagccagaggcgcucgccggauggccauccugggagauaccgcgugggacuucggcucuaucgggggagucuuuacaagcgugggcaaacuggugcaucagauuuucgggaccgccuacggaguccucuuuuccggcgugagcuggacgaugaagaucgggauuggcguucugcuuaccuggcugggacucaauucuagauccacaagccugucuaugaccuguaucgcugugggccuggucacacuuuaccucggggugaugguucaggccgauuccggaugcgugauuaacuggaaaggccgcgaacugaagugugggagcggaaucuucgucaccaaugaggugcacacauggaccgaacaauauaaguuucaggcugacuccccuaaacggcugucugccgcgauuggcaaggccugggaggaggggguuugcggcaucagaagcgcuacgcgccucgaaaacaucauguggaaacagauuuccaacgagcugaaucauauccuucuggaaaacgacaugaagcucacaguggucgugggagauguggccggcauucuggggcagggcaagaagaugauccggccgcaacccauggaguacaaauauucuuggaaaagcuggggcaaggcuaagauuaucggggccgacgcccagaauaccaccuucaucauugauggaccuaacacacccgaauguccugacgaucagagagcuuggaauaucugggaggucgaggacuacggcuuuggcauuuucaccacgaacaucuggcugaaacuucgcgauuccuauacacagguuugcgaccaccggcucaugagcgcggccauuaaagauucuaaggcugugcacgccgacaugggguacuggaucgaauccgagaaaaaugaaaccuggaagcuggccagagcuagcuuuaucgaggugaagacauguauuuggcccaaaucucauacccugugguccaacggaguccucgaaagcgagaugaucauuccgaagaucuauggcgggccuauuucucaacacaauuaccgccccggauacuucacacagaccgccggcccuuggcaucuggggaaacuugagcuggauuucgaccucugcgaaggaacgaccgugguuguggaugagcacugcggcaaccggggccccagccugagaacaaccacagucaccgggaagaucauccacgaaugguguugccgguccuguacgcugccuccccuucgcuuuagaggagaggacggcugcugguaugggauggagauucggccggugaaagaaaaggaggaaaaucucguuaagagcauggugucugcgggauccggcgaggucgacagcuucucccuggggcugcucuguaucucuauuaugaucgaagaggugaugagaagccgcuggucccggaaaaugcugaugacaggaacccuugcugucuuuuuccugcucauuaugggccagcugacauggaacgaucugaucagacuuugcauuauggugggcgccaaugccucugaccgcauggggaugggaaccaccuaccuggcucucauggccacauuuaagaugagaccuauguucgcggucggccugcucuuucggcgccugacgagcagagaggugcuucugcucaccaucgggcugucccugguggcuucugucgaacuucccaacagccuggaggaacucggagauggccuggccauggggaucaugauucucaaacugcuuacagacuuccaaucccaucagcugugggccacccuccugagccugacauuuaucaagaccacguucucucuucacuaugcuuggaaaacaauggccaugguucuguccauugugagccucuuuccccugugucucucuaccaccucccagaagacaaccuggcugccugugcuucugggaagccugggcugcaagccgcucacaauguuccugaucgcugagaauaaaauuuggggccggaagucuuggccccuuaacgaagggaucauggccgucggaaucguguccauucugcucagcucccugcucaaaaacgauguuccucuggcgggcccccuuaucgccgggggaaugcugauugcuuguuacgugaucagcggcucuagcgccgaccugucccucgagaaggcugccgaggucucuugggaagaggaagccgagcauagcggggcuucccacaauauucugguggaaguucaggaugacggaacgaugaaaaucaaggaugaggagcgcgacgauacccuuacaauccugcucaaagcgacccugcucgccgugucuggcgucuauccucugagcauucccgcuacacuuuuugugugguacuucuggcaaaagaagaaacagagauccggcguccugugggacaccccuucucccccggaaguggagcgggccguucuggaugacgggaucuaucgcauuaugcagagaggacuccugggccggagccaggugggggucggaguguuccaagaaaacguuuuucauacgauguggcacgugacccgcggcgccguccuuauguaccaggggaagagacuggagccuuccugggcuagcgugaaaaaggaccucaucucuuacggaggcggcuggcggcugagaggguccuggaauacaggagaggaagugcagguuauugccgucgagcccggcaaaaacccuaagaaugugcagaccgcgcccgggacauucaagaccccggaaggagaggugggcgcuaucgcccucgauuuuaaaccugggacaagcggaucucccauugucaaccgcgaaggcaagaucgugggccuguaugggaauggaguugugacgaccuccggcacauacgucagcgccaucgcucaagccaaagcgucccaggaggggccucuucccgagauugaagacgagguguuccggaagagaaaccugaccaucauggaucugcaccccggaucuggcaaaacccgccgguaucucccugcuauuguuagagaagccaucaagcgcaagcugcggacacuuauucuggccccgacgagaguggucgcuagcgagauggccgaagcucucaaagggaugcccauccgcuaccagaccacagccgugaaguccgagcauaccggcaaagagaucguugaccugaugugccacgcgacauuuaccaugcggcugcucagcccugugagaguccccaauuauaacaugauuaucauggaugaagcccauuucacggacccuucuuccauugcugcccggggauacaucagcacacgcgugggcaugggggaggcugccgccauuuuuaugaccgcuacacccccuggaucuguggaagcguucccgcaaagcaaugccgucauccaggaugaggaaagagacauccccgagcgguccuggaacucuggcuaugaguggauuacagauuuuccugggaagaccguuugguucgugcccagcaucaaauccggaaaugacauugcuaacugucuucgcaagaauggcaagagagugauccagcugucucggaaaacauuugauaccgaauaccagaagacgaaaaacaacgacugggacuacgucgugacaaccgauauuagcgagaugggggccaauuucagagccgaccgcguuaucgauccucggagaugccugaagcccgugauucucaaagacggcccggaacgcgucauccuggcuggaccuaugcccgugacaguugccuccgcggcucaacggagaggccgcaucgggcggaaccacaauaaggagggagaucaguauauuuacaugggccagccccuuaacaaugacgaggaucaugcccacuggaccgaagccaagaugcugcucgacaacaucaauacgccugaggggauuauccccgcucuguucgaaccugagagagaaaagagcgccgcgguggauggagaguaucgccugagaggcgaggcccggaagaccuuugucgagcucaugcgcagaggggaccuuccgguguggcugucuuacaaagucgcuuccgagggcuuccaguauagcgaucggcgcuggugcuuugacggagaaagaaacaaucaagugcuggaggaaaacauggauguugagauuuggacaaaggagggcgaacggaaaaagcucagaccccgcuggcuggacgcccggaccuacuccgacccucuugcucugagagaguucaaagaauuugccgcugggcgccggucugugagcggagaucucauccuggagaucggcaagcugccccagcaccucacacagagagcccagaaugcgcuugacaaccuggugaugcugcauaauuccgaacaagggggacgggccuaucgccacgcuauggaggagcucccugauaccauugaaacacugaugcuucuggcccucaucgcuguccugaccggcggcguuacgcuguucuuucucucugggagaggacuuggcaagacaagcauugggcugcugugugugauggccuccagcgugcuccuguggauggccucugucgagccccauuggaucgcugcguccauuauccuugaguucuuucugauggugcuccugaucccggagccugaccggcagcgcacaccccaggauaaccagcuggccuacguugugauuggacuccuuuucaugauccugaccgucgcugccaaugagaugggccugcucgaaacaaccaaaaaggaccuggggauuggacacguggccgucgagaaccaccaucacgcugccaugcuugauguggaccugcauccugcgagcgccuggacacucuacgcuguugccacgaccaucauuacacccaugaugagacacaccaucgaaaacacaaccgcuaauauuucucugacggccaucgcgaaccaagccgcuauccugaugggccucgauaaaggcuggccuauuuccaagauggacaucggggugccccuucuggcccugggaugcuauagccaggucaauccgcucacccugacagcugccgugcuuaugcugguugcucauuacgccauuaucggcccugggcuccaggcgaaagccacccgggaggcucaaaagcgcacagccgcuggaauuaugaagaaccccaccguggauggcaucgucgccaucgaccuggaucccgugguguaugacgccaaauuugaaaagcagcuggggcagauuaugcuccuuauccuguguacgucucagauucugcucaugagaacaaccugggcgcugugcgagagcaucacacuugcuaccggaccucugaccacacucugggagggcuccccgggcaaauucuggaauacgaccauugccguuucuauggcuaacaucuuucgggggagcuaccuggccggagccggccuggcuuucucccucaugaaaagccuugggggaggccgcagagggacaggagcccaaggcgaaacccugggcgagaaauggaagcggcagcugaaucagcucuccaagucugaguucaacacauauaaaagaagcgggaucauggaggucgaccgcuccgaagcgaaggagggacugaaacggggcgagaccacgaagcacgccgugucuagagggacagcuaaacuucgcugguuuguggaacggaaucuggucaagcccgagggaaagguuauugaucucggcugugggagaggaggcuggagcuacuauugcgccggccugaaaaaggugaccgaagugaaaggguacaccaagggaggcccugggcacgaggaacccaucccuauggcuacauacggauggaaccuggucaaacuccauuccggcaaggacguguucuuuauucccccugagaaaugugauacccuucugugcgacaucggggagucuagcccgaaucccacaauugaagagggacgcacgcugcggguucucaagaugguggaaccuuggcugagaggcaaccaguucuguaucaagauucuuaaucccuauaugccuuccgucguggagacccuggagcaaaugcagcgcaaacacggcgggaugcucguucggaacccccugagcagaaauucuacacaugaaauguacuggguguccugcggaaccggcaacaucgucagcgccgugaauaugacaucucgcaugcugcucaaccgguuuaccauggcgcacagaaagccgacguaugagcgcgauguggaccuggggaccggaacaagacacgucgccguugaaccugagguggcuaaccuugauaucauuggccagcggaucgaaaauauuaaacaugagcacaaguccaccuggcauuacgacgaggauaaccccuauaaaacaugggccuaccacgggagcuaugaagugaagcccucuggauccgcuagcuccauggucaauggcgugguuaagcugcucaccaaaccuugggacgugauccccauggucacacagauugccaugaccgauacgacaccuuucggccaacagcgcguguuuaaggagaaaguugacaccagaaccccgaaggcuaaacgggggacagcccagaucauggaagugacggcgagauggcuguggggauuccuuagccggaacaagaagccccgcaucuguaccagagaggaauuuacacggaaaguccgcucuaaugccgcuauuggcgccguguucguugacgagaaccaauggaauagcgcuaaggaggccguggaagaugagagauuuugggaccugguccaucgggaacgcgagcuccacaaacaggggaagugcgcgaccugcguguacaacaugaugggaaaaagagaaaagaagcugggcgaguucgggaaagcgaagggcucccgggcuaucugguacauguggcugggagcccgcuuucucgaguucgaagcccugggcuucaugaaugaggaucacugguuuucuagagaaaacagccuuuccggggucgagggagagggccugcauaaacucggguauauucugcgggacaucucuaagauuccuggaggcaauauguacgcugaugacacagccgggugggauacccgcaucacagaagacgaucuucagaacgaggcuaaaaucaccgacauuauggaacccgagcacgcccugcucgcgaaggccaucuucaaacugacguaucagaauaaggugguuagagugcaacggccugcuaagaacggcaccgucauggaugugauuagccgcagagaccagcggggauccggccagguggggacauacggacugaauaccuuuacaaacauggaagcccagcucaucagacaaauggagucugagggcauuuucagccccuccgaacuggagaccccgaaccuugcugaacgcgcccuggauuggcucgagaaauaugggguugaacggcugaagagaauggcgaucagcggagacgacuguguggucaaaccuaucgaugaccgcuuugccacggcucuuacagcccugaaugauaugggcaaggugcggaaagacauuccccagugggagccuucuaagggguggaacgauuggcagcagguucccuucugcucccaucacuuucaccaacucaucaugaaggacggcagagagauuguggucccuugucgcaaucaggaugaacuggugggacgggcuagagucagccagggcgccggguggucucugcgcgagaccgcuugccucggaaaauccuacgcccagauguggcaacugauguauuuccaucggagagaccuucgccuggcggccaacgcuaucuguagcgccgugcccguugauugggugccgacaucccggaccacguggucuauucacgcccaucaccaguggaugaccacagaagacaugcucagcgucuggaauagaguguggaucgaggaaaacccuuggauggaggauaagacccauauuuccagcugggaggacguucccuaccugggcaaacgggaagaccaguggugcgggucucuuaucggacugacagcuagagccaccugggcgacaaauauccaaguggcuauuaaccagguccgccggcucaucggcaaugagaacuaccuggauuauaugaccuccaugaagagauuuaaaaaugaaacggaccccgagggggcccugugguga

SEQ ID NO: 18938 - RNA, 9879 nt, Artificial Sequence
  derived and/or modified CDS sequence (opt5) from DENV-1__FJ461325__SS-prME
agcgugaccaugcugcucaugcugaugcccaccgcccuugcuuuccaccugacgaccagaggaggggaaccucauaugaucgucuccaagcaggaacggggaaaaucucuccuguuuaagacaagcgccggcguuaacaugugcacccuuaucgcgauggaccugggggaacucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccaggccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucagaggggaggacggaugcugguauggcauggagauucggccggugaaagaaaaggaggaaaaucuuguuaagagcauggugucugcuggguccggagaggucgacagcuuuucccucggccugcuguguaucucuauuaugaucgaagaggugaugagaagccgcuggucccggagaaugcucaugacagggacccuggccguuuucuuucuucugauuaugggacagcucacauggaacgaucugauccgccugugcauuauggugggcgccaaugcuucugacagaaugggcauggggaccaccuaccuugcccugauggcgacauucaaaaugcggccuauguuugcugucggacuccuguuccgcagacucacgagccgggaggugcugcuucugaccaucggccucucccugguggccucugucgaacugcccaacagccuugaggaacugggggauggacucgccaugggcaucaugauucugaagcuccugacagacuuucaaucccaucagcuuugggcuacccugcucagccugacauucaucaaaaccacguuuucucugcacuaugccuggaagacaauggcuaugguucuuuccauugugagccuguucccccucugucugucuaccaccucccagaaaacaaccuggcucccugugcugcuugggagccugggaugcaagccgcugacaauguuucucaucacggagaauaagauuuggggccgcagaucuuggccccugaacgaaggcaucauggccgucgggaucguguccauucuucugagcucccuccugaaaaacgauguuccucucgcgggaccccugaucgccggcgggaugcuuauugcuuguuacgugaucagcggaucuagcgccgaccugucccuggagaaggcugccgaggucucuugggaagaggaagccgagcauagcggcgcuucccacaauauucucguggaaguucaggaugacgggaccaugaaaaucaaggaugaggagcgggacgauacacugaccauccuucugaaagcgacacuccuggccgugucuggagucuauccucucagcauucccgcuacccuguucgugugguacuucuggcaaaagaaaaagcagcgcuccggcguccuuugggacacgccuucucccccggaaguggagagagccguucuggaugacggcaucuaucggauuaugcagcgcgggcugcucggaagaagccaggugggcgucgggguguuucaagaaaacguuuuccauaccauguggcacgugacacggggagccguccugauguaccagggcaagagacuugagccuuccugggcuagcgugaaaaaggaccugaucucuuacgggggaggcuggcgccuccagggcuccuggaauaccggggaggaagugcagguuauugccgucgagcccggcaagaacccuaagaaugugcaaacagcgcccggcaccuuuaaaacaccggaaggggaggugggagcuaucgcccuggauuucaagccuggcacgagcgggucucccauugucaaccgggaaggaaagaucgugggccucuauggcaaugggguugugaccacauccggaaccuacgucagcgccaucgcucaggccaaagcgucccaggagggcccucugcccgagauugaagacgagguguuuagaaagcgcaaccuuaccaucauggaucugcaccccgggucuggaaaaacacggagauaucugccugcuauuguucgcgaagccaucaagcggaaacucagaacgcugauucuugccccgacccgcguggucgcuagcgagauggccgaagcucugaagggcaugcccauccgguaccaaacaaccgccgugaaguccgagcauacagggaaagagaucguugaccucaugugccacgcgaccuucacgaugagacugcugagcccugugcggguccccaauuauaacaugauuaucauggaugaagcccauuuuacagacccuucuuccauugcugcccgcggcuacaucagcaccagagugggaaugggcgaggcugccgccauuuucaugaccgcuacacccccugggucuguggaagcguuuccgcagagcaaugccgucauccaggaugaggaacgggacauccccgagcgcuccuggaacucuggauaugaguggauuaccgauuucccuggcaagacaguuugguuugugcccagcaucaaauccgggaaugacauugcuaacugucucagaaagaauggaaaacgggugauccagcuuucuagaaagaccuucgauacggaauaccaaaagaccaagaacaacgacugggacuacgucgugaccacagauauuagcgagaugggcgccaauuuccgcgccgaccggguuaucgauccuagacgcugccugaagcccgugauucugaaagacgggccggaacgggucauccucgcuggcccuaugcccgugaccguugccuccgcggcucagagacgcggacggaucggcagaaaccacaauaaggagggggaucaguauauuuacaugggacagccccugaacaaugacgaggaucaugcccacuggacggaagccaaaaugcuucuggacaacaucaauaccccugagggcauuauccccgcucucuuugaaccugagcgcgaaaagagcgccgcgauugauggggaguauagacugcggggagaggcccgcaagacauucguggaacugaugagacggggcgaccucccggucuggcuuucuuacaaaguggcuuccgagggguuucaauauagcgaucgcagauggugcuucgacggcgaacggaacaaucagguccuggaggaaaacauggauguggagaucuggaccaaggagggagaacgcaaaaagcugcgcccccgguggcucgacgccagaacauacuccgacccucuggcucuuagagaguuuaaagaguucgccgcuggccggagaucuguuagcggggaucugauccucgagauuggaaagcugccccagcaccugacccagcgggcccaaaaugcgcucgacaaccuugugaugcugcauaauuccgaacagggcgggcgcgccuauagacacgcuauggaggagcugccugauacaaucgaaacccucaugcugcuugcccugauugcugugcucacgggaggcgucacacuguuuuuccugucuggccgggggcucggaaaaaccagcaucggccuucuguguguuauggccuccagcgugcugcucuggauggccucuguggagccccauuggauugcugcguccaucauccuggaauuuuuccuuaugguccugcucauuccggagccugaccgccagagaacaccccaggauaaccaacuggccuacgugguuaucgggcugcucuuuaugauucuuacaguggcugccaaugagaugggacugcuggaaaccacaaagaaggaccucggcaucgggcacgucgccguggagaaccaccaucacgcugccaugcuggaugucgaccuucauccugcgagcgccuggacgcuguacgcuguggccaccacaauuaucacccccaugaugcggcacacaauugaaaacaccacggcuaauaucucucucaccgccaucgcgaaccaggccgcuauucugaugggacuggauaaaggcuggccuaucuccaagauggacauuggcguuccccuccuugcccuggggugcuauagccaggugaauccgcugacacucaccgcugccguccugaugcuuguggcucauuacgccaucauuggaccuggccugcaagcgaaagccacacgcgaggcucagaagagaaccgccgcugggaucaugaaaaaccccacgguugauggaaucguggccauugaccucgaucccgucguguaugacgccaaguucgaaaagcagcugggccagaucaugcugcucauucuuuguacaucucaaauccugcugaugcggaccacaugggcgcucugcgagagcauuacccuggcuaccgggccucuuacaacgcugugggagggauccccgggcaaauuuuggaauaccacaaucgccgugucuauggcuaacaucuuccgcggcagcuaccucgccggggccggacuggcuuucucccugaugaaaagccucggcgggggaagacggggcaccggggcccagggagaaacacuuggcgagaaauggaagagacagcugaaucagcuguccaaaucugaauuuaacaccuauaagcgcagcggcauuauggagguugaccgguccgaagcgaaggaggggcucaaaagaggagagacgacaaagcacgccgucucucgcggcaccgcuaaacugcggugguucguggaaagaaaucuugugaagcccgaggggaaagucaucgaucugggauguggccgcgggggauggagcuacuauugcgccggccucaagaagguuaccgaagugaaaggcuacacaaaaggcgggccugggcacgaggaacccauuccuauggcuaccuacggguggaaccuggugaaacugcauuccggaaaggacgucuuuuucauucccccugagaaaugugauacacuccuuugcgacauuggcgagucuagcccgaaucccacgaucgaagaggggcggacccugagagugcugaagaugguugaaccuuggcuccgcggaaaccaauuuuguauuaaaauccugaaucccuauaugccuuccguggucgagacacuugagcagaugcagcggaagcacggcggcaugcuggugagaaacccccucagccgcaauucuacccaugaaauguacuggguuuccugcgggacaggaaacaucgugagcgccgucaauaugaccucucggaugcugcugaacagauucacgauggcgcaccgcaagccgaccuaugagagagauguggaccucggcgccgggacacggcacguggcugucgaaccugagguugccaaccuggauauuaucggacagcgcauugaaaauaucaaacaugagcacaaguccaccuggcauuacgacgaggauaaccccuauaaaacaugggcuuaccacggcagcuaugaagugaagcccucuggguccgccagcuccauggugaauggagucgugaaacuucugaccaagccuugggacguuauucccauggugacacaaaucgcuaugaccgauacgacaccuuuuggccagcagagagucuucaaggagaaaguggacacccggaccccgaaggccaaaagaggcacagcgcaaaucauggaaguuacggccaaguggcucuggggguuucugagccggaacaaaaagccccgcauuuguaccagagaggaguucacacggaaggugcgcucuaaugcugccaucggagcugucuuuguggacgagaaccaguggaauagcgccaaagaggccguugaagaugagagauucugggaccuugugcaucgggaacgcgagcugcacaagcagggcaaaugcgcgaccugcgucuacaacaugauggggaagagagagaaaaagcucggagaguuuggcaaggcuaaagggucccgggccauuugguacauguggcugggcgcccgcuuccuggaguucgaagcucucggauuuaugaaugaggaucacugguucucuagagaaaacagccuguccggcguggagggggagggacuucauaagcugggcuauauccuccgggacauuucuaaaaucccugggggaaauauguacgccgaugacacagcuggcugggauacccgcaucacagaagacgaucugcagaacgaggccagaauuaccgacaucauggaacccgagcacgcgcuucuggccaagagcauuuuuaaacucacguaucaaaauaaggucgugcggguucagcgcccugcuaaaaacgggaccgugauggaugucaucuccagacgggaccagagaggcucuggacaggugggcacauacgggcugaauaccuucacaaacauggaagcccaacugauucgccagauggagagcgagggaaucuuuucccccagcgaacucgagaccccgaaccuggcugaacgggugcuugauuggcuggagaaguauggcguugaaagacucaagcgcauggccaucucuggggacgacuguguggucaaaccuauugaugaccgguucgcgacggcccugacagcucuuaaugauaugggaaaggugagaaaagacaucccccagugggagccuuccaagggcuggaacgauuggcagcaaguucccuuuugcagccaucacuuccaccagcugauuaugaaagacgggcgcgagaucguggucccuugucggaaucaggaugaacucgugggcagagcccgcgucucucagggagcuggcuggucccugcgggagaccgccugccugggaaagagcuacgcucaaauguggcagcucauguauuuucauagacgcgaccugcggcuugccgcgaacgccauuuguuccgcugugcccguugauuggaucccgacaucuagaaccacguggagcauucacgcccaucaccaguggaugaccacagaagacaugcuguccguguggaaucgggucuggaucgaggaaaacccuuggauggaggauaagacccauaucagcucuuggggagacgugcccuaccucggcaaaagagaggaccaauggugcgggucccugauuggacuuacagcccgcgcuaccugggccacaaauauccagguugcgauuaaccaggugcggagacugaucggcaaugaaaacuaccucgauuauaugaccagcaugaagcgcuucaaaaaugagucugaccccgaaggggcucugugguga

SEQ ID NO: 18939 - RNA, 9879 nt, Artificial Sequence
  derived and/or modified CDS sequence (opt5) from DENV-1__FJ410232__SS-prME
agcgugaccaugcugcucaugcugaugcccacagcccuugcuuuccaccugacgaccagaggaggggaaccucauaugaucguguccaagcaggaacggggaaaaucucuccuguuuaagacaagcgccggcguuaacaugugcacccuuauugcgauggaccugggggaacucugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugacagcccuuuuucuggcgcaugccaucgggaccucuauuacccagaagggaaucaucuucauucuccugaugcuugucacaccuagcauggcuaugagaugcgugggcaucgggucccgggauuuuguugagggacugagcggcgccacguggguggacgucgugcucgagcacgggucuugugugaccacaauggcuaaggauaaacccacccuggacauugaacugcucaagacagaggucaccaacccugccguucugcgcaaacuuugcaucgaagcgaagauuuccaauacgacaaccgauagcagauguccgacccaaggagaggccacacugguggaagaacaggacgcuaacuucgugugccggcgcaccuuugucgauagaggcuggggcaauggguguggacucuucggcaaagggucucugaucacaugcgccaaguuuaagugcgugacgaaacuugagggaaagauuguucaguacgaaaaccugaaauauuccgugaucgucaccgugcacacaggcgaccagcaucaaguugggaaugagagcaccgaacacggaacaaccgcuacgaucacaccccaggccccuacaaccgagauucagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggcuuccacaucucaagagaccuggaaucgccaggaccugcucgugaccuucaaaacagcgcacgccaagaagcaggaagucgugguucugggaagccaagagggcgcuaugcacacggcccugaccggggccacagaaauccagaccuccggaacaaccacgauuuuugcuggccaucucaaaugcagacugaagauggauaaacuuacacugaaggggaugagcuaugugauguguaccggcucuuucaaacucgagaaggaagucgccgagacccagcacggaacagugcugguucagaucaaguacgagggcaccgacgcgccgugcaaaauuccuuucuccacacaagaugaaaagggggugacgcagaacggacggcugaucaccgcuaaucccaucgucacagacaaagagaagccugugaacauugaagccgagccgcccuuuggcgagagcuauaucgugauuggggccggagaaaaagcucuuaagcucucuugguucaagaaaggcagcuccaucgggaagauguuugaggccaccgcuagaggcgcccgccggauggcgauucugggagauacagccugggacuucggcucuaucgggggaguuuuuaccagcgucggcaaacuggugcaucagaucuucgggacggcuuacggagugcucuuuuccggcgucagcuggaccaugaagauugggaucggcgugcugcuuacauggcugggacucaauucuagauccaccagccugucuaugacauguauugccguuggccuggugacccuuuaccucggggucauggugcaggcugauuccggaugcguuaucaacuggaaaggccgcgaacugaagugugggagcggaauuuucgugacaaaugagguccacaccuggacggaacaauauaaguuucaggccgacuccccuaaacggcugucugcggccaucggcaaggcuugggaggagggggugugcggcauuagaagcgccacacgccucgaaaacaucauguggaaacagaucuccaacgagcugaaucauauucuucuggaaaacgacaugaagcucaccguuguggucggagauguggcuggcauccuggggcagggcaagaaaaugauucggccgcaacccauggaguacaaauauucuuggaaaagcuggggcaaggccaagaucauuggggccgacgcucagaauaccacauucaucaucgauggaccuaacacccccgaauguccugacgaucagagagcguggaauauuugggagguggaggacuacggcuuuggcaucuucacgacaaacauuuggcugaaacuucgcgauuccuauacccaggucugcgaccaccggcucaugagcgccgcuaucaaagauucuaaggccguucacgccgacaugggguacuggauugaauccgagaaaaaugaaacauggaagcuggcuagagccagcuuuaucgaggugaagaccuguaucuggcccaaaucucauacacugugguccaacggagugcucgaaagcgagaugauuaucccgaagauuuauggcgggccuaucucucaacacaauuaccgccccggauacuucacccagacggcgggcccuuggcaucuggggaaacuugagcuggauuucgaccucugcgaaggaaccacagucgugguugaugagcacugcggcaaccggggccccagccugagaaccacaaccgugacggggaagauuauccacgaaugguguugccgguccuguacacugccuccccuucgcuuuagaggagaggacggcugcugguaugggauggagauccggccggucaaagaaaaggaggaaaaucucgucaagagcaugguuucugcuggauccggcgagguggacagcuucucccuggggcugcucuguauuucuaucaugauugaagaggucaugagaagccgcuggucccggaaaaugcugaugaccggaacacuugccguguuuuuccugcucaucaugggccagcugaccuggaacgaucugauuagacuuugcaucaugguuggcgccaaugcuucugaccgcauggggaugggaaccacauaccuggcccucauggcgacguuuaagaugagaccuauguucgcugugggccugcucuuucggcgccugaccagcagagagguccuucugcucacaauugggcugucccugguggccucuguggaacuucccaacagccuggaggaacucggagauggccuggccauggggaucaugauccucaaacugcuuaccgacuuccaaucccaucagcugugggcuacacuccugagccugaccuuuauuaagacgacauucucucuucacuaugccuggaaaaccauggcuaugguccuguccaucguuagccucuuuccccugugucucucuaccacaucccagaagaccacauggcugccugugcuucugggaagccugggcugcaagccgcucacgauguuccugauugccgagaauaaaaucuggggccggaagucuuggccccuuaacgaagggauuauggcggugggaaucgucuccauccugcucagcucccugcucaaaaacgaugugccucuggccggcccccuuauugcugggggaaugcugaucgccuguuacguuauuagcggcucuagcgcugaccugucccucgagaaggccgccgaggugucuugggaagaggaagcugagcauagcggggcgucccacaauauccuggucgaagugcaggaugacggaaccaugaaaauuaaggaugaggagcgcgacgauacacuuaccauccugcucaaagccacacugcucgcuguuucuggcguguauccucugagcauccccgccacccuuuuugucugguacuucuggcaaaagaagaaacagagauccggcgugcugugggacacgccuucucccccggaagucgagcgggccgugcuggaugacgggauuuaucgcaucaugcagagaggacuccugggccggagccagguuggggugggagucuuccaagaaaacguguuucauaccauguggcacguuacacgcggcgcugugcuuauguaccaggggaagagacuggagccuuccugggccagcgucaaaaaggaccucauuucuuacggaggcggcuggcggcugagaggguccuggaauaccggagaggaaguccaggugaucgcgguugagcccggcaaaaacccuaagaauguccagacagcucccgggaccuucaagacaccggaaggagaggugggcgccauugcccucgauuuuaaaccugggacgagcggaucucccaucgugaaccgcgaaggcaagauugucggccuguaugggaauggagugguuaccacauccggcaccuacgugagcgcuaucgcccaagcgaaggcuucccaggaggggccucuucccgagaucgaagacgaggucuuccggaagagaaaccugaccauuauggaucugcaccccggaucuggcaaaacacgccgguaucucccugccaucgugagagaagccauuaagcgcaagcugcggacgcuuauccuggcuccgaccagaguuguggccagcgagauggcugaagcccucaaagggaugcccauucgcuaccagacaaccgcggucaaguccgagcauacaggcaaagagaucguggaccugaugugccacgccaccuuuacgaugcggcugcucagcccuguuagagugcccaauuauaacaugaucauuauggaugaagcucauuucacagacccuucuuccaucgccgcucggggauacauuagcacccgcgucggcaugggggaggccgccgcuaucuuuaugaccgcgacacccccuggaucuguggaagccuucccgcaaagcaaugcugugauucaggaugaggaaagagacauccccgagcgguccuggaacucuggcuaugaguggaucaccgauuuuccugggaagacagucugguucguucccagcauuaaauccggaaaugacaucgccaacugucuucgcaagaauggcaagagagugauucagcugucucggaaaaccuuugauacggaauaccagaagaccaagaacaacgacugggacuacguggucaccacagauaucagcgagaugggggccaauuucagagcugaccgcgugauugauccucggagaugccugaagcccguuauccucaaagacggcccggaacgcgugauucuggccggaccuaugcccgucaccguggcguccgcugcccaacggagaggccgcaucgggcggaaccacaauaaggagggagaucaguauaucuacaugggccagccccuuaacaaugacgaggaucaugcccacuggacggaagcuaagaugcugcucgacaacauuaauaccccugaggggaucauucccgcccuguucgaaccugagagagagaaaagcgcggccguugauggagaguaucgccugagaggcgaggcucggaagacauuuguggaacucaugcgcagaggggaccuuccggucuggcugucuuacaaaguggccuccgagggcuuccaguauagcgaucggcgcuggugcuuugacggagaaagaaacaaucaaguccuggaggaaaacauggauguggagaucuggaccaaggagggcgaacggaaaaagcucagaccccgcuggcuggacgcucggacauacuccgacccucuugcccugagagaguucaaagaauuugcugccgggcgccggucuguuagcggagaucucauucuggagaucggcaagcugccccagcaccucacccagagagcgcagaaugcccuugacaaccuggugaugcugcauaauuccgaacaagggggacgggcuuaucgccacgccauggaggagcucccugauacaaucgaaacccugaugcuucuggcucucauugccgugcugacgggcggcgucacacuguucuuucucucugggagaggacuuggcaagaccagcaucgggcugcuguguguuauggccuccagcgugcuccuguggauggcuucuguggagccccauuggauugcggccuccaucauucuugaguucuuucugaugguccuccugaucccggagccugaccggcagcgcacaccccaggauaaccagcuggcuuacgugguuaucggacuccuuuucaugauucugacaguggccgccaaugagaugggccugcucgaaaccaccaaaaaggaccuggggaucggacacgucgcuguggagaaccaccaucacgccgcgaugcuugaugucgaccugcauccugccagcgcuuggacgcucuacgccguggcuaccacaauuaucacccccaugaugagacacacaauugaaaacaccacggccaauaucucucugaccgcgauugccaaccaagcugccauccugaugggccucgauaaaggcuggccuaucuccaagauggacauugggguuccccuucuggcucugggaugcuauagccaggugaauccgcucacacugaccgccgcuguccuuaugcugguggcccauuacgcgaucauuggcccugggcuccaggccaaagcuacacgggaggcccaaaagcgcaccgcugccggaaucaugaagaaccccacgguugauggcauuguggccaucgaccuggaucccgucguguaugacgcgaaauuugaaaagcagcuggggcagaucaugcuccuuauucuguguacaucucagauccugcucaugagaaccacaugggcucugugcgagagcauuacccuugccaccggaccucugacaacgcucugggagggcuccccgggcaaauucuggaauaccacaaucgcugugucuauggccaacauuuuucgggggagcuaccuggccggagcuggccuggccuucucccucaugaaaagccuugggggaggccgcagagggaccggagcgcaaggcgaaacacugggcgagaaauggaagcggcagcugaaucagcucuccaagucugaguucaacaccuauaaaagaagcgggaucauggagguugaccgcuccgaagccaaggagggacugaaacggggcgagacgacaaagcacgcugucucuagagggaccgccaaacuucgcugguuuguggaacggaaucuggugaagcccgagggaaaggucaucgaucucggcugugggagaggaggcuggagcuacuauugcgcuggccugaaaaagguuaccgaagugaaaggguacacaaagggaggcccugggcacgaggaacccauuccuauggccaccuacggauggaaccuggugaaacuccauuccggcaaggacgucuucuuuauucccccugagaaaugugauacacuucugugcgacaucggggagucuagcccgaaucccacgaucgaagagggacgcacccugcgggugcucaagaugguugaaccuuggcugagaggcaaccaguucuguauuaagauccuuaaucccuauaugccuuccguggucgagacacuggagcaaaugcagcgcaaacacggcgggaugcucgugcggaacccccugagcagaaauucuacccaugaaauguacuggguuuccugcggaacaggcaacauugugagcgcggucaauaugaccucucgcaugcugcucaaccgguuuacgauggcccacagaaagccgaccuaugagcgcgauguggaccuggggacaggaaccagacacguggcugucgaaccugagguugccaaccuugauaucaucggccagcggauugaaaauaucaaacaugagcacaaguccacauggcauuacgacgaggauaaccccuauaaaaccugggcuuaccacgggagcuaugaagugaagcccucuggauccgccagcuccauggugaauggcgucgugaagcugcucacaaaaccuugggacguuauucccauggugacccagaucgcuaugacggauacaaccccuuucggccaacagcgcgucuuuaaggagaaaguggacaccagaacaccgaaggccaaacgggggacggcgcagauuauggaaguuaccgccagauggcuguggggauuccuuagccggaacaagaagccccgcaucuguacaagagaggaauuuacccggaaagugcgcucuaaugcugccaucggcgcugucuucguggacgagaaccaauggaauagcgccaaggaggccguugaagaugagagauuuugggaccuggugcaucgggaacgcgagcuccacaaacaggggaagugcgcgacaugcgucuacaacaugaugggaaaaagagaaaagaagcugggcgaguucgggaaagcuaagggcucccgggccauuugguacauguggcugggagcccgcuuucucgaguucgaagcucugggcuucaugaaugaggaucacugguuuucuagagaaaacagccuuuccgggguggagggagagggccugcauaaacucggguauauccugcgggacauuucuaagaucccuggaggcaauauguacgccgaugacaccgcugggugggauacacgcauuaccgaagacgaucuucagaacgaggccaaaaucacggacaucauggaacccgagcacgcgcugcucgccaaggcuauuuucaaacugaccuaucagaauaaggucgugagaguucaacggccugccaagaacggcacagugauggaugucaucagccgcagagaccagcggggauccggccagguggggaccuacggacugaauacauuuaccaacauggaagcucagcucauuagacaaauggagucugagggcaucuucagccccuccgaacuggagacgccgaaccuugccgaacgcgcgcuggauuggcucgagaaauaugggguggaacggcugaagagaauggccauuagcggagacgacuguguugugaaaccuaucgaugaccgcuuugcuacagcccuuaccgcucugaaugauaugggcaagguccggaaagacaucccccagugggagccuucuaagggguggaacgauuggcaacaggugcccuucugcucccaucacuuucaccaacucauuaugaaggacggcagagagaucguugugccuugucgcaaucaggaugaacuggucggacgggccagagugagccagggcgcuggguggucucugcgcgagacagccugccucggaaaauccuacgcgcagauguggcaacugauguauuuccaucggagagaccuucgccuggccgcuaacgccauuuguagcgccguccccguggauuggguuccgaccucccggacgaccuggucuauccacgcucaucaccaguggaugacaaccgaagacaugcucagcguguggaauagagucuggauugaggaaaacccuuggauggaggauaagacacauaucuccagcugggaggacgugcccuaccugggcaaacgggaagaccaguggugcgggucucuuauuggacugaccgccagagcgacaugggcuaccaauauccaaguugccaucaaccaggugcgccggcucauuggcaaugagaacuaccuggauuauaugacguccaugaagagauuuaaaaaugaaagcgaccccgagggggcccugugguga

SEQ ID NO: 18940 - RNA, 9879 nt, Artificial Sequence
  derived and/or modified CDS sequence (opt5) from DENV-1__FJ461327__SS-prME
agcgugaccaugcugcucaugcugaugcccaccgcccuugcuuuccaccugacgaccagaggaggggaaccucauaugauugucuccaagcaggaacggggaaaaucucuccuguuuaagaccagcgccggcguuaacaugugcacccuuauugcgauggaccugggggaacucugugaagauaccaugaccuacaaaugccccagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccaggccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucagaggggaggacggaugcugguauggcauggagauucggccggugaaagaaaaggaggaaaaucuuguuaagagcauggugucugcuggguccggagaggucgacagcuuuucccucggccugcuguguaucucuauuaugaucgaagaggugaugagaagccgcuggucccggagaaugcucaugacagggacccuggccguuuucuuucuucugauuaugggacagcucacauggaacgaucugauccgccugugcauuauggugggcgccaaugcuucugacagaaugggcauggggaccaccuaccuugcccugauggcgacauucaaaaugcggccuauguuugcugucggacuccuguuccgcagacucacgagccgggaggugcugcuucugaccaucggccucucccugguggccucugucgaacugcccaacagccuugaggaacugggggauggacucgccaugggcaucaugauucugaagcuccugacagacuuucaaucccaucagcuuugggcuacccugcucagccugacauucaucaaaaccacguuuucucugcacuaugccuggaagacaauggcuaugguucuuuccauugugagccuguucccccucugucugucuaccaccucccagaaaacaaccuggcucccugugcugcuugggagccugggaugcaagccgcugacaauguuucucaucgccgagaauaagauuuggggccgcagaucuuggccccugaacgaaggcaucauggcggucgggaucguguccauucuucugagcucccuccugaaaaacgauguuccucucgccggaccccugaucgcuggcgggaugcuuauugccuguuacgugaucagcggaucuagcgcugaccugucccuggagaaggccgccgaggucucuugggaagaggaagcugagcauagcggcgcgucccacaauauucucguggaaguucaggaugacgggacgaugaaaaucaaggaugaggagcgggacgauacccugacaauccuucugaaagccacccuccuggcugugucuggagucuauccucucagcauucccgccacacuguucgugugguacuucuggcaaaagaaaaagcagcgcuccggcguccuuugggacaccccuucucccccggaaguggagagagccguucuggaugacggcaucuaucggauuaugcagcgcgggcugcucggaagaagccaggugggcgucgggguguuucaagaaaacguuuuccauacgauguggcacgugacccggggagcuguccugauguaccagggcaagagacuugagccuuccugggccagcgugaaaaaggaccugaucucuuacgggggaggcuggcgccuccagggcuccuggaauacaggggaggaagugcagguuauugcggucgagcccggcaagaacccuaagaaugugcaaaccgcucccggcacauuuaaaaccccggaaggggaggugggagccaucgcccuggauuucaagccuggcacaagcgggucucccauugucaaccgggaaggaaagaucgugggccucuauggcaaugggguugugacgaccuccggaacauacgucagcgcuaucgcccaggcgaaggcuucccaggagggcccucugcccgagauugaagacgagguguuuagaaagcgcaaccuuaccaucauggaucugcaccccgggucuggaaaaacccggagauaucugccugccauuguucgcgaagccaucaagcggaaacucagaacacugauucuugcuccgacgcgcguggucgccagcgagauggcugaagcccugaagggcaugcccauccgguaccaaaccacagcggugaaguccgagcauaccgggaaagagaucguugaccucaugugccacgccacauucaccaugagacugcugagcccugugcggguccccaauuauaacaugauuaucauggaugaagcucauuuuacggacccuucuuccauugccgcucgcggcuacaucagcacaagagugggaaugggcgaggccgccgcuauuuucaugaccgcgacacccccugggucuguggaagccuuuccgcagagcaaugcugucauccaggaugaggaacgggacauccccgagcgcuccuggaacucuggauaugaguggauuacagauuucccuggcaagaccguuugguuugugcccagcaucaaauccgggaaugacauugccaacugucucagaaagaauggaaaacgggugauccagcuuucuagaaagacauucgauaccgaauaccaaaagacgaaaaacaacgacugggacuacgucgugacaaccgauauuagcgagaugggcgccaauuuccgcgcugaccggguuaucgauccuagacgcugccugaagcccgugauucugaaagacgggccggaacgggucauccucgccggcccuaugcccgugacaguugcguccgcugcccagagacgcggacggaucggcagaaaccacaauaaggagggggaucaguauauuuacaugggacagccccugaacaaugacgaggaucaugcccacuggaccgaagcuaaaaugcuucuggacaacaucaauacgccugagggcauuauccccgcccucuuugaaccugagcgcgaaaagagcgcggccauugauggggaguauagacugcggggagaggcucgcaagaccuucguggaacugaugagacggggcgaccucccggucuggcuuucuuacaaaguggccuccgagggguuucaauauagcgaucgcagauggugcuucgacggcgaacggaacaaucagguccuggaggaaaacauggauguggagaucuggacaaaggagggagaacgcaagaaacugcgcccccgguggcucgacgcuagaaccuacuccgacccucuggcccuucgcgaguuuaaagaguucgcugccggccggagaucuguuagcggggaucugauccucgagauuggaaagcugccccagcaccugacacagcgggcgcaaaaugcccucgacaaccuugugaugcugcauaauuccgaacagggcgggcgcgcuuauagacacgccauggaggagcugccugauaccaucgaaacacucaugcugcuugcucugauugccgugcucaccggaggcgucacgcuguuuuuccugucuggccgggggcucggaaaaacaagcaucggccuucuguguguuauggccuccagcgugcugcucuggauggcuucuguggagccccauuggauugcggccuccaucauccuggaauuuuuccuuaugguccugcucauuccggagccugaccgccagagaacaccccaggauaaccaacuggcuuacgugguuaucgggcugcucuuuaugauucuuaccguggccgccaaugagaugggacugcuggaaacaaccaagaaggaccucggcaucgggcacgucgcuguggagaaccaccaucacgccgcgaugcuggaugucgaccuucauccugccagcgcuuggacacuguacgccguggcuacgaccauuaucacacccaugaugcggcacaccauugaaaacacaaccgccaauaucucucucacggcgaucgccaaccaggcugccauucugaugggacuggauaaaggcuggccuaucuccaagauggacaugggcguuccccuccuugcucuggggugcuauagccaggugaauccgcugacccucacagccgcuguccugaugcuuguggcccauuacgcgauuaucggaccuggccugcaagccaaagcuacccgcgaggcccagaagagaacagcugccgggauuaugaaaaaccccaccguugauggaaucguggccaucgaccucgaucccgucguguaugacgcgaaguucgaaaagcagcugggccagauuaugcugcucauccuuuguacgucucaaauucugcugaugcggacaaccugggcucucugcgagagcaucacacuggccaccgggccucuuaccacacugugggagggauccccgggcaaauuuuggaauacgaccauugcugugucuauggccaacaucuuccgcggcagcuaccucgccggggcuggacuggccuucucccugaugaaaagccucggcgggggaagacggggcacaggggcgcagggagaaacccuuggcgagaaauggaagagacagcugaaucagcuguccaaaucugaauuuaacacauauaagcgcagcggcaucauggagguugaccgguccgaagccaaggaggggcucaaaagaggagagaccacgaagcacgcugucucucgcggcacagccaaacugcggugguucguggaaagaaaucuugugaagcccgaggggaaagucauugaucugggauguggccgcgggggauggagcuacuauugcgcuggccucaagaagguuaccgaagugaaaggcuacaccaaaggcgggccugggcacgaggaacccaucccuauggccacauacggguggaaccuggugaaacugcauuccggaaaggacgucuuuuucauucccccugagaaaugugauacccuccuuugcgacaucggcgagucuagcccgaaucccacaauugaagaggggcggacgcugagagugcugaagaugguugaaccuuggcuccgcggaaaccaauuuuguaucaaaauucugaaucccuauaugccuuccguggucgagacccuugagcagaugcagcggaagcacggcggcaugcuggugagaaacccccucagccgcaauucuacacaugaaauguacuggguuuccugcgggaccggaaacaucgugagcgcggucaauaugacaucucggaugcugcugaacagauucaccauggcccaccgcaagccgacguaugagagagauguggaccucggcgcugggacccggcacguggccgucgaaccugagguugcuaaccuggauaucauuggacagcgcaucgaaaauauuaaacaugagcacaaguccacauggcauuacgacgaggauaaccccuauaaaaccugggccuaccacggcagcuaugaagugaagcccucuggguccgcuagcuccauggugaauggagucgugaaacuucugacaaagccuugggacguuauccccauggugacccaaauugccaugacagauaccacgccuuuuggccagcagagagucuucaaggagaaaguggacacacggaccccgaaggcgaaaagaggcaccgcccaaaucauggaaguuacagcuaaguggcucuggggguuucugagccggaacaaaaagccccgcaucuguacgagagaggaguucacccggaaggugcgcucuaaugccgcuauuggagccgucuuuguggacgagaaccaguggaauagcgccaaagaggcgguugaagaugagagauucugggaccuugugcaucgggaacgcgagcugcacaagcagggcaaaugcgcuacaugcgucuacaacaugauggggaagagagagaaaaagcucggagaguuuggcaaggccaaagggucccgggccaucugguacauguggcugggcgcucgcuuccuggaguucgaagcccucggauuuaugaaugaggaucacugguucucuagagaaaacagccuguccggcguggagggggagggacuucauaagcugggcuauauucuccgggacaucucuaaaauuccugggggaaauauguacgcugaugacaccgccggcugggauacacgcaucaccgaagacgaucugcagaacgaggcgagaaucacagacauuauggaacccgagcacgcccuucuggcuaagagcaucuuuaaacucaccuaucaaaauaaggucgugcggguucagcgcccugccaaaaacgggacggugauggaugucauuuccagacgggaccagagaggcucuggacaggugggcaccuacgggcugaauacauucaccaacauggaagcucaacugauccgccagauggagagcgagggaaucuuuucccccagcgaacucgagacaccgaaccuggccgaacgggugcuugauuggcuggagaaguauggcguugaaagacucaagcgcauggcgaucucuggggacgacuguguggucaaaccuaucgaugaccgguucgccaccgcucugacggcccuuaaugauaugggaaaggugagaaaagacauuccccagugggagccuuccaagggcuggaacgauuggcagcaaguucccuuuugcagccaucacuuccaccagcugaucaugaaagacgggcgcgagauuguggucccuugucggaaucaggaugaacucgugggcagagcucgcgucucucagggagccggcuggucccugcgggagacagcuugccugggaaagagcuacgcccaaauguggcagcucauguauuuucauagacgcgaccugcggcuugcggccaacgcuaucuguuccgccgugcccguugauuggauuccgaccucuagaacaaccuggagcauccacgcccaucaccaguggaugacgaccgaagacaugcuguccguguggaaucgggucuggauugaggaaaacccuuggauggaggauaagacacauaucagcucuuggggagacgugcccuaccucggcaaaagagaggaccaauggugcgggucccugaucggacuuaccgcucgcgccacaugggcgaccaauauucagguugcuaucaaccaggugcggagacugauuggcaaugaaaacuaccucgauuauaugacaagcaugaagcgcuucaaaaaugagucugaccccgaaggggcccugugguga

SEQ ID NO: 18941 - RNA, 9879 nt, Artificial Sequence
  derived and/or modified CDS sequence (opt5) from DENV-1__FJ461328__SS-prME
agcgugaccaugcugcucaugcugaugcccacggcccuugcuuuccaccugacgaccagaggaggggagccucauaugaucgucuccaagcaggaacggggaaaaucucuccuguuuaagaccagcgccggaguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccagaccggcgagcacagacgggagaagcgcucugucgcccuggcuccucauguggggcugggacucgaaacaagaaccgagacguggaugagcuccgaaggcgccuggaaacagauucagcggguugagacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggacuuuguugagggacugagcggcgccacauggguggaugucgugcucgaacacgggucuugugugacgaccauggcuaaggacaaacccacacuggauaucgagcugcucaagaccgaagucacaaacccugccguucugcgcaaacuuugcauugaggcgaagaucuccaauaccacgacagacagcagauguccgacccaaggagaagccacccugguggaggagcaggaugcuaacuucgugugccggcgcacauuugucgacagaggcuggggcaauggguguggacucuucggcaaagggucucugcuuaccugcgccaaguuuaagugcgugacaaaacuggaaggaaagauuguucaguacgagaaccucaaauauuccgugaucgucacggugcacaccggcgaucagcaucaaguugggaaugaaagcacagagcacggaaccacagcuaccaucacgccccaggccccuaccacagaaauucagcugaccgacuacggcgcccugacacucgacuguucuccccggaccggccuggauuucaacgagauggugcuucugacgaugaaggagaaauccuggcucguccauaagcagugguuucuggaccuuccucugcccuggacaagcggggcuuccaccucucaagaaacauggaaucgccaggaucuccuggugaccuucaaaaccgcgcacgccaagaagcaggaggucgugguucugggaagccaagaaggcgcuaugcacacagcccucacgggggccaccgagauccagacauccggaaccacaaccauuuuugcuggccaucugaaaugcagacuuaagauggacaaacugacgcucaaggggaugagcuaugugauguguacaggcucuuucaaacuggaaaaggaggucgccgagacccagcacggaaccgugcugguucagaucaaguacgaaggcacagaugcgccgugcaaaauuccuuucuccacccaagacgagaagggggugacacagaacggacggcuuaucacggcuaaucccaucgucaccgauaaagaaaagccugugaacauugaggccgagccgcccuuuggcgaaagcuauaucgugauuggggccggagagaaagcucucaagcugucuugguucaagaaaggcagcuccaucgggaagauguuugaagccacagcuagaggcgcccgccggauggcgauucugggagacaccgccugggauuucggcucuaucgggggaguuuuuacaagcgucggcaaacucgugcaucagaucuucgggaccgcuuacggagugcuguuuuccggcgucagcuggacgaugaagauugggaucggcgugcuucugaccuggcucggacucaauucuagauccacaagccugucuaugaccuguauugccguuggccuugugacacucuaccugggggucauggugcaggcugacuccggaugcguuaucaacuggaaaggccgcgagcugaagugugggagcggaauuuucgugaccaaugaaguccacacauggaccgagcaauauaaguuucaggccgauuccccuaaacggcucucugcggccaucggcaaggcuugggaggaaggggugugcggcauuagaagcgccacgcgccuggagaacaucauguggaaacagaucuccaacgaacuuaaucauauucugcucgagaacgacaugaaguucacaguuguggucggagacguggcuggcauccuggugcaggggaaaaagaugauucggccgcaacccauggaauacaaauauucuuggaaaagcuggggaaaggccaaaaucauuggcgccgauguccaaaauuccaccuuuaucaucgacgggccuaacacccccgaguguccugaugaccagagagcuuggaauauuugggagguugaagauuacggauucggcaucuuuacaaccaacauuuggcugaaacuucgcgacagcuauacacaggugugcgaucaccggcucaugucugcggccaucaaagacuccaaggcugugcacgccgauaugggcuacuggauugagagcgagaagaaugagacauggaagcuggccagagcuucuuucaucgaagucaagaccuguaucuggcccaaaucccauacacuguggagcaacggggugcucgagucugagaugauuaucccgaagauucacggaggcccuaucagccaacauaauuaucgccccggguacuucacccagacagccggaccuuggcaccugggcaaacuugaacuggacuuugaucucugcgaggggaccacgguuguggucgacgaacacugcggaaaccggggccccucccugagaaccacaaccgugacaggcaagauuauccaugagugguguugccggagcuguacccugccuccccuucgcuucagaggggaggauggaugcugguacggcauggaaauccggccgguuaaagagaaggaagagaaucucgugaagucuauggucuccgcggggagcggagaaguggacuccuuuucucugggccugcucuguauuagcaucaugauugaggagguuaugagaucccgcuggucucggaaaaugcugaugacggggacacuugcuguguucuuucugcucaucaugggacagcugaccuggaacgaccugauuagacuuugcaucauggucggcgccaaugccagcgaucgcaugggcauggggacaaccuaucuggcucucauggccaccuucaagaugagaccuauguuugcggugggacugcuguuccggcgccugacauccagagaagugcuucugcucacgauuggccugucucuggucgcuagcguugagcuucccaacucccuggaagaacugggggacggacuggccaugggcaucaugauccucaaacugcuuaccgauuuucaaagcuaccagcugugggccacacuccugucucugaccuucauuaagacaaccuuuucccuucacuaugcuuggaaaacgauggccauggugcugagcaucgugucucucuucccccugugucucuccacaaccagccagaagaccacauggcugccuguccuucuggggucucugggaugcaagccgcucaccauguuucugauugcugaaaauaaaaucuggggccggaaguccuggccccuuaacgagggcauuauggccguggggaucguuagcauccugcucuccagccugcucaaaaacgacgugccucuggcgggaccccuuauugccggcgggaugcugaucgcuuguuacgucauuucuggaagcuccgccgaucugucucucgagaaggcugccgaagugagcugggaggaagaggccgaacauuccggcgcuucucacaauauccugguugaggugcaggacgaugggacaaugaaaauuaaggacgaggaacgcgaugacacgcuuaccauccugcucaaagcgacacugcucgccgucagcggaguguauccucuguccauccccgcuacccuuuucgucuggcauuucuggcaaaagaagaaacagagaucuggcgugcugugggauacaccuagcccucccgagguugaacgggccgugcuggacgauggcauuuaccgcaucaugcagagagggcuccugggacggucccaggucggcguggggguuuuucaagagaacguguuccacaccauguggcacgucacgcgcggagccgugcuuauguaucagggcaagagacuggagcccagcugggcuucugugaaaaaggaccucauuuccuacgggggaggcuggcgguuucagggcagcuggaauaccggggaagagguucaggucaucgccguggaacccggcaagaacccuaagaaugugcaaacagcgcccggcaccuucaagacaccggagggggaagucggagcuauugcccuggacuuuaaaccuggcaccucugggucccccaucgugaacagagagggaaagauuguuggccucuacggcaaugggguggucacaacgagcggaaccuauguguccgccaucgcucaggccaaagcgucucaggagggcccucugcccgaaaucgaggaugaaguuuuccgcaagcggaaccuuacaauuauggaccugcaucccgggagcggaaaaaccagacgcuaccugccugcuaucgugcgggaggccauuaagagaaagcuccgcacccugauccuugccccgacacgggucguggcuuccgaaauggccgaggcucugaaaggcaugcccauuagauaucaaacgaccgccguuaagagcgagcacacagggaaagaaaucguggaucucaugugccaugcgaccuuuacaaugcgccugcugucuccuguccgggugcccaauuacaacaugaucauuauggacgaggcccacuucaccgauccuuccagcaucgcugccagaggcuauauuucuacgcgggugggaaugggcgaagcugccgccaucuuuaugacagcuacacccccugggagcauggaggcguucccgcaguccaaugccgucauucaggacgaagaaagagauauccccgagagaucuuggaacagcggauacgaauggaucaccgacuuuccuggcaagacaguuugguucgugcccuccauuaaagcugggaaugauaucgccaacugucuccggaagaauggaaagcgcgugauucagcuuucuagaaaaaccuucgacacagaguaucaaaagaccaaaaacaacgauugggacuacgucgugacgacagacaucagcgaaaugggcgccaauuuucgggcugauagaguuauugacccucgccggugccugaagcccgugauccugaaagaugggccggagagagucauucucgccggcccuaugcccgugaccguugcguccgcugcccagcgccggggaagaaucggccgcaaccauaauaaggagggggaccaguacaucuauaugggacagccccugaacaaugaugaagaccacgcccacuggacagaggcuaagaugcuucuggauaacauuaauaccccugaaggcaucauucccgcccucuucgagccugaacgggagaaaagcgcggccaucgacggggaguacagacugcgcggagaagcuagaaagacguuuguggagcugaugcggcgcggcgaucucccggucuggcuuucuuauaaaguggccuccgaaggguuccaauacagcgacagacgguggugcuuugauggcgagcgcaacaaucagguccuggaagagaacauggacguggagauuuggaccaaggaaggagagcgcaaaaagcugcggcccagauggcucgaugcucgcacauauuccgacccucuggcccuucgggaguucaaagaguuugcugccggcagacgcucuguuagcggggaccugauccucgaaaucggaaagcugccccagcaucugacccagcgggcgcaaaaugcccucgauaaccuugugaugcugcacaauuccgagcagggcgggagagcuuaccggcaugccauggaggaacugccugacacaauugagacccucaugcugcuugcucugaucgccgugcucacaggaggcgucacccuguucuuucugucuggcaaggggcucggaaaaacgagcauuggccuucuguguguuauggccuccagcgugcugcucuggauggcuucuguggaaccccacuggaucgcggccuccauuauccuggaguucuuucuuaugguccugcucaucccggagccugaucgccagagaacaccccaggacaaccaacuggcuuaugugguuauugggcuccucuucaugauccuuaccguggccgccaaugaaaugggacugcuggagaccacaaagaaagaucucggcauugggcacgucgcuguggaaaaccaucaccaugccgcgaugcuggacgucgaucuucacccugccagcgcuuggacccuguacgccguggcuacaacgaucauuacccccaugaugcggcauacaaucgagaacaccacagccaauauuucucucaccgcgaucgccaaccaggcugccauccugaugggacuggacaagggcuggccuauuuccaaaauggauaucggcguuccccuccuugcucuggggugcuacagccaggugaauccgcugacgcucaccgccgcuguccugaugcuuguggcccacuaugcgauuaucggaccuggccugcaagccaaggcuacacgcgaagcccagaagagaaccgcugccgggauuaugaaaaaccccacaaucgacggaaucguugccauugaucucgaccccguggucuacgaugcgaaguuugagaaacagcugggccagaucaugcugcucauucuuuguaccucucaaauccugcugaugcggacgacaugggcucucugcgagagcauuacccuggccacagggccucuuaccacccugugggaaggauccccgggcaaguucuggaauacaacgaucgcugugucuauggccaacaucuuccgcggcagcuaucucgccggggcuggacuggccuuuucccugaugaaaagccucggcgggggaagacggggcaccggggcgcagggagagacacuuggcgaaaaguggaagcgccagcugaaucagcuguccaaaucugaguucaacaccuacaagagaagcggcauuauggaaguggaccgguccgaggccaaagaggggcucaagagaggagaaacaaccaaacacgcuguuucucgcggcacggccaagcugcggugguuugucgagagaaaucuugugaagcccgaagggaaagugaucgaccugggauguggccgcgggggauggagcuauuacugcgcuggccucaagaaagucacagagguuaagggcuauaccaaagggggaccuggccaugaggaacccauuccuauggccaccuacggguggaaccuggugaagcugcacuccggaaaagauguguucuuuauucccccugagaagugugacacacuccuuugcgauaucggcgaaucuagcccgaaucccaccaucgaggaagggcggacacugagaguccugaagaugguggagccuuggcuccgcggaaaccaauucuguauuaaaauccugaaucccuacaugccuuccguuguggagacgcuugaacagaugcagcggaagcauggcggcaugcuggucagaaacccccucagccgcaauucuacccacgagauguauuggguguccugcgggacaggaaacaucguuagcgcggugaauaugaccucucggaugcugcugaacagauuuacaauggcccaccgcaaaccgaccuacgaacgggacgucgaucucggcgcugggacgagacauguggccguggagccugaagucgcuaaccuggacauuaucggacagcgcauugagaauaucaagcacgagcauaaauccaccuggcacuaugaugaagacaaccccuacaagacaugggccuaucauggcagcuacgagguuaagcccucuggguccgcuagcuccauggugaauggaguggucaaacuucugaccaagccuugggaugugauucccaugguuacacaaaucgccaugaccgacacaaccccuuucggccagcagagaguguuuaaagaaaaggucgauacgcggacaccgaaagcgaagcgcggcaccgcccaaaucauggaggugaccgcuagauggcucuggggguuccugagccggaacaagaaacccagaauuuguacacgggaagaguuuacgcgcaagguuagaucuaaugccgcuaucggagccguguucgucgacgagaaccaguggaauagcgccaaagaagcgguggaggacgaucgguuuugggaccuuguucaccgcgaaagagagcugcacaagcagggcaaaugcgcuaccugcguguauaacaugauggggaagcgggaaaagaaacucggagaguucggcaaggccaaagggucccgcgccauuugguacauguggcugggcgcuagauuccuggaguuugaagcccucggauucaugaaugaggaucauugguuuucucgggaaaacagccuguccggcgucgagggggagggacuucacaagcugggcuacauccuccgcgacauuucuaaaaucccugggggaaauauguaugcugaugacacagccggcugggauaccagaaucacagaagacgaucugcagaacgaggcgaagauuaccgacaucauggaacccgagcaugcccuucuggcuaaaagcauuuucaagcucacauaccaaaauaaggugguccgggugcagcgcccugccaaaaacgggaccguuauggaugugaucuccagacgggaccagcgcggcucuggacaggucggcacguaugggcugaauaccuuuacaaacauggaagcucaacugauuagacagauggagagcgagggaaucuuccuccccaacgaacuggagaccccgaaucuugccggccgggugcuggauuggcucgaaaaguacgggguggagagacugaaacgcauggcgaucuccggagacgacuguguugugaagccuauugaugaccgguuugccacagcucuuaccgcccugaacgauaugggcaaagucagaaaggacaucccccagugggaaccuagcaagggguggaaugauuggcagcaagugcccuucugcucucaccacuuucaucagcucauuaugaaagacggccgcgagaucguugugccuugucggaaccaggaugagcuggucggcagagcucgcgugucccagggcgccggguggagccugcgggaaacggcuugccucggaaagucuuaugcccaaauguggcagcugauguacuuccacagacgcgaccuucggcuggcggccaaugcuauuuguuccgccguccccguggauuggguuccgacaagcagaaccacaugguccauccaugcccaccaucaguggaugaccacggaggacaugcucucuguguggaaccgcgucuggauugaagagaauccuuggauggaagauaaaacccggaucagcuccugggaggacgugcccuaucugggcaagagagaggaccaauggugcgggagccuuaucggacugacagcucgggccaccugggcgacaaacauucagguugcuaucaaucaggugagacgccucauuggcaacgaaaauuacucugauuacaugaccuccaugaaacgguuuaagaacgagagcgaacccgagggggcccugugguga

SEQ ID NO: 18942 - RNA, 9879 nt, Artificial Sequence
  derived and/or modified CDS sequence (opt5) from DENV-1__FJ410234__SS-prME
agcgugaccaugcugcucaugcugaugcccaccgcccuugcuuuccaccugacgaccagaggaggggaaccucauaugaucguguccaagcaggaacggggaaaaucucuccuguuuaagacaagcgccggcguuaacaugugcacccuuauugcgauggaccugggggaacucugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaagcucacaguuguggucggagauguggcuggcauucuggggcagggcaagaagaugauccggccgcaacccauggaguacaaauauucuuggaaaagcuggggcaaggccaagauuaucggggccgacgcucagaauaccaccuucaucauugauggaccuaacacacccgaauguccugacgaucagagagcguggaauaucugggagguggaggacuacggcuuuggcauuuucaccacgaacaucuggcugaaacuucgcgauuccuauacacaggucugcgaccaccggcucaugagcgccgcuauuaaagauucuaaggccguucacgccgacaugggguacuggaucgaauccgagaaaaaugaaaccuggaagcuggcuagagccagcuuuaucgaggugaagacauguauuuggcccaaaucucauacccugugguccaacggagugcucgaaagcgagaugaucauuccgaagaucuauggcgggccuauuucucaacacaauuaccgccccggauacuucacacagaccgcgggcccuuggcaucuggggaaacuugagcuggauuucgaccucugcgaaggaacgaccgucgugguugaugagcacugcggcaaccggggccccagccugagaacaaccacagugaccgggaagaucauccacgaaugguguugccgguccuguacgcugccuccccuucgcuuuagaggagaggacggcugcugguaugggauggagauucggccggucaaagaaaaggaggaaaaucucgucaagagcaugguuucugcuggauccggcgagguggacagcuucucccuggggcugcucuguaucucuauuaugaucgaagaggucaugagaagccgcuggucccggaaaaugcugaugacaggaacccuugccguguuuuuccugcucauuaugggccagcugacauggaacgaucugaucagacuuugcauuaugguuggcgccaaugcuucugaccgcauggggaugggaaccaccuaccuggcccucauggcgacauuuaagaugagaccuauguucgcugugggccugcucuuucggcgccugacgagcagagagguccuucugcucaccaucgggcugucccugguggccucuguggaacuucccagcucccuggaggaacucggagauggccuggccauggggaucaugauucucaaacugcuuacagacuuccaaagccaucagcugugggcuacccuccugucucugacauuuaucaagaccgccuucucccuucacuaugcuuggaaaacgauggccaugguccugagcauuguuucucucuuuccccugugucucuccacaaccagccagaagaccacauggcugccugugcuucugggaucucugggcugcaagccgcucaccauguuccugaucgcggagaacaaaauuuggggccggaaguccuggccccuuaaugaagggaucauggccgugggaaucgucagcauucugcucuccagccugcucaaaaacgaugugccucuggcuggcccccuuaucgccgggggaaugcugauugcuuguuacguuaucucuggcagcuccgccgaccugucucucgagaaggccgcugaggugagcugggaagaggaagcggagcauuccggggccucucacaacauucuggucgaagugcaggaugacggaacaaugaaaaucaaggaugaggagcgcgacgauacgcuuaccauccugcucaaagcuacacugcucgccguuagcggcguguauccucuguccauucccgccacccuuuuugucugguacuucuggcaaaagaagaaacagagaucuggcgugcugugggacacaccuagcccucccgaagucgagcgggcugugcuggaugacgggaucuaucgcauuaugcagagaggacuccugggccggucccagguuggggugggagucuuccaagaaaauguguuucauaccauguggcacguuacgcgcggcgccgugcuuauguaccaggggaagagacuggagcccagcugggcgucugucaaaaaggaccucaucuccuacggaggcggcuggcggcugagagggagcuggaacaccggagaggaaguccaggugauugcuguugagcccggcaaaaauccuaagaacguccagacagcccccgggaccuucaagacaccggaaggagaggugggcgccaucgcucucgauuuuaaaccugggaccucuggaucccccauugugaaucgcgaaggcaagaucgucggccuguaugggaacggagugguuacaacgagcggcaccuacguguccgccaucgcgcaagcuaaagccucucaggaggggccucuucccgagauugaagacgaggucuuccggaagagaaaucugacaaucauggaucugcaccccggaagcggcaaaacccgccgguaucucccugccauugugagagaagcuaucaagcgcaagcugcggacccuuauucuggccccgacaagaguuguggcuuccgagauggccgaagcgcucaaagggaugcccauccgcuaccagacgaccgccgucaagagcgagcauacaggcaaagagaucguggaccugaugugccacgcuaccuuuacaaugcggcugcucucuccuguuagagugcccaacuauaauaugauuaucauggaugaagcccauuucaccgacccuuccagcauugcugcccggggauacaucucuacgcgcgucggcaugggggaggccgcugcgauuuuuaugacagccacacccccuggaagcguggaggcuuucccgcaauccaacgccgugauccaggaugaggaaagagacauccccgagcggucuuggaauagcggcuaugaguggauuaccgauuuuccugggaagacagucugguucguucccuccaucaaaucuggaaacgacauugccaauugucuucgcaagaacggcaagagagugauccagcugagccggaaaaccuuugauacagaauaccagaagaccaaaaauaacgacugggacuacguggucacgacagauauuuccgagaugggggcuaacuucagagccgaccgcgugaucgauccucggagaugccugaagcccguuauucucaaagacggcccggaacgcgugauccuggcgggaccuaugcccgucaccguggcuagcgccgcccaacggagaggccgcaucgggcggaaucacaacaaggagggagaucaguauauuuacaugggccagccccuuaauaacgacgaggaucaugcucacuggacagaagccaagaugcugcucgacaauaucaacaccccugaggggauuauccccgcgcuguucgaaccugagagagaaaaaucugccgcuguugauggagaguaucgccugagaggcgaggcccggaagacguuuguggaacucaugcgcagaggggaccuuccggucuggcuguccuacaaaguggcuagcgagggcuuccaguauuccgaucggcgcuggugcuuugacggagaaagaaauaaccaaguccuggaggaaaauauggauguggagauuuggaccaaggagggcgaacggaaaaagcucagaccccgcuggcuggacgcccggacauacucugacccucuugcucugagagaguucaaagaauuugccgcggggcgccggagcguuuccggagaucucauccuggagaucggcaagcugccccagcaccucacccagagagcccagaacgcucuugacaaucuggugaugcugcauaacucugaacaagggggacgggccuaucgccacgcuauggaggagcucccugauacaauugaaacccugaugcuucuggcccucaucgccgugcugacaggcggcgucacccuguucuuucucagcgggagaggacuuggcaagacguccauugggcugcuguguguuauggcuagcucugugcuccuguggauggcguccguggagccccauuggaucgccgcuagcauuauccuugaguucuuucugaugguccuccugaucccggagccugaccggcagcgcacaccccaggauaaucagcuggccuacgugguuauuggacuccuuuucaugauccugaccguggccgcuaacgagaugggccugcucgaaaccaccaaaaaggaccuggggauuggacacgucgccguggagaaucaccaucacgcggccaugcuugaugucgaccugcauccugcuucugccuggacccucuacgcuguggccacaacgaucauuacccccaugaugagacacacaaucgaaaacaccacagcgaacauuucccugaccgccaucgcuaaucaagccgcuauccugaugggccucgauaaaggcuggccuauuagcaagauggacaucgggguuccccuucuggcccugggaugcuauucucaggugaacccgcucacgcugaccgcugccguccuuaugcugguggcgcauuacgccauuaucggcccugggcuccaggcuaaagccacacgggaggcucaaaagcgcaccgccgccggaauuaugaagaaucccacaguugauggcaucguggcgaucgaccuggaucccgucguguaugacgcuaaauuugaaaagcagcuggggcagauuaugcuccuuauccuguguaccagccagauucugcucaugagaacgacaugggcccugugcgaguccaucacccuugcuacaggaccucugaccacccucugggagggcucuccgggcaaauucuggaacacaacgauugccgugagcauggccaauaucuuucggggguccuaccuggcuggagccggccuggcguucagccucaugaagucccuugggggaggccgcagagggaccggagcccaaggcgaaacacugggcgagaaauggaagcggcagcugaaccagcucucuaagagcgaguucaauaccuauaaaagauccgggaucauggagguugaccgcucugaagcuaaggagggacugaaacggggcgagacaaccaagcacgccgucagcagagggacggcuaaacuucgcugguuuguggaacggaaccuggugaagcccgagggaaaggucauugaucucggcugugggagaggaggcugguccuacuauugcgccggccugaaaaagguuacagaagugaaaggguacaccaagggaggcccugggcacgaggaacccaucccuauggcgaccuacggauggaaucuggugaaacuccauucuggcaaggacgucuucuuuauucccccugagaaaugugauacacuucugugcgacaucggggagagcuccccgaaccccaccauugaagagggacgcacacugcgggugcucaagaugguugaaccuuggcugagaggcaaucaguucuguaucaagauucuuaaccccuauaugccuagcguggucgagacgcuggagcaaaugcagcgcaaacacggcgggaugcucgugcggaauccccugucuagaaacuccacccaugaaauguacuggguuagcugcggaacaggcaauaucgugucugccgucaacaugaccucccgcaugcugcucaaucgguuuacaauggcucacagaaagccgaccuaugagcgcgauguggaccuggggacgggaaccagacacguggccgucgaaccugagguugcuaaccuugauaucauuggccagcggaucgaaaacauuaaacaugagcacaagagcacauggcauuacgacgaggauaaucccuauaaaaccugggccuaccacgggucuuaugaagugaagcccuccggaagcgcuuccagcauggugaacggcgucgugaagcugcucacaaaaccuugggacguuauccccauggugacccagauugccaugacagauaccacgccuuucggccaacagcgcgucuuuaaggagaaaguggacacaagaaccccgaaggcgaaacgggggaccgcccagaucauggaaguuacagcuagauggcuguggggauuccuuucucggaauaagaagccccgcaucuguacgagagaggaauuuacccggaaagugcgcagcaacgccgcuauuggcgccgucuucguggacgagaaucaauggaacuccgccaaggaggcgguugaagaugagagauuuugggaccuggugcaucgggaacgcgagcuccacaaacaggggaagugcgcuacaugcgucuacaauaugaugggaaaaagagaaaagaagcugggcgaguucgggaaagccaagggcucucgggccaucugguacauguggcugggagcucgcuuucucgaguucgaagcccugggcuucaugaacgaggaucacugguuuagcagagaaaauucccuuucugggguggagggagagggccugcauaaacucggguauauucugcgggacaucagcaagauuccuggaggcaacauguacgcugaugacaccgccgggugggauacacgcaucaccgaagacgaucuucagaaugaggcgaaaaucacagacauuauggaacccgagcacgcccugcucgcuaaggccaucuucaaacugaccuaucagaacaaggucgugagaguucaacggccugcuaagaauggcacggugauggaugucauuucccgcagagaccagcggggaucuggccagguggggaccuacggacugaacacauuuaccaauauggaagcccagcucaucagacaaauggagagcgagggcauuuucucccccagcgaacuggagacaccgaaccuugcggaacgcgcccuggauuggcucgagaaauaugggguggaacggcugaagagaauggcuaucucuggagacgacuguguugugaaaccuaucgaugaccgcuuugccaccgcucuuacggcccugaacgauaugggcaagguccggaaagacauuccccagugggagccuuccaagggguggaaugauuggcaacaggugcccuucugcagccaucacuuucaccaacucaucaugaaggacggcagagagauuguugugccuugucgcaaccaggaugaacuggucggacgggcuagagugucucagggcgccggguggucccugcgcgagacagcgugccucggaaaaagcuacgcccagauguggcaacugauguauuuccaucggagagaccuucgccuggcugccaaugccaucuguuccgcuguccccguggauuggguuccgaccucucggacaaccuggagcauucacgcccaucaccaguggaugacgaccgaagacaugcucuccguguggaacagagucuggaucgaggaaaauccuuggauggaggauaagacacauauuagcucuugggaggacgugcccuaccugggcaaacgggaagaccaguggugcgggucccuuaucggacugaccgcgagagcuacaugggccaccaacauccaaguugccauuaaucaggugcgccggcucaucggcaacgagaauuaccuggauuauaugacaagcaugaagagauuuaaaaacgaaucugaccccgagggggcucugugguga

SEQ ID NO: 18943 - RNA, 9879 nt, Artificial Sequence
  derived and/or modified CDS sequence (opt5) from DENV-1__FJ410235__SS-prME
agcgugacaaugcugcugaugcugaugcccacagcccuugcuuuccaccugacgaccagaggcggggaaccucauaugaucgucuccaagcaggaacgggggaaaucucuccuguuuaagacaagcgccggcguuaacaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacgaccaaucccaucgucacagacaaggagaaaccugugaacauugaagcugagccgcccuucggcgagucuuauaucgugauuggggccggagaaaaggcccugaaacuuagcugguuuaaaaagggcuccucuaucgggaaaauguucgaggcuaccgccagaggcgcucgccggauggccauucucggagauacagcgugggacuuuggcagcaucgggggaguuuucaccuccgucggcaagcuggugcaucagaucuuugggacggccuacggagugcuguucagcggcgucucuuggaccaugaaaauugggaucggcgugcuccugacauggcuuggacucaauuccagaagcaccucucucuccaugacauguauugcuguuggccuggugacccuguaccuuggggucauggugcaggccgauagcggaugcguuaucaacuggaagggccgcgaacucaaguguggguccggaauuuuugugacaaaugagguccacaccuggacggaacaguauaaauuccaagcugacucuccuaagcggcugagcgccgcgaucggcaaagccugggaggagggggugugcggcauuagauccgcuacacgccuggaaaacaucauguggaagcagaucucuaacgagcucaaucauauucugcuugaaaacgacaugaaauuuaccguuguggucggagauguggccggcauccuggcucaggggaagaaaaugauucggccgcagcccauggaguacaaguauagcuggaaguccuggggaaaagccaagaucauuggcgccgacgugcaaaauaccacauucaucaucgaugggccuaacacccccgaauguccugacgaucagagagcuuggaauauuugggaggucgaggacuacggauuuggcaucuucacgacaaacauuuggcucaaacugcgcgauagcuauacccagguuugcgaccaccggcugaugucugcggccaucaaggauuccaaagcugugcacgccgacaugggcuacuggauugaaagcgagaagaaugaaacauggaaacuugccagagcuucuuucaucgaggugaaaaccuguaucuggcccaagucccauacacucuggagcaacgggguccuggaaucugagaugauugugccgaaaaucuauggaggcccuauuagccagcacaauuaccgccccggguacuuuacccaaacggccggaccuuggcaucugggcaagcucgagcuggauuucgaccuuugcgaagggaccacaguuguggucgaugagcacugcggaaaccggggccccucccugagaaccacaaccgugacgggcaaaaucauucacgaaugguguugccggagcuguacacucccuccccugcgcuuuaagggggaggacggaugcugguauggcauggagaucagaccgguuaaggaaaaagaggaaaaucuggugaagucuauggucuccgcggggagcggagagguggacuccuucucucuuggccuccuguguaucagcauuaugaucgaagagguuaugcgguccagauggucucgcaaaaugcugaugaccgggacacucgcuguguuuuuccugcuuauuaugggacagcugaccuggaacgaucucauccggcugugcauuauggucggcgccaaugccagcgacagaaugggcauggggaccacauaccuggcucuuauggccacguuuaagaugcgcccuauguucgcggugggacugcucuuuagacggcugaccucccgcgaggugcuccugcuuacaaucggccugucucucgucgcuagcguugaacugcccaacucccuggaggaacuuggggauggacuggccaugggcauuaugauccucaaacugcucaccgacuuccagagccaucaacugugggccacacuucugucucucaccuuuaucaagacgacauucucccugcacuaugcuuggaagaccauggccauggugcugagcauugugucucuuuuuccccugugucucuccaccacaagccagaaaaccacauggcugccuguccuccuggggucucuuggaugcaagccgcugacgauguuccugaucgcugagaauaaaauuuggggcagaaaguccuggccccucaacgaaggcaucauggccguggggauuguuagcauccugcuuuccagccugcucaaaaacgaugugccucuggcgggaccccucaucgccggcgggaugcugauugcuuguuacgucaucucuggaagcuccgccgaccuuucucuggagaaggcugccgaggugagcugggaagaggaagccgagcauuccggcgcuucucacaauauucugguugaagugcaggaugacgggaccaugaaaaucaaggaugaggagcgggacgauacacucaccauucugcuuaaggcgacacugcucgccgucagcggaguguauccucuguccauccccgcuacccucuucgucugguacuuuuggcagaaaaagaaacaacgcucuggcgugcugugggacacgccuuccccucccgaaguugagagagccgugcuugaugacggcaucuaucggauuaugcagcgcgggcugcugggaagaucccaggucggcguggggguuuuccaggaaaacguguuucauaccauguggcacgucacacggggagccgugcucauguaccaaggcaagcgccuggagcccagcugggcuucugugaaaaaggaccuuaucuccuacgggggaggcuggagacugcagggcagcuggaauaccggggaggaaguucaggucauugccguggagcccggaaagaacccuaaaaaugugcagacagcgcccggcaccuucaagacaucugaaggggaggucggagcuaucgcccucgauuuuaaaccgggcacguccgggagcccuauugugaaccgggaaggaaagaucguuggccuguauggcaaugggguggucaccacauccggaaccuacgugucugccauugcucaagccaaagcgagccaggagggcccccucccugagaucgaagacgagguuuucagaaagcgcaaccugaccaucauggaucuucaccccggguccggaaagacacggagauaucugcccgcuauugugcgcgaagccaucaaacggaagcugagaacgcucauucuggccccuacccgcgucguggcuagcgagauggccgaagcucuuaaaggcaugccgauccgguaccagacaaccgccguuaagucugagcauacagggaaagagauuguggaccugaugugccacgcgaccuuuacgaugagacuccugucccccguccgcgugccuaauuauaacaugaucaucauggaugaagcccauuucacagaccccagcucuauugcugcccggggcuacaucagcaccagagugggaaugggcgaggcugccgccauuuuuaugaccgcuacaccucccggguccgucgaagcguucccucaaucuaaugccaucauucaggaugaggaacgggacaucccggagcgcagcuggaacuccggauaugaguggaucaccgauuuucccggcaagacaguuugguucgugccuucuauuaagagcgggaaugacaucgcuaacugucugcgcaagaauggaaagcgggugauucagcucucccgcaaaaccuucgauacggaauaccagaagaccaagaauaacgacugggacuacgucgugaccacagauaucagcgagaugggcgccaauuuuagagccgaccggguuauugaucccagacgcugccuuaagccugugauccugaaggacgggcccgaacgggucauucuggcuggcccgaugccugugaccguugccucugcggcucaaagacgcggacggaucggcagaaaccacaauaaagagggggaucaguauaucuacaugggacagccccucaacaaugacgaggaucaugcccacuggacggaagccaagaugcugcuugacaacauuaauacccccgagggcaucauuccugcucuguucgaacccgagcgcgaaaaauccgccgcgaucgauggggaguaucggcucagaggagaggcccgcaagacauuuguggaacugaugagacggggcgaccugccugucuggcucagcuacaaaguggcuuccgagggguuccaguauucugaucgcagauggugcuuugacggcgaacggaacaaucaaguccuugaggaaaacauggauguggagauuuggaccaaggagggagaacgcaaaaagcugagaccgcgguggcuggacgccagaacauacagcgacccccucgcucugcgcgaguucaaggaauuugccgcuggccggagauccguuucuggggaucuuauccuggagaucggaaaacucccucagcaccugacccagcgcgcccagaaugcgcuggacaaccucgugaugcuucauaauagcgaacaaggcgggcgggccuauagacacgcuauggaggagcugcccgauacaauugaaacccugaugcuccuggcccuuaucgcugugcugacgggaggcgucacacucuucuuucuguccggccgggggcugggaaagaccagcauuggccuccuuuguguuauggccucuuccgugcugcuguggauggccagcguggagccucauuggaucgcugcgucuauuauccucgaguucuuucugaugguccuucugauccccgagccggaccgccagagaaccccucaggauaaccagcucgccuacgugguuauugggcugcuguucaugauccucacaguggcugccaaugagaugggacuucuggaaaccaccaagaaggaccugggcauugggcacgucgccguggagaaccaccaucacgcugccaugcucgaugucgaccugcaucccgcguccgccuggacgcuuuacgcuguggccaccacaaucauuaccccuaugaugcggcacacaaucgaaaacaccacggcuaauauuagccugaccgccaucgcgaaccaagccgcuauccucaugggacuggauaaaggcuggcccauuucuaagauggacaucggcguuccucugcucgcccuugggugcuauagccaggugaauccccugacacugaccgcugccguccucaugcugguggcucauuacgccauuaucggaccgggccuucaggcgaaggccacacgcgaggcucagaaaagaaccgccgcugggauuaugaagaacccuacgguugauggaaucguggccaucgaccuggaucccgucguguaugacgccaaauuugaaaagcagcucggccagauuaugcugcugauccucuguacaucccagauucuucugaugcggaccacaugggcgcugugcgagucuaucacccucgcuaccgggccccugacaacgcuuugggagggaagcccuggcaaauucuggaauaccacaauugccguguccauggcuaacaucuuccgcggcagcuaccuggccggggccggacucgcuuuuucccugaugaagucucugggcgggggaagacggggcaccggggcccaaggagaaacacucggcgagaaguggaaacgccagcuuaaucagcugggcaagagcgaguucaacaccuauaaaagauccgggaucauggagguugaccggucugaagcgaaggagggacugaaaagaggcgagacgacaaagcacgccgucagccgcgggaccgcuaagcuccggugguuuguggaaagaaaucuggugaaaccggagggaaaggucauugaucuuggcugugggcgcggaggcugguccuacuauugcgccggccugaaaaagguuaccgaagugaaaggguacacaaagggaggccccgggcacgaggaaccuauccccauggcuaccuacggauggaaccucgugaaacugcauucuggcaaggacgucuucuuuauuccucccgagaagugugauacacugcucugcgacaucggggagagcuccccuaauccgacgauugaagagggacggacccuuagagugcugaaaaugguugaacccuggcugcgcggcaaccaguucuguaucaagauucucaauccuuauaugcccagcguggucgagacacuggagcaaaugcagcggaaacacggcgggaugcuugugagaaacccucugucucgcaauuccacccaugaaauguacuggguuagcugcggaacaggcaacaucgugucugccgucaauaugaccucccggaugcuccugaacagauuuacgauggcgcaccgcaagcccaccuaugagcgggauguggaccugggggccggaacaagacacguggcugucgaaccggagguugccaaccucgauaucauuggccagcgcaucgaaaauauuaaacaugagcacaagagcaccuggcauuacgacgaggauaacccuuauaagacaugggcuuaccacgggucuuaugaagugaaacccuccggaagcgccuccagcauggugaauggcgucgugaagcugcuuaccaaacccugggacguuaucccuauggugacacagauugcuaugaccgauacgacacccuucggccaacagagagucuuuaaggagaaaguggacacccggaccccuaaggccaagcgcgggacagcgcagaucauggaaguuacggccaaauggcuguggggauuccucucuagaaacaagaaaccgcggaucuguaccagagaggaauuuacacggaaggugcgcagcaaugcugccauuggcgcugucuucguggacgagaaccaauggaacuccgccaaagaggccguugaagaugagagauuuugggaccuggugcaucgggaacgcgagcuucacaagcaggggaagugcgcgaccugcgucuacaacaugaugggaaaaagagaaaagaaacugggcgaguucgggaaggcuaaaggcucucgggccaucugguacauguggcucggagcccgcuuccuggaguuugaagcucugggcuucaugaaugaggaucacugguuuagcagagaaaacucccucucugggguggagggagagggccugcauaaacuuggguauauucugcgggacaucagcaaaauucccggaggcaauauguacgccgaugacacagcugggugggauacccgcaucacagaagacgaucuccagaacgaggccaagaucaccgacauuauggaaccugagcacgcgcugcuugccaaguccaucuucaaacugacguaucagaauaaggucgugagaguucaacggcccgcuaaaaacggcaccgugauggaugucauuucucgcagagaccagcggggaagcggccagguggggacauacggacucaauaccuuuacaaacauggaagcccagcugauccgccaaauggaguccgagggcauuuucagcccuucugaacuggagacccccaaccucgcugggagagugcuggauuggcuugaaaagcauggaguugagcggcugaaaagaauggccaucuccggcgacgacuguguggucaagccgaucgaugaccgcuuugcgacggcccucacagcucugaaugauauggggaaggugcggaaagacauuccucagugggaacccagcaagggcuggaacgauuggcagcagguuccuuucugcucucaccacuuucaucaacuuaucaugaaagacggaagagagauugugguccccugucgcaaucaggaugagcuggugggccgggccagagucucccagggggcuggauggagccuccgcgaaaccgccugccugggcaaguccuaugcucagauguggcaacugauguacuuccaccggagagaccuccgccuggccgcgaacgccaucuguucugcugugccuguugauugggugcccacaagccggaccacgugguccauucaugcccaccaucaguggaugaccacagaggacaugcuuagcgucuggaauagaguguggaucgaagagaacccguggauggaagauaaaacccacauuucuuccuggggagacguuccuuaucugggaaagcgcgaggaccaguggugcggcagccucaucgggcugacagcccgggcuaccugggccacaaauauccaaguggcgauuaaccaggucagacggcuuaucggcaaugagaacuaccuggauuacaugaccucuaugaagagauuuaaaaaugaaagcgaccccgagggagcucucugguga

SEQ ID NO: 18944 - RNA, 9879 nt, Artificial Sequence
  derived and/or modified CDS sequence (opt5) from DENV-1__FJ410236__SS-prME
agcgugaccaugcugcucaugcuggugcccacagcccuugcuuuccaccugacgaccagaggcggggaaccucauaugaucguuuccaagcaggaacggggaaaaucucuccuguuuaagacaagcgccggcgugaacaugugcacccuuaucgcgauggaccugggggagcucugugaagauacaaugaccuacaaaugcccccgcaucacagagaccgaacccgacgauguggacuguuggugcaaugcuacggauaccugggucacauauggaaccuguucccaaacaggcgagcacagacgggacaagcgcucuguggcccuggccccucauguugggcugggacucgagaccagaacggaaacauggaugagcuccgagggcgcuuggaaacagauucagcggguggaaaccugggcccugcgccaccccggcuucacagucaucgcucuuuuucuggcccaugcgauugggaccucuaucacccagaagggaaucauuuucauccuccugaugcuugugacaccuagcauggccaugagaugcguuggcauugggucccgggauuuuguggagggacugagcggcgcuacgugggucgacguggugcucgagcacgggucuugugucaccacaauggccaaggauaaacccacccuggacaucgaacugcucaagacagagguuaccaacccugcugugcugcgcaaacuuugcauugaagccaagaucuccaauacgacaaccgauagcagauguccgacccaaggagaggcgacacugguggaagaacaagacgccaacuucgucugccggcgcaccuuuguggauagaggcuggggcaauggguguggacucuucggcaaagggucucugauuacaugcgcuaaguuuaagugcguuacgaaacuugagggaaagaucgugcaguacgaaaaccugaaauauuccgucaucgugaccguucacacaggcgaccagcaucaaguggggaaugagagcaccgaacacggaacaaccgccacgauuacaccccaagcuccuaccaccgagauccagcucacagacuacggcgcccugacccuggauuguucuccccggacgggccucgacuucaacgaaaugguccugcuuacaaugaaggagaaauccuggcuggugcauaagcagugguuucucgaucugccucuucccuggaccagcggggccuccacaucucaagagaccuggaaucgccaggaccugcucgucaccuucaaaacagcucacgcgaagaagcaggaagugguugugcugggaagccaagagggcgccaugcacacggcucugaccggggccacagaaauucagaccuccggaacaaccacgaucuuugccggccaucucaaaugcagacugaagauggauaaacuuacacugaaggggaugagcuaugucauguguaccggcucuuucaaacucgagaaggaaguggcugagacccagcacggaacaguucuggugcagauuaaguacgagggcaccgacgccccgugcaaaaucccuuucuccacacaagaugaaaagggggucacgcagaacggacggcugaucaccgcgaaucccauugugacagacaaagagaagccugugaacaucgaagcugagccgcccuuuggcgagagcuauauuguuaucggggccggagaaaaagccaugaaacuuucuugguucaagaaaggcagcuccauugggaagauguuugaggcuaccgccagaggcgcucgccggauggccauccucggagauacagcgugggacuucggcucuaucgggggagucuuuaccagcgugggcaaacuggugcaucagauuuucgggacggccuacggaguccuguuuuccggcgugagcuggaccaugaagaucgggauuggcguucuccugacauggcuuggacucaauucuagauccaccagccucucuaugacauguaucgcugugggccuggucacccuguaccuuggggugaugguucaggccgauuccggaugcgugauuaacuggaaaggccgcgaacucaagugugggagcggaaucuucgucacaaaugaggugcacaccuggacggaacaauauaaguuucaggcugacuccccuaaacggcugucugccgcgauuggcaaggccugggaggaggggguuugcggcaucagaagcgcuacacgccuggaaaacaucauguggaaacagauuuccaacgagcucaaucauauccugcuugaaaacgacaugaaguucaccguggucgugggagauguggccggcauucuggcucaggggaaaaagaugauccggccgcaacccauggaguacaaauauucuuggaaaagcuggggaaaggccaagauuaucggcgccgacguccagaauaccacauuuaucauugaugggccuaacacccccgaauguccugacgaucagagagcuuggaauaucugggagguugaggacuacggauucggcauuuuuacgacaaacaucuggcucaagcugcgcgauuccuauacccaggugugcgaccaccggcugaugagcgcggccauuaaagauucuaaggcugugcacgccgacaugggcuacuggaucgaauccgagaaaaaugaaacauggaaacuugccagagcuagcuucaucgaggucaagaccuguauuuggcccaaaucucauacacucugguccaacggggugcuggaaagcgagaugaucauuccgaagaucuauggaggcccuauuucucaacacaauuaccgccccggguacuucacccagacggccggaccuuggcaucugggcaaacucgagcuggauuuugaccuuugcgaagggaccacaguuguggucgaugagcacugcggaaaccggggccccagccugagaaccacaaccgugacgggcaagaucauccacgaaugguguugccgguccuguacacucccuccccugcgcuucagaggggaggacggaugcugguauggcauggagauucggccgguuaaagaaaaggaggaaaaucuggucaagagcauggucucugcgggguccggagagguggacagcuuuucccuuggccuccuguguaucucuauuaugaucgaagagguuaugagaagccgcuggucccggaaaaugcugaugaccgggacacucgcuguguucuuucugcuuauuaugggacagcugaccuggaacgaucucaucagacugugcauuauggucggcgccaaugccucugaccgcaugggcauggggaccacauaccuggcucuuauggccacguucaagaugagaccuauguuugcggugggacugcuguuccggcgccugaccagcagagaggugcuccugcuuacaaucggccugucccucgucgcuucuguugaacugcccaacagccuggaggaacuuggggauggacuggccaugggcaucaugauucucaaacugcucaccgacuuucaaucccaucagcugugggccacacuucugagccucaccuucaucaagacgacauuuucucugcacuaugcuuggaaaaccauggccauggugcuguccauugugagccuuuucccccugugucucucuaccacaucccagaagaccacauggcugccuguccuccuggggagccuuggaugcaagccgcugacgauguuucugaucgcugagaauaaaauuuggggccggcgcucuuggccccucaacgaaggcaucauggccguggggaucguuuccauucugcuuagcucccugcucaagaacgaugugccucuggcgggaccccucaucgccggcgggaugcugauugcuuguuacgucaucagcggaucuagcgccgaccuuucccuggagaaagcugccgaggugucuugggaagaggaagccgagcauagcggcgcuucccacaauauucugguugaagugcaggaugacgggaccaugaagaucaaagaugaggagagagacgauacacucaccauccugcuuaaggcgacacugcucgccgucucuggaguguauccucugagcauucccgcuacccucuucgucugguacuucuggcagaagaagaagcagcgguccggcgugcugugggacacgccuucucccccggaaguugagcgcgccgugcuugaugacggcaucuauagaauuaugcagcgggggcugcugggacgcagccaggucggcguggggguuuuucaagaaaacguguuccauaccauguggcacgucacaagaggagccgugcucauguaccagggcaaacggcuggagccuuccugggcuagcgugaagaaagaccuuaucucuuacgggggaggcuggagacugcagggcuccuggaauaccggggaggaaguucaggucauugccguggagcccggaaagaacccuaaaaaugugcaaacagcgcccggcaccuuuaagacaccggaaggggaggucggagcuaucgcccucgauuucaagccuggcacgagcgggucucccauugugaaccgcgaaggaaaaaucguuggccuguauggcaaugggguggucaccacauccggaaccuacgugagcgccaucgcucaggccaaggcgucccaggagggcccucuccccgagauugaagacgagguuuuucggaaaagaaaccugaccaucauggaucuucaccccgggucuggaaagacacgccgguaucugccugcuauugugagagaagccaucaaacgcaagcugcggacgcucauucuggccccgaccagagucguggcuagcgagauggccgaagcucuuaagggcaugcccauccgcuaccaaacaaccgccguuaaauccgagcauacagggaaggagaucguggaccugaugugccacgcgaccuucacgaugcggcuccugagcccugucagagugcccaauuauaacaugauuaucauggaugaagcccauuuuacagacccuucuuccauugcugcccggggcuacaucagcacccgcgugggaaugggcgaggcugccgccauuuucaugaccgcuacacccccugggucugucgaagcguuuccgcagagcaaugccguuauccaggaugaggaaagagacauccccgagcgguccuggaacucuggauaugaguggauuaccgauuucccuggcaaaacagugugguuugugcccagcaucaaguccgggaaugacauugcuaacugucugcgcaaaaauggaaagagagucauccagcucucucggaagaccuucgauacggaauaccagaagaccaagaacaacgacugggacuacgugguuaccacagauauuagcgagaugggcgccaauuucagagccgaccgcgugaucgauccucggagaugccuuaaacccgucauucugaaggacgggccggaacgcgugauccuggcuggcccuaugcccguuaccguggccuccgcggcucagcggagaggacgcaucggccggaaccacaauaaagagggggaucaguauauuuacaugggacagccccucaacaaugacgaggaucaugcccacuggacggaagccaagaugcugcuugacaacaucaauaccccugagggcauuauccccgcucuguuugaaccugagagagaaaagagcgccgcgauugauggggaguaucgccucagaggagaggcccggaaaacauucgucgaacugaugcgcagaggcgaccugccgguguggcucucuuacaaggucgcuuccgagggguuucaauauagcgaucggcgcuggugcuucgacggcgaaagaaacaaucaggugcuugaggaaaacauggauguugagaucuggaccaaagagggagaacggaagaaacugagaccccgcuggcuggacgcccggacauacuccgacccucucgcucugagagaguuuaaggaguucgccgcuggccgccggucugugagcggggaucuuauccuggagauuggaaaacucccccagcaccugacccagagagcccaaaaugcgcuggacaaccucgugaugcuucauaauuccgaacagggcgggcgggccuaucgccacgcuauggaggagcugccugauacaaucgaaacccugaugcuccuggcccuuauugcuguccugacgggaggcguuacacucuuuuuccugucuggcagagggcugggaaagaccagcaucggccuccuuugugugauggccuccagcgugcugcuguggauggccucugucgagccccauuggauugcugcguccaucauccucgaauuuuuccugauggugcuucugauuccggagccugaccggcagcgcacaccccaggauaaccaacucgccuacguugugaucgggcugcuguuuaugauucucacagucgcugccaaugagaugggacuucuggaaaccacaaagaaagaccugggcaucgggcacguggccgucgagaaccaccaucacgcugccaugcucgauguggaccugcauccugcgagcgccuggacgcuuuacgcuguugccaccacaauuaucacccccaugaugagacacacaauugaaaacaccacggcuaauaucucucugaccgccaucgcgaaccaggccgcuauucucaugggacuggauaagggcuggccuaucuccaaaauggacauuggcgugccccugcucgcccuugggugcuauagccaggucaauccgcugacacugaccgcugccgugcucaugcugguugcucauuacgccaucauuggaccuggccuucaagcgaaggccacacgggaggcucagaaacgcaccgccgcugggaucaugaagaaccccacgguggauggaaucgucgccauugaccuggaucccgugguguaugacgccaaguucgaaaaacagcucggccagaucaugcugcugauucucuguacaucucaaauccuucugaugagaaccacaugggcgcugugcgagagcauuacccucgcuaccgggccucugacaacgcuuugggagggauccccgggcaaguuuuggaauaccacaaucgccguuucuauggcuaacaucuuccggggcagcuaccuggccggggccggacucgcuuucucccugaugaaaagccugggcgggggacgcagaggcaccggggcccagggagaaacacucggcgagaaguggaaacggcagcuuaaucagcuguccaagucugaauuuaacaccuauaagagaagcggcauuauggaggucgaccgcuccgaagcgaaagaggggcugaagcggggagagacgacaaaacacgccgugucuagaggcaccgcuaagcuccgcugguucguggaacggaaucuggucaaacccgaggggaagguuaucgaucuuggauguggcagagggggauggagcuacuauugcgccggccugaagaaagugaccgaagugaagggcuacacaaaagggggaccuggccacgaggaacccauuccuauggcuaccuacggguggaaccucgucaagcugcauuccggaaaagacguguuuuucauucccccugagaagugugauacacugcucugcgacauuggcgagucuagcccgaaucccacgaucgaagaggggcgcacccuucggguucugaaaaugguggaaccuuggcugagaggaaaccaauuuuguauuaagauccucaaucccuauaugccuuccgucguggagacacuggagcagaugcagcgcaagcacggcggcaugcuuguucggaacccccugagcagaaauucuacccaugaaauguacuggguguccugcgggacaggaaacaucgucagcgccgugaauaugaccucucgcaugcuccugaaccgguucacgauggcgcacagaaaaccgaccuaugagcgcgauguggaccugggcgccgggacaagacacgucgcuguugaaccugagguggccaaccucgauauuaucggacagcggauugaaaauaucaagcaugagcacaaauccaccuggcauuacgacgaggauaaccccuauaagacaugggcuuaccacggcagcuaugaagugaaacccucuggguccgccagcuccauggucaauggagugguuaagcugcuuaccaagccuugggacgugauucccauggucacacaaaucgcuaugaccgauacgacaccuuuuggccagcagcgcguguucaaagagaagguugacaccagaaccccgaaagccaagcggggcacagcgcaaaucauggaagugacggccaaauggcuguggggguuucucagcagaaacaagaagccccggauuuguacccgcgaggaguucacaagaaaaguccggucuaaugcugccaucggagcuguguuuguugacgagaaccaguggaauagcgccaaggaggccguggaagaugagcgcuucugggaccugguccauagagaacgggagcuucacaaacagggcaagugcgcgaccugcguguacaacaugauggggaaacgcgaaaagaagcugggagaguuuggcaaagcuaagggguccagagccauuugguacauguggcucggcgcccgguuccuggaguucgaagcucugggauuuaugaaugaggaucacugguucucucgcgaaaacagccucuccggcgucgagggggagggacugcauaaacuuggcuauauccugagagacauuucuaagaucccugggggaaauauguacgccgaugacacagcuggcugggauacccggaucacagaagacgaucuccagaacgaggcccgcauuaccgacaucauggaacccgagcacgcgcugcuugccaaaagcauuuuuaagcugacguaucaaaauaaagugguuagagugcagcggccugcuaagaacgggaccgucauggaugugaucucccgcagagaccagcggggcucuggacaggugggcacauacgggcucaauaccuucacaaacauggaagcccaacugauuagacagauggagagcgagggaaucuuuucccccagcgaacuggagaccccgaaccucgcugaacgcguucuggauuggcuugagaaguauggcgugaaacggcugaagagaauggccaucucuggggacgacugugucgugaaaccuauugaugaccgcuucgcgacggcccucacagcucugaaugauaugggaaagguucggaaagacaucccccagugggaaccuuccaagggcuggaacgauuggcagcaagugcccuuuugcagccaucacuuccaccagcuuauuaugaaggacgggagagagaucgucgugccuugucgcaaucaggaugagcuggucggccgggccagagugucucagggagcuggcuggucccuccgcgaaaccgccugccuggggaaaagcuacgcucaaauguggcagcugauguauuuucaucggagagaccuccgccuggccgcgaacgccauuuguuccgcuguucccguggauuggaucccgacaucucggaccacguggagcauucacgcccaucaccaguggaugaccacagaggacaugcuuuccgucuggaauagaguguggaucgaagagaacccuuggauggaagauaagacccauaucagcucuuggggagacguucccuaccugggcaaacgggaggaccaauggugcgggucccucauuggacugacagccagagcuaccugggccacaaauauccagguggcgauuaaccagguccgccggcuuaucggcaaugagaacuaccuggauuauaugaccagcaugaagagauucaaaaaugaaucugaccccgagggggcucucugguga

SEQ ID NO: 18945 - RNA, 9879 nt, Artificial Sequence
  derived and/or modified CDS sequence (opt5) from DENV-1__FJ410238__SS-prME
agcgugaccaugcugcugaugcugaugcccacagcccuugcuuuccaccugacgaccagaggaggggaaccucauaugaucguguccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaagcugacgguuguggucggagauguggcuggcauucucgcccaggggaaaaagaugauccggccgcaacccauggaguacaaauauagcuggaaguccuggggaaaggccaaaauuaucggcgcugacgugcagaauacaaccuuuaucauugaugggccuaacacccccgaauguccugacgaucagagagcguggaauaucugggaggucgaggacuacggauucggcauuuuuacaaccaacaucuggcugaagcugcgcgauagcuauacgcagguuugcgaccaccggcuuaugucugccgcuauuaaagauuccaaggccgugcacgccgacaugggcuacuggaucgaaagcgagaaaaaugaaacauggaagcucgcuagagccucuuucaucgaggugaagaccuguauuuggcccaaaucccauacacuguggagcaacgggguccuggaaucugagaugaucauuccgaagaucuauggaggcccuauuagccaacacaauuaccgccccggguacuucacccagacagcgggaccuuggcaucucggcaaacuggagcuugauuuugaccugugcgaagggaccacggugguuguggaugagcacugcggaaaccggggccccucccucagaaccacaaccgucacaggcaagaucauccacgaaugguguugccggagcuguacccugccuccccugcgcuucaaaggggaggacggaugcugguauggcauggagauuagaccggugaaggaaaaggaggaaaaucuuguuaaaucuaugguguccgcugggagcggagaggucgacuccuuuucucucggccugcuguguaucagcauuaugaucgaagaggugaugcgguccagauggucucgcaagaugcucaugacggggacacuggccguuuucuuucuucugauuaugggacagcucaccuggaacgaucugauccggcugugcauuauggugggcgccaauacaagcgacagaaugggcauggggaccaccuaccuugcucugauggccacauucaaaaugcgcccuauguuugcggucggacuccuguucagacggcucacgucccgcgaggugcugcuucugaccaucggccucucucugguggcuagcgccgaacugcccaacucccuugaggaacugggggauggacucgccaugggcaucaugauucugaagcuccugacagacuuucaaagccaucagcuuugggcuacccugcucucucugacauucaucagaaccacguuuucccugcacuaugccuggaaaacaauggcuaugguccuuagcauuguuucucuguucccccucugucuguccaccaccagccagaagacaaccuggcucccugugcugcuugggucucugggaugcaagccgcugacaauguuucucaucgccgagaauaaaauuuggggccggaaguccuggccccugaacgaaggcaucauggcgguggggaucgucagcauucuucuguccagccuccugaaaaacgaugugccucucgccggaccccugaucgcuggcgggaugcuuauugccuguuacguuaucucuggaagcuccgcugaccugucucuggagaaggccgccgaggugagcugggaagaggaagcugagcauuccggcgcgucucacaauauucucgucgaagugcaggaugacgggacgaugaaaaucaaggaugaggagcgcgacgauacccugacaauccuucugaaagccacccuccuggcuguuagcggaguguauccucucuccauucccgccacacuguucgucugguacuucuggcaaaagaagaaacagagaucuggcgugcuuugggacaccccuuccccucccgaagucgagcgggccgugcuggaugacggcaucuaucgcauuaugcagagagggcugcucggacggucccagguuggcgugggggucuuucaagaaaacguguuccauacgauguggcacguuacccgcggagcugugcugauguaccagggcaagagacuugagcccagcugggccucugucaaaaaggaccugaucuccuacgggggaggcuggcggcuccagggcagcuggaauacaggggaggaaguccaggugauugcgguugagcccggcaagaauccuaagaauguccaaaccgcucccggcacauuuaagaccucugaaggggaggugggagccaucgcccuggauuucaaaccgggcacauccgggagcccuauugugaacagagaaggaaagaucgucggccucuauggcaauggggugguuacgaccuccggaacauacgugucugcuaucgcccaggcgaaagcuagccaggagggcccccugccugagauugaagacgaggucuuucgcaagcggaaccuuaccaucauggaucugcaccccggguccggaaaaaccagacgcuaucugcccgccauugugcgggaagccaucaagagacgccuccggacacugauucuugcuccuacgagaguuguggccagcgagauggcugaagcccugaagggcaugccgauccgcuaccaaaccacagcggucaaaucugagcauaccgggaaggagaucguggaccucaugugccacgccacauucaccaugcggcugcugucccccguuagagugccuaauuauaacaugauuaucauggaugaagcucauuuuacggaccccagcucuauugccgcucggggcuacaucagcacacgcgucggaaugggcgaggccgccgcuauuuucaugaccgcgaccccucccggguccguggaagccuuuccucagucuaaugcugugauccaggaugaggaaagagacaucccggagcggagcuggaacuccggauaugaguggauuacagauuuccccggcaaaaccgucugguuuguuccuucuaucaagagcgggaaugacauugccaacugucuccgcaaaaauggaaagagagugauccagcuuucccggaagacauucgauaccgaauaccagaagacgaagaacaacgacugggacuacguggucacaaccgauauuagcgagaugggcgccaauuucagagcugaccgcgugaucgauccccggagaugccugaaaccuguuauucugaaggacgggcccgaacgcgugauccucgccggcccgaugccugucacaguggcgucugcugcccagcggagaggacgcaucggccggaaccacaauaaagagggggaucaguauauuuacaugggacagccccugaacaaugacgaggaucaugcccacuggaccgaagcuaagaugcuucuggacaacaucaauacgcccgagggcauuaucccugcccucuuugaacccgagagagaaaaguccgcggccauugauggggaguaucgccugagaggagaggcucggaaaaccuucguugaacugaugcgcagaggcgaccucccuguguggcuuagcuacaaggucgccuccgagggguuucaauauucugaucggcgcuggugcuucgacggcgaaagaaacaaucaggugcuggaggaaaacauggaugucgagaucuggacaaaagagggagaacggaagaaacugagaccgcgcuggcucgacgcucggaccuacagcgacccccuggcccuuagagaguuuaaggaguucgcugccggccgccgguccgugucuggggaucugauccucgagauuggaaaacugccucagcaccugacacagagagcgcaaaaugcccucgacaaccuuguuaugcugcauaauagcgaacagggcgggcggguguaucgccacgcuauggaggagcugcccgauaccaucgaaacacucaugcugcuugcccugauugcugugcucaccggaggcgucacgcuguuuuuccuguccggcagagggcucggaaagacaagcaucggccuucuguguguuauggccucuuccgugcugcucuggauggccagcguggagccucauuggauugcugcgucuaucauccuggaauuuuuccuuaugguccugcucauucccgagccggaccggcagcgcaccccucaggauaaccaacuggccuacgugguuaucgggcugcucuuuaugauucuuaccguggcugccaaugagaugggacugcuggaaacaaccaagaaagaccucggcaucgggcacgucgccguggagaaccaccaucacgcugccaugcuggaugucgaccuucaucccgcguccgccuggacacuguacgcuguggccacgaccauuaucacaccuaugaugagacacaccauugaaaacacaaccgcuaauaucagccucacggccaucgcgaaccaggccgcuauucugaugggacuggauaagggcuggcccaucucuaaaauggacauuggcguuccucuccuugcccuggggugcuauagccaggugaauccccugacccucacagcugccguccugaugcuuguggcucauuacgccaucauuggaccgggccugcaagcgaaggccacccgggaggcucagaaacgcacagccgcugggaucaugaagaacccuaccguugauggaaucguggccauugaccucgaucccgucguguaugacgccaaguucgaaaaacagcugggccagaucaugcugcucauucuuuguacgucccaaauccugcugaugagaacaaccugggcgcucugcgagucuauuacacuggcuaccgggccccuuaccacacugugggagggaagcccuggcaaguuuuggaauacgaccaucgccguguccauggcuaacaucuuccggggcagcuaccucgccggggccggacuggcuuucucccugaugaaaucucucggcgggggacgcagaggcacaggggcccagggagaaacccuuggcgagaaguggaaacggcagcugaaucagcugagcaaguccgaauuuaacacauauaagagaucuggcauuauggagguugaccgcagcgaagcgaaagaggggcucaagcggggagagaccacgaaacacgccgucuccagaggcacagcuaagcugcgcugguucguggaacggaaucuugugaaaccggaggggaaggucaucgaucugggauguggcagagggggauggucuuacuauugcgccggccucaagaaaguuaccgaagugaagggcuacaccaaagggggacccggccacgaggaaccuauucccauggcuacauacggguggaaccuggugaagcugcauagcggaaaagacgucuuuuucaucccucccgagaagugugauacccuccuuugcgacauuggcgaguccagcccuaauccgacaaucgaagaggggcgcacgcugcgggugcugaaaaugguugaacccuggcucagaggaaaccaauuuuguauuaagauccugaauccuuauaugcccucuguggucgagacccuugagcagaugcagcgcaagcacggcggcaugcuggugcggaacccucucuccagaaauagcacacaugaaauguacuggguuucuugcgggaccggaaacaucguguccgccgucaauaugacaagccgcaugcugcugaaccgguucaccauggcgcacagaaaacccacguaugagcgcgauguggaccucggcgccgggaccagacacguggcugucgaaccggagguugccaaccuggauauuaucggacagcggauugaaaauaucaagcaugagcacaaaucuacauggcauuacgacgaggauaacccuuauaagaccugggcuuaccacggcuccuaugaagugaaacccagcggguccgccagcucuauggugaauggagucgugaaacuucugacaaagcccugggacguuauuccuauggugacccaaaucgcuaugacagauaccacgcccuuuggccagcagcgcgucuucaaagagaagguggacacaagaaccccuaaagccaagcggggcaccgcgcaaaucauggaaguuacagccaaauggcucuggggguuucugagcagaaacaagaagccgcggauuuguacgcgcgaggaguucaccagaaaagugcgguccaaugcugccaucggagcugucuuuguggacgagaaccaguggaacucugccaaggaggccguugaagaugagcgcuucugggaccuugugcauagagaacgggagcugcacaaacagggcaagugcgcgacaugcgucuacaacaugauggggaaacgcgaaaagaagcucggagaguuuggcaaagcuaaggggagcagagccauuugguacauguggcugggcgcccgguuccuggaguucgaagcucucggauuuaugaaugaggaucacugguucucccgcgaaaacucucugagcggcguggagggggagggacuucauaaacugggcuauauccucagagacauuuccaagauccccgggggaaauauguacgccgaugacaccgcuggcugggauacacggaucaccgaagacgaucugcagaacgaggccaaaauuacagacaucauggaaccugagcacgcgcuucuggccaagucuauuuuuaaacucaccuaucaaaauaaggucgugcgcguucagagacccgcuaagaacgggacggugauggaugucaucagccggcgcgaccagagaggcuccggacaggugggcaccuacgggcugaauacauucaccaacauggaagcccaacugauucggcagauggagagcgagggaaucuuuucuccuuccgaacucgagacacccaaccuggcuggcagagugcuugauuggcuggaaaaacaugggguugagcgccucaagcggauggccaucagcggagacgacuguguggucaaaccgauugaugacagauucgcgaccgcccugacggcucuuaaugauaugggcaaggugcgcaaagacaucccucagugggaacccucuaagggguggaacgauuggcagcaaguuccuuuuugcucccaccacuuccaucagcugauuaugaaggacggccgggagaucgugguccccuguagaaaucaggaugagcucgugggacgcgcccgggucagccagggcgcuggguggucccugagagaaacagccugccugggaaaaucuuaugcucaaauguggcagcucauguacuuucaccgccgggaccugagacuugccgcgaacgccauuuguagcgcugugccuguugauugggugcccaccucccgcacaaccuggagcauccaugcccaccaucaguggaugacgaccgaggacaugcugucugucuggaaucggguguggauugaagagaacccguggauggaagauaagacacacguuuccagcuggggcgacgugccuuaucucgggaaaagagaggaccaauggugcggaucucugaucggccuuaccgcccgggcuacaugggccaccaauauccaggucgcgauuaaccaggugagacgccugcucgggaaugagaacuaccuggauuacaugacaagcaugaagcgguucaaaaaugaauccgaccccgagggcgcucugugguga

SEQ ID NO: 18946 - RNA, 9879 nt, Artificial Sequence
  derived and/or modified CDS sequence (opt5) from DENV-1__FJ410239__SS-prME
agcgugaccaugcugcucaugcugaugcccacagcccuugcuuuccaccugacgaccagaggcggggaaccucauaugaucgucuccaagcaggaacgggggaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcgccggcaaacucguucaucagauuuucgggacggcuuacggaguccuguuuuccggcgugagcuggaccaugaagaucgggauuggcgugcuucugacauggcucggacucaauucuagauccaccagccugucuaugacauguaucgccgucggccuugugacccucuaccuggggguuauggugcaggcugauuccggaugcgucauuaacuggaaaggccgcgaacugaagugugggagcggaaucuucgugacaaaugagguucacaccuggacggaacaauauaaguuucaggccgacuccccuaaacggcucucugcggccauuggcaaggcuugggaggagggggugugcggcaucagaagcgccacacgccuggaaaacaucauguggaaacagauuuccaacgagcuuaaucauauccugcucgaaaacgacaugaaguucaccgucgugguuggagauguggcuggcauucuggcccaggggaaaaagaugauccggccgcaacccauggaguacaaauauucuuggaaaagcuggggaaaggccaagauuaucggcgcugacguccagaauaccacauuuaucauugaugggccuaacacccccgaauguccugacgaucagagagcguggaauaucugggagguggaggacuacggauucggcauuuuuacgacaaacaucuggcugaaacuucgcgauuccuauacccaggugugcgaccaccggcucaugagcgccgcuauuaaagauucuaaggccguccacgccgacaugggcuacuggaucgaauccgagaaaaaugaaacauggaagcuggcuagagccagcuucaucgagguuaagaccuguauuuggcccaaaucucauacacugugguccaacggggugcucgaaagcgagaugaucauuccgaagaucuauggaggcccuauuucucaacacaauuaccgccccggguacuucacccagacggcgggaccuuggcaucugggcaaacuugagcuggauuuugaccucugcgaagggaccacaguggucguggaugagcacugcggaaaccggggccccagccugagaaccacaaccguuacgggcaagaucauccacgaaugguguugccgguccuguacacugccuccccuucgcuucagaggggaggacggaugcugguauggcauggagauucggccggugaaagaaaaggaggaaaaucucgucaagagcauggugucugcuggguccggagagguugacagcuuuucccugggccugcucuguaucucuauuaugaucgaagaggugaugagaagccgcuggucccggaaaaugcugaugaccgggacacuugccgucuucuuucugcucauuaugggacagcugaccuggaacgaucugaucagacuuugcauuauggugggcgccaaugcuucugaccgcaugggcauggggaccacauaccuggcccucauggcgacguucaagaugagaccuauguuugcuguuggacugcuguuccggcgccugaccagcagagaggugcuucugcucacaaucggccugucccuggucgccucuguggaacuucccaacagccuggaggaacucggggauggacuggccaugggcaucaugauucucaaacugcuuaccgacuuucaaucccaucagcugugggcuacacuccugagccugaccuucaucaagacgacauuuucucuucacuaugccuggaaaaccauggcuauggugcuguccauugucagccucuucccccugugucucucuaccacaucccagaagaccacauggcugccuguuuuucuugggagccugggaugcaagccgcugacgauguuccucaucgccgagaauaaaauuuggggccggcgcucuuggccccugaacgaaggcaucauggcgguggggaucguguccauucuucugagcucccuccugaagaacgaugucccucucgccggaccccugaucgcuggcgggaugcuuauugccuguuacgugaucagcggaucuagcgcugaccugucccuggagaaagccgccgagguuucuugggaagaggaagcugagcauagcggcgcgucccacaauauucucguggaaguccaggaugacgggaccaugaagaucaaagaugaggagagagacgauacacugaccauccuucugaaggccacacuccuggcugugucuggaguuuauccucucagcauucccgccacccuguucgugugguacuuuuggcagaagaagaagcagcgguccggcguccuuugggacacgccuucucccccggaaguggagcgcgccguccuggaugacggcaucuauagaauuaugcagcgggggcugcucggacgcagccaggugggcguugggguguuccaagaaaacgucuuucauaccauguggcacgugacaagaggagcuguucugauguaccagggcaaacggcuugagccuuccugggccagcgugaagaaagaccugaucucuuacgggggaggcuggagacuccagggcuccuggaauaccggggaggaaguccaggugauugcgguggagcccggaaagaacccuaaaaauguucaaacagcucccggcaccuucaagacaccggaaggggaggucggagccaucgcccuggauuuuaagccuggcacgagcgggucucccauugugaaccgcgaaggaaaaaucgugggccucuauggcaauggggucgugaccacauccggaaccuacguuagcgcuaucgcccaggcgaaggcuucccaggagggcccucugcccgagauugaagacgagguguuccggaaaagaaaccuuaccaucauggaucugcaccccgggucuggaaagacacgccgguaucugccugccauugucagagaagccaucaaacgcaagcuccggacgcugauucuugcuccgaccagagugguugccagcgagauggcugaagcccugaagggcaugcccauccgcuaccaaacaaccgcggugaaauccgagcauacagggaaggagaucgucgaccucaugugccacgccaccuuuacgaugcggcugcugagcccugugagaguucccaauuauaacaugauuaucauggaugaagcucauuucacagacccuucuuccauugccgcucggggcuacaucagcacccgcgugggaaugggcgaggccgccgcuauuuuuaugaccgcgacacccccugggucugucgaagccuucccgcagagcaaugcugugauccaggaugaggaaagagacauccccgagcgguccuggaacucuggauaugaguggauuaccgauuuuccuggcaaaacagugugguucguccccagcaucaaguccgggaaugacauugccaacugucuccgcaaaaauggaaagagaguuauccagcuuucucggaagaccuucgauacggaauaccagaagaccaagaacaacgacugggacuacguggugaccacagauauuagcgagaugggcgccaauuuuagagcugaccgcgucaucgauccucggagaugccugaaacccgugauucugaaggacgggccggaacgcguuauccucgccggcccuaugcccgugaccgucgcguccgcugcccagcggagaggacgcaucggccggaaccacaauaaagagggggaucaguauauuuacaugggacagccccugaacaaugacgaggaucaugcccacuggacggaagcuaagaugcuucuggacaacaucaauaccccugagggcauuauccccgcccucuucgaaccugagagagaaaagagcgcggccauugauggggaguaucgccugagaggagaggcucggaaaacauuuguggaacugaugcgcagaggcgaccucccgguuuggcuuucuuacaagguggccuccgagggguuccaauauagcgaucggcgcuggugcuuugacggcgaaagaaacaaucagguccuggaggaaaacauggauguggagaucuggaccaaagagggagaacggaagaaacugagaccccgcuggcucgacgcucggacauacuccgacccucuggcccuuagagaguucaaggaauuugcugccggccgccggucugucagcggggaucugauccucgagauuggaaaacugccccagcaccugacccagagagcgcaaaaugcccucgacaaccuugugaugcugcauaauuccgaacagggcgggcgggcuuaucgccacgccauggaggagcugccugauacaaucgaaacccucaugcugcuugcucugauugccguucucacgggaggcgugacacuguucuuucugucuggcagagggcucggaaagaccagcaucggccuucugugugugauggccuccagcguccugcucuggauggcuucuguugagccccauuggauugcggccuccaucauccuggaguucuuucuuauggugcugcucauuccggagccugaccggcagcgcacaccccaggauaaccaacuggcuuacguggucaucgggcuccuguucaugauucuuacaguggccgccaaugagaugggacugcuggaaaccacaaagaaagaccucggcaucgggcacguugcuguggagaaccaccaucacgccgcgaugcuggaugucgaccuucauccugccagcgcuuggacgcuguacgccguggcuaccacaauuaucacccccaugaugagacacacaauugaaaacaccacggccaauaucucucucaccgcgaucgccaaccaggcugccauucugaugggacuggauaagggcuggccuaucuccaaaauggacauuggcgucccccuccuugcucuggggugcuauagccaggugaauccgcugacacucaccgccgcuguucugaugcuuguggcccauuacgcgaucauuggaccuggccugcaagccaaggcuacacgggaggcccagaaacgcaccgcugccgggaucaugaagaaccccacggucgauggaaucguggccauugaccucgaucccguuguguaugacgcgaaguuugaaaaacagcugggccagaucaugcugcucauucuuuguacaucucaaauccugcugaugagaaccacaugggcucucugcgagagcauuacccuggccaccgggccucuuacaacgcugugggagggauccccgggcaaguucuggaauaccacaaucgcugucucuauggccaacaucuuccggggcagcuaccucgccggggcuggacuggccuuuucccugaugaaaagccucggcgggggacgcagaggcaccggggcgcagggagaaacacuuggcgagaaguggaaacggcagcugaaucagcuguccaagucugaguucaacaccuauaagagaagcggcauuauggagguggaccgcuccgaagccaaagaggggcucaagcggggagagacgacaaaacacgcugugucuagaggcaccgccaagcugcgcugguuuguugaacggaaucuugucaaacccgaggggaaggugaucgaucugggauguggcagagggggauggagcuacuauugcgcuggccucaagaaagugaccgaagucaagggcuacacaaaagggggaccuggccacgaggaacccauuccuauggccaccuacggguggaaccugguuaagcugcauuccggaaaagacguguucuuuauucccccugagaagugugauacacuccuuugcgacaucggcgagucuagcccgaaucccacgaucgaagaggggcgcacccugcgggugcugaaaauggucgaaccuuggcucagaggaaaccaauucuguauuaagauccugaaucccuauaugccuuccgugguugagacacuugagcagaugcagcgcaagcacggcggcaugcuggugcggaacccccucagcagaaauucuacccaugaaauguacugggucuccugcgggacaggaaacaucgugagcgcgguuaauaugaccucucgcaugcugcugaaccgguuuacgauggcccacagaaaaccgaccuaugagcgcgauguggaccucggcgcugggacaagacacgucgccguggaaccugagguggcuaaccuggauauuaucggacagcggauugaaaauaucaagcaugagcacaaauccaccuggcauuacgacgaggauaaccccuauaagacaugggccuaccacggcagcuaugaagucaaacccucuggguccgcuagcuccaugguuaauggaguggugaaacuucugaccaagccuugggacgucauucccauggugacacaaaucgccaugaccgauacgacaccuuucggccagcagcgcguuuuuaaagagaagguggacaccagaaccccgaaagcgaagcggggcacagcccaaaucauggaagucacggcuaaauggcucuggggguuccugagcagaaacaagaagccccggauuuguacccgcgaggaauuuacaagaaaagugcggucuaaugccgcuaucggagccguuuucguggacgagaaccaguggaauagcgccaaggaggcggucgaagaugagcgcuuuugggaccuugugcauagagaacgggagcugcacaaacagggcaagugcgcuaccugcguuuacaacaugauggggaaacgcgaaaagaagcucggagaguucggcaaagccaagggguccagagccauuugguacauguggcugggcgcucgguuccuggaguuugaagcccucggauucaugaaugaggaucacugguuuucucgcgaaaacagccuguccggcguggagggggagggacuucauaaacugggcuauauccucagagacauuucuaagaucccugggggaaauauguacgcugaugacacagccggcugggauacccggaucacagaagacgaucugcagaacgaggcgcgcauuaccgacaucauggaacccgagcacgcccuucuggcuaaaagcauuuucaagcucacguaucaaaauaaagucgugagaguccagcggccugccaagaacgggaccgugauggauguuaucucccgcagagaccagcggggcucuggacaggugggcacauacgggcugaauaccuuuacaaacauggaagcucaacugauuagacagauggagagcgagggaaucuucucccccagcgaacucgagaccccgaaccuggccgaacgcguccuugauuggcuggagaaguauggcguggaacggcucaaaagaauggcgaucucuggggacgacugugugguuaagccuauugaugaccgcuuugccacggcucugacagcccuuaaugauaugggaaaagugcggaaggacaucccccagugggagccuuccaaaggcuggaacgauuggcagcaaguccccuucugcagccaucacuuucaccagcugauuaugaaggacgggagagagaucgugguuccuugucgcaaucaggaugaacucgugggccgggcuagagucucucagggagccggcuggucccugcgcgagaccgcuugccugggaaagagcuacgcccaaauguggcagcucauguauuuccaucggagagaccugcgccuugcggccaacgcuauuuguuccgccgugcccgucgauuggaucccgacaucucggaccacguggagcauucacgcccaucaccaguggaugaccacagaagacaugcuguccguguggaauagaguuuggaucgaggaaaacccuuggauggaggauaaaacccauaucagcucuuggggagacgugcccuaccucggcaagcgggaggaccaauggugcgggucccugauuggacuuacagcuagagccaccugggcgacaaauauccaggucgcuauuaaccaggugcgccggcugaucggcaaugaaaacuaccucgauuauaugaccagcaugaaaagauuuaagaaugagucugaccccgaaggggcccugugguga

SEQ ID NO: 18947 - RNA, 9879 nt, Artificial Sequence
  derived and/or modified CDS sequence (opt5) from DENV-1__FJ410240__SS-prME
agcgugaccaugcugcucaugcugaugcccaccgcccuugcuuuccaccugacgaccagaggcggggaaccucauaugaucguguccaagcaggaacggggaaagucucuccuguuuaagacaagcgccggcguuaauaugugcacccuuauugcgauggaccugggggaguucugugaagauacaaugaccuacaagugcccgagaaucacagaggcugaacccgacgauguggacuguuggugcaaugccaccgauacgugggugaccuauggaacauguucccagaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgcucacacaggcgaccagcaucaaguggggaaugagagcaccgaacacggaacaaccgccacgaucacaccccaggccccuucuacagagauucagcugaccgacuacggcgcucucacacuggauuguagcccccggaccggccuggacuuuaacgaaaugguucuccugacgaugaaggagaaaagcuggcuugugcauaagcagugguuccuggaucucccucugcccuggacauccggggcgucuaccagccaagagacauggaaucgcaaagaccuucuggucaccuuuaagaccgcccacgcuaagaaacaggaaguggucgugcucggaucccaggagggcgccaugcacacagcccugacgggggcuaccgaaauccaaacaagcggaaccacaaccauuuucgccggccaucugaagugcagacucaaaauggauaagcugacgcuuaaagggaugucuuauguuauguguacaggcuccuucaagcuggagaaggaaguggcggagacccagcacggaaccguccucgugcagaucaaauacgagggcacagacgcuccgugcaagauuccuuuuagcacccaggaugaaaaagggguuacacaaaacggacggcugaucacggccaaucccaucgugaccgacaaggagaaaccugucaacauugaagccgagccgcccuucggcgagucuuauaucgugauuggggcuggagaaaaggcccugaaacuuagcugguuuaaaaagggcuccucuaucgggaaaauguucgaggcuacagccagaggcgcgcgccggauggccauucucggagauaccgcuugggacuuuggcagcaucgggggaguguucacauccguuggcaagcugguccaucagaucuuugggaccgccuacggagugcuguucagcggcgugucuuggacgaugaaaauugggaucggcguccuccugaccuggcuuggacucaauuccagaagcacaucucucuccaugaccuguauugcugugggccugguuacacuguaccuuggggugaugguccaggccgauagcggaugcgugaucaacuggaagggccgcgaacucaaguguggguccggaauuuuuguuaccaaugaggugcacacauggaccgaacaguauaaauuccaagcggacucuccuaagcggcugagcgccgcuaucggcaaagccugggaggagggggucugcggcauuagauccgcuacgcgccuggaaaacaucauguggaagcagaucucuaacgagcucaaucauauucugcuugaaaacgacaugaaauuuacagugguugugggagaugucgccggcauccuggcccaggggaagaaaaugauucggccgcagcccauggaguacaaguauagcuggaaguccuggggaaaagcuaagaucauuggcgcggacgugcaaaauaccaccuucaucaucgaugggccuaacacacccgaauguccugacgaucagagagccuggaauauuugggagguggaggacuacggauuuggcaucuucaccacgaacauuuggcucaaacugcgcgauagcuauacacaggucugcgaccaccggcugaugucugcugccaucaaggauuccaaagccguucacgcugacaugggcuacuggauugaaagcgagaagaaugaaaccuggaaacuugccagagcgucuuucaucgaggugaaaacauguaucuggcccaagucccauacccucuggagcaacggggugcuggaaucugagaugauuaucccgaaaauuuauggaggcccuaucagccagcacaauuaccgccccggguacuuuacacaaaccgcuggaccuuggcaucugggcaagcucgagcuggauuucgaccuuugcgaagggacgaccgucgugguugaugagcacugcggaaaccggggccccucccugagaacaaccacagugaccggcaaaauuauccacgaaugguguugccggagcuguacgcucccuccccugcgcuuuaagggggaggacggaugcugguauggcauggagaucagaccggucaaggaaaaagaggaaaaucuggugaagucuaugguuuccgccgggagcggagagguggacuccuucucucuuggccuccuguguauuagcaucaugauugaagaggucaugcgguccagauggucucgcaaaaugcugaugacagggacccucgccguguuuuuccugcuuaucaugggacagcugacauggaacgaucucauucggcugugcaucaugguuggcgcuaaugccagcgacagaaugggcauggggaccaccuaccuggcgcuuauggcuacauuuaagaugcgcccuauguucgccgugggacugcucuuuagacggcugacgucccgcgagguccuccugcuuaccauuggccugucucucguggccagcguggaacugcccaacucccuggaggaacuuggggauggacuggcuaugggcaucaugauccucaaacugcucacagacuuccagagccaucaacugugggccacccuucugucucucacauuuauuaagaccacguucucccugcacuaugcuuggaagacaauggccaugguccugagcaucguuucucuuuuuccccugugucucuccaccaccagccagaaaacaaccuggcugccugugcuccuggggucucuuggaugcaagccgcugacaauguuccugauugcggagaauaaaaucuggggcagaaaguccuggccccucaacgaaggcauuauggccguggggaucgucagcauccugcuuuccagccugcucaaaaacgaugugccucuggcuggaccccucauugccggcgggaugcugaucgcuuguuacguuauuucuggaagcuccgccgaccuuucucuggagaaggccgcugaggugagcugggaagaggaagcggagcauuccggcgccucucacaauauccuggucgaagugcaggaugacgggacgaugaaaauuaaggaugaggagcgggacgauacccucacaauccugcuuaaggcuacccugcucgccguuagcggaguguauccucuguccauccccgccacacucuucgucugguacuuuuggcagaaaaagaaacaacgcucuggcgugcugugggacaccccuuccccucccgaagucgagagagcugugcuugaugacggcauuuaucggaucaugcagcgcgggcugcugggaagaucccagguuggcgugggggucuuccaggaaaacguguuucauacgauguggcacguuacccggggagccgugcucauguaccaaggcaagcgccuggagcccagcugggcgucugucaaaaaggaccuuauuuccuacgggggaggcuggagacugcagggcagcuggaauacaggggaggaaguccaggugaucgcuguugagcccggaaagaacccuaaaaauguccagaccgcccccggcacauucaagaccucugaaggggaggugggagccauugcucucgauuuuaaaccgggcacauccgggagcccuaucgugaaccgggaaggaaagauugucggccuguauggcaauggggugguuacgaccuccggaacauacgugucugccaucgcgcaagcuaaagccagccaggagggcccccucccugagaucgaagacgaggucuucagaaagcgcaaccugaccauuauggaucuucaccccggguccggaaagacccggagauaucugcccgccaucgugcgcgaagcuauuaaacggaagcugagaacacucauccuggccccuacgcgcguuguggcuagcgagauggccgaagcgcuuaaaggcaugccgauucgguaccagaccacagccgucaagucugagcauaccgggaaagagaucguggaccugaugugccacgcuacauuuaccaugagacuccugucccccguucgcgugccuaauuauaacaugaucauuauggaugaagcccauuucacggaccccagcucuaucgcugcccggggcuacauuagcacaagagucggaaugggcgaggccgcugcgaucuuuaugaccgccaccccucccggguccguggaggcuuucccucaaucuaaugccgugauucaggaugaagaacgggacaucccggagcgcagcuggaacuccggauaugaguggaucacagauuuucccggcaagaccgucugguucguuccuucuauuaagagcgggaaugacaucgccaacugucugcgcaagaauggaaagcgggugauucagcucucccgcaaaacauucgauaccgaauaccagaagacgaaaaacaacgacugggacuacguggucacaaccgauaucagcgagaugggcgcuaauuuuagagccgaccgggugauugaucccagacgcugccuuaagccuguuauccugaaggacgggcccgaacgggugauucuggcgggcccgaugccugucacaguggcuucugccgcccaaagacgcggacggaucggcagaaaccacaauaaagagggggaucaguauaucuacaugggacagccccucaacaaugacgaggaucaugcucacuggaccgaagccaagaugcugcuugacaacauuaauacgcccgagggcaucauuccugcgcuguucgaacccgagcgcgaaaaauccgccgcuaucgauggggaguaucggcucagaggagaggcccgcaagaccuuuguugaacugaugagacggggcgaccugccuguguggcucagcuacaaagucgcuuccgagggguuccaguauucugaucgcagauggugcuuugacggcgaacggaacaaucaagugcuugaggaaaacauggaugucgagauuuggacaaaggagggagaacgcaaaaagcugagaccgcgguggcuggacgccagaaccuacagcgacccccucgcucugcgcgaguucaaggaauuugccgcgggccggagauccgugucuggggaucuuauccuggagaucggaaaacucccucagcaccugacacagcgcgcccagaaugcucuggacaaccucguuaugcuucauaauagcgaacaaggcgggcgggccuauagacacgcuauggaggagcugcccgauaccauugaaacacugaugcuccuggcccuuaucgccgugcugaccggaggcgugacgcuguucuuucuguccggccgggggcugggaaagacaagcauuggccuccuuugugucauggcuucuuccguucugcuguggauggcgagcguggagccucauuggaucgccgcuucuauuauccucgaguucuuucugauggugcuucugauccccgagccggaccgccagagaaccccucaggauaaccagcucgccuacgucgugauugggcugcuguucaugauccucaccguugccgcuaaugagaugggacuucuggaaacaaccaaaaaggaccugggcauugggcacguggccgucgagaaccaccaucacgcggccaugcucgauguggaccugcaucccgcuuccgccuggacacuuuacgcugucgccacgaccaucauuacaccuaugaugcggcacaccaucgaaaacacaaccgcgaauauuagccugacggccaucgcuaaccaagccgcuauccucaugggacuggauaaaggcuggcccauuucuaagauggacaucggcgugccucugcucgcccuugggugcuauagccagguuaauccccugacccugacagcugccgugcucaugcuggucgcgcauuacgccauuaucggaccgggccuucaggcuaaggccacccgcgaggcucagaagagaacagccgccgggauuaugaagaacccuaccguggauggaaucguugcgaucgaccuggaucccguggucuaugacgcuaaauuugaaaagcagcucggccagauuaugcugcugauccucuguacgucccagauucuucugaugcggacaaccugggcccugugcgagucuaucacacucgcuaccgggccccugaccacacuuugggagggaagcccuggcaaauucuggaauacgaccauugccguguccauggccaacaucuuccgcggcagcuaccuggcuggggccggacucgcguuuucccugaugaagucucugggcgggggaagacggggcacaggggcccaaggagaaacccucggcgagaaguggaaacgccagcuuaaucagcugagcaaguccgaguucaacacauauaaaagaucuggcaucauggagguggaccggagcgaagcuaaggaggggcugaaaagaggagagaccacgaagcacgccguuucccgcggcacagcuaagcuccggugguuugucgaaagaaaucuggugaaaccggaggggaaggugauugaucuuggauguggccgcgggggauggucuuacuauugcgccggccugaaaaaggucaccgaaguuaaaggcuacaccaaagggggacccggccacgaggaaccuauccccauggcgacauacggguggaaccucgugaaacugcauagcggaaaggacguguucuuuauuccucccgagaagugugauacccugcucugcgacaucggcgaguccagcccuaauccgacaauugaagaggggcggacgcuuagaguccugaaaaugguggaacccuggcugcgcggaaaccaguucuguaucaagauucucaauccuuauaugcccucuguuguggagacccuggagcaaaugcagcggaaacacggcggcaugcuugucagaaacccucugucccgcaauagcacacaugaaauguacugggugucuugcgggaccggaaacaucguuuccgccgugaauaugacaagccggaugcuccugaacagauuuaccauggcucaccgcaagcccacguaugagcgggaugucgaccugggcgccgggaccagacacguggcuguggaaccggaggucgccaaccucgauaucauuggacagcgcaucgaaaauauuaaacaugagcacaagucuacauggcauuacgacgaggauaacccuuauaagaccugggcuuaccacggcuccuaugaaguuaaacccagcggguccgccagcucuauggugaauggaguggucaagcugcuuacaaaacccugggacgugaucccuaugguuacccagauugcgaugacagauaccacgcccuucggccaacagagaguguuuaaggagaaagucgacacacggaccccuaaggccaagcgcggcaccgcucagaucauggaagugacagccaaauggcuguggggguuccucagcagaaacaagaaaccgcggaucuguacgagagaggaauuuacccggaagguucgcuccaaugcugccauuggagccguguucgucgacgagaaccaauggaacucugcgaaagaggcuguggaagaugagagauuuugggaccugguucaucgggaacgcgagcuucacaagcagggcaagugcgccacaugcguguacaacaugauggggaaaagagaaaagaaacugggagaguucggcaaggccaaagggagccgggcuaucugguacauguggcucggcgcccgcuuccuggaguuugaagcucugggauucaugaaugaggaucacugguuuuccagagaaaacucucucagcggcgucgagggggagggacugcauaaacuuggcuauauucugcgggacaucuccaaaauucccgggggaaauauguacgccgaugacaccgcgggcugggauacacgcaucaccgaagacgaucuccagaacgaggccaagaucacagacauuauggaaccugagcacgcucugcuugccaagucuaucuucaaacugaccuaucagaauaagguggucagagugcaacggcccgcuaaaaacgggacgguuauggaugugauuagccgcagagaccagcggggcuccggacaggucggcaccuacgggcucaauacauuuaccaacauggaagcccagcugauccgccaaauggagagcgagggaauuuucucuccuuccgaacuggagacacccaaccucgcgggcagagugcuggauuggcuugaaaagcaugggguggagcggcugaaaagaauggccaucagcggagacgacuguguugugaagccgaucgaugaccgcuuugcuaccgcccucacggcucugaaugauaugggcaagguccggaaagacauuccucagugggaacccucuaagggguggaacgauuggcaacaggugccuuucugcucccaccacuuucaucaacuuaucaugaaagacggcagagagauuguugugcccugucgcaaucaggaugagcuggucggacgggccagagugagccagggcgcuggguggucccuccgcgaaacagccugccugggaaagucuuaugcgcagauguggcaacugauguacuuccaccggagagaccuccgccuggccgcuaacgccaucuguagcgccgucccuguggauuggguucccaccucccggacaaccuggagcauucaugcucaccaucaguggaugacgaccgaggacaugcuuucuguguggaauagagucuggaucgaagagaacccguggauggaagauaaaacacacauuuccagcuggggcgacgugccuuaucuggggaagcgcgaggaccaguggugcggaucucucaucggccugaccgcccgggcgacaugggcuaccaauauccaaguugccauuaaccaggugagacggcuuaucgggaaugagaacuaccuggauuacaugacaagcaugaagagauuuaaaaaugaauccgaccccgagggcgcccucugguga

SEQ ID NO: 18948 - RNA, 9879 nt, Artificial Sequence
  derived and/or modified CDS sequence (opt5) from DENV-1__FJ410242__SS-prME
agcgugaccaugcugcucaugcugaugcccacggcccuugcuuuccaccugacgaccagaggcggggaaccucauaugaucgucuccaagcaggaacggggaaagucucuccuguuuaagaccagcgccggcguuaacaugugcacccuuaucgcgauggaccugggggaguucugugaagauacaaugaccuacaaaugcccgagaaucacagaagcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacagaacaguauaaauuccaagccgacucuccuaagcggcugagcgcggccauuggcaaggcuugggaggagggggugugcggcaucagauccaccacgcgccuggaaaacaucauguggaagcagauuucuaacgagcucaaucauauccugcuugaaaacgacaugaaauuuacaguuguggucggagauguggccggcauucuggcucaggggaagaaaaugauccggccgcagcccauggaguacaaguauagcuggaaguccuggggaaaagccaagauuaucggcgccgacgugcaaaauaccaccuucaucauugaugggccuaacacacccgaauguagcgacgaucagagagcuuggaauaucugggaggucgaggacuacggauuuggcauuuucaccacgaacaucuggcucaaacugcgcgauucuuauacacagguuugcgaccaccggcugauguccgcggccauuaaggauagcaaagcugugcacgccgacaugggcuacuggaucgaaucugagaagaaugaaaccuggaaacuugccagagcuuccuucaucgaggugaaaacauguauuuggccuaagagccauacccucuggucuaacgggguccuggaaagcgagaugaucauucccaaaaucuauggaggcccgauuucccagcacaauuaccgcccuggguacuuuacacaaaccgccggacccuggcaucugggcaagcucgagcuggauuucgaccuuugcgaagggacgaccgugguuguggaugagcacugcggaaaccggggcccuagccugagaacaaccacagucaccggcaaaaucauccacgaaugguguugccggucuuguacgcugcccccucugcgcuuuaagggggaggacggaugcugguauggcauggagauuagacccgugaaggaaaaagaggaaaaucugguuaaguccauggugagcgcgggguccggagaggucgacucuuucagccuuggccuccuguguaucuccauuaugaucgaagaggugaugcggucuagauggagccgcaaaaugcugaugacagggacccucgcugucuuuuuccugcuuauuaugggacagcugacauggaacgaucucauccggcugugcauuauggugggcgccaaugccuccgacagaaugggcauggggaccaccuaccuggcucuuauggccacauuuaagaugcgcccgauguucgcggucggacugcucuuuagacggcugacgucucgcgaggugcuccugcuuaccaucggccugagccucguggcuuccgucgaacugccuaacagccuggaggaacuuggggauggacuggccaugggcaucaugauucucaaacugcucacagacuuccagucucaucaacugugggccacccuucugucccucacauuuaucaagaccacguucagccugcacuaugcuuggaagacaauggccaugguucugucuauugugucccuuuuuccccugugucucagcaccaccucucagaaaacaaccuggcugcccgugcuccuggggucccuuggaugcaagccucugacaauguuccugaucgcugagaauaaaauuuggggcagaaagagcuggccgcucaacgaaggcaucauggccgucgggaucguguccauucugcuuagcucucugcucaaaaacgauguuccccuggcgggaccucucaucgccggcgggaugcugauugcuuguuacgugaucagcggauccucugccgaccuuagccuggagaaggcugccgaggucuccugggaagaggaagccgagcauucuggcgcuagccacaauauucugguggaaguucaggaugacgggacgaugaaaaucaaggaugaggagcgggacgauacccucacaauccugcuuaaggcgacccugcucgccguguccggagucuauccccugucuauuccugcuacacucuucgugugguacuuuuggcagaaaaagaaacaacgcagcggcguccugugggacacccccuccccucccgaaguggagagagccguucuugaugacggcaucuaucggauuaugcagcgcgggcugcugggaagaagccaggugggcgucgggguguuccaggaaaacguuuuucauacgauguggcacgugacccggggagccguccucauguaccaaggcaagcgccuggagccgucuugggcuuccgugaaaaaggaccuuaucagcuacgggggaggcuggagacugcagggcucuuggaauacaggggaggaagugcagguuauugccgucgagccuggaaagaaccccaaaaaugugcagaccgcgccuggcacauucaagaccuccgaaggggaggugggagcuaucgcccucgauuuuaaacccggcacaagcggguccccgauugucaaccgggaaggaaagaucgugggccuguauggcaaugggguugugacgaccucuggaacauacgucagcgccaucgcucaagccaaagcgucccaggagggcccucuccccgagauugaagacgagguguucagaaagcgcaaccugaccaucauggaucuucacccugggagcggaaagacccggagauaucugcccgcuauuguucgcgaagccaucaaacggaagcugagaacacucauucuggcccccacgcgcguggucgcuucugagauggccgaagcucuuaaaggcaugccuauccgguaccagaccacagccgugaaguccgagcauaccgggaaagagaucguugaccugaugugccacgcgacauuuaccaugagacuccugagcccggugcgcguccccaauuauaacaugauuaucauggaugaagcccauuucacggacccuucuagcauugcugcccggggcuacaucuccacaagagugggaaugggcgaggcugccgccauuuuuaugaccgcuacacccccugggucuguggaagcguucccccaaagcaaugccgucauccaggaugaggaacgggacaucccugagcgcuccuggaacucuggauaugaguggauuacagauuuuccgggcaagaccguuugguucgugcccagcaucaaguccgggaaugacauugcuaacugucugcgcaagaauggaaagcgggugauccagcucagccgcaaaacauucgauaccgaauaccagaagacgaaaaacaacgacugggacuacgucgugacaaccgauauuucugagaugggcgccaauuuuagagccgaccggguuaucgauccuagacgcugccuuaagcccgugauucugaaggacgggccugaacgggucauccuggcuggccccaugccggugacaguugccuccgcggcucaaagacgcggacggaucggcagaaaccacaauaaagagggggaucaguauauuuacaugggacagccucucaacaaugacgaggaucaugcccacuggaccgaagccaagaugcugcuugacaacaucaauacgcccgagggcauuauccccgcucuguucgaaccugagcgcgagaaguccgccgcgauugauggggaguaucggcucagaggagaggcccgcaagaccuuuguggaacugaugagacggggcgaccugcccgucuggcucuccuacaaaguggcuucugagggguuccaguauagcgaucgcagauggugcuuugacggcgaacggaacaaucaaguccuugaggaaaacauggauguggagaucuggacaaaggagggagaacgcaaaaagcugagaccucgguggcuggacgccagaaccuacuccgacccgcucgcucugcgcgaguucaaggaauuugccgcuggccggagaucuguuagcggggaucuuauccuggagauuggaaaacucccccagcaccugacacagcgcgcccagaaugcgcuggacaaccucgugaugcuucauaauuccgaacaaggcgggcgggccuauagacacgcuauggaggagcugccugauaccaucgaaacacugaugcuccuggcccuuauugcugugcugaccggaggcgucacacucuucuuucugagcggccgggggcugggaaagacaucuaucggccuccuuuguguuauggccuccagcgugcugcuguggauggccucuguggagccccauuggauugcugcguccaucauccucgaguucuuucugaugguccuucugauuccugagcccgaccgccagagaaccccgcaggauaaccagcucgccuacgugguuaucgggcugcuguucaugauucucaccguggcugccaaugagaugggacuucuggaaacaaccaaaaaggaccugggcaucgggcacgucgccgcugagaaccaccaucacgccgcgaugcucgauguggaccugcauccugccagcgcuuggacacuuuacgccgucgcuacgaccauuaucacacccaugaugcggcacaccauugaaaacacaaccgccaauaucucucugacggcgaucgccaaccaagcugccauucucaugggacuggauaaaggcuggccuaucagcaagauggacauuggcgugccccugcucgcucuugggugcuauucccagguuaauccucugacccugacagccgcugugcucaugcuggucgcccauuacgcgaucauuggacccggccuucaggccaaggcuacccgcgaggcccagaagagaacagcugccgggaucaugaagaacccgaccguggauggaaucguugccauugaccuggauccuguggucuaugacgcgaaauuugaaaagcagcucggccagaucaugcugcugauucucuguacgucucagauccuucugaugcggacaaccugggcucugugcgagagcauuacacucgccaccgggccccugaccacacuuugggagggaucccccggcaaauucuggaauacgaccaucgcugugagcauggccaacaucuuccgcggcuccuaccuggccggggcuggacucgccuuuucucugaugaaaagccugggcgggggaagacggggcacaggggcgcaaggagaaacccucggcgagaaguggaaacgccagcuuaaucagcuguccaagucugaguucaacacauauaaaagaagcggcauuauggagguggaccgguccgaagccaaggaggggcugaaaagaggagagaccacgaagcacgcuguuucucgcggcacagccaagcuccggugguuugucgaaagaaaucuggugaaaccugaggggaaggugaucgaucuuggauguggccgcgggggauggagcuacuauugcgcuggccugaaaaaggucaccgaaguuaaaggcuacaccaaagggggaccgggccacgaggaacccauuccuauggccacauacggguggaaccucgugaaacugcauuccggaaaggacguguucuuuauucccccugagaagugugauacccugcucugcgacauuggcgagagcucucccaauccuacaaucgaagaggggcggacgcuuagaguccugaaaaugguggaaccguggcugcgcggaaaccaguucuguauuaagauccucaaucccuauaugccuuccguuguggagacccuggagcaaaugcagcggaaacacggcggcaugcuugucagaaacccccugagccgcaauucuacacaugaaauguacuggguguccugcgggaccggaaacaucguuagcgcggugaauaugacaucucggaugcuccugaacagauuuaccauggcccaccgcaagccuacguaugagcgggaugucgaccugggcgcugggaccagacacguggccguggaacccgaggucgcuaaccucgauauuaucggacagcgcauugaaaauaucaaacaugagcacaaguccacauggcauuacgacgaggauaacccguauaagaccugggccuaccacggcagcuaugaaguuaaaccuuccgggagcgcuucuagcauggugaauggaguggucaagcugcuuacaaaacccugggacgugauucccaugguuacccagaucgccaugacagauaccacgccuuucggccaacagagaguguuuaaggagaaagucgacacacggacccccaaggcgaagcgcggcaccgcccagaucauggaagugacagcuaaauggcuguggggguuccucuccagaaacaagaaaccucggauuuguacgagagaggaauuuacccggaagguucgcucuaaugccgcuaucggagccguguucgucgacgagaaccaauggaauagcgccaaagaggcgguggaagaugagagauuuugggaccugguucaucgggaacgcgagcuucacaagcagggcaagugcgcuacaugcguguacaacaugauggggaaaagagaaaagaaacugggagaguucggcaaggccaaagggucccgggccauuugguacauguggcucggcgcucgcuuccuggaguuugaagcccugggauucaugaaugaggaucacugguuuucuagagaaaacagccucuccggcgucgagggggagggacugcauaaacuuggcuauauccugcgggacauuucuaaaauccccgggggaaauauguacgcugaugacaccgccggcugggauacacgcaucaccgaagacgaucuccagaacgaggcgaagauuacagacaucauggaacccgagcacgcccugcuugcuaagagcauuuucaaacugaccuaucagaauaagguggucagagugcaacggccugccaaaaacgggacgguuauggaugugaucucccgcagagaccagcggggcagcggacaggucggcaccuacgggcucaauacauuuaccaacauggaagcucagcugauucgccaaauggagucugagggaaucuucucccccagcgaacuggagacaccuaaccucgccggcagagugcuggauuggcuugaaaagcaugggguggagcggcugaaaagaauggcgaucucuggagacgacuguguugugaagcccauugaugaccgcuuugccaccgcucucacggcccugaaugauaugggcaagguccggaaagacaucccgcagugggaaccuuccaagggguggaacgauuggcaacaggugcccuucugcagccaccacuuucaucaacuuauuaugaaagacggcagagagaucguugugccuugucgcaaucaggaugagcuggucggacgggcuagagugucccagggcgccggguggucucuccgcgaaacagcuugccugggaaagagcuaugcccagauguggcaacugauguacuuccaccggagagaccuccgccuggcggccaacgcuauuuguuccgccguccccguggauuggguuccuaccagccggacaaccuggucuauccaugcccaccaucaguggaugacgaccgaggacaugcuuuccguguggaauagagucuggauugaagagaaccccuggauggaagauaaaacacacaucagcucuuggggcgacgugccguaucuggggaagcgcgaggaccaguggugcggaagccucaucggccugaccgcucgggccacaugggcgaccaauauucaaguugcuaucaaccaggugagacggcuuauugggaaugagaacuaccuggauuacaugacauccaugaagagauuuaaaaaugaaucugacccugagggcgcccucugguga

SEQ ID NO: 18949 - RNA, 9879 nt, Artificial Sequence
  derived and/or modified CDS sequence (opt5) from DENV-1__FJ410243__SS-prME
uccgugaccaugcugcugaugcugaugcccaccgcccuugcuuuccaccugacgacccggggcggggaaccucauaugaucgucuccaagcaggaacggggaaaaucucuccuguuuaagaccagcgccggcguuaauaugugcacccuuaucgcgauggaccugggggaguucugugaagauacaaugaccuacaaaugcccccgcaucacagaagcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaggcuuggcuuguccauaagcagugguuccuggaucucccucugcccuggacaagcggggcguccaccucucaagagacauggaaucgcaaagaccuucuggugaccuuuaagaccgcccacgcuaagaaacaggaagucgugguucucggaagccaggagggcgccaugcacacagcccugacgggggcuaccgaaauccaaacauccggaaccacaaccauuuucgccggccaucugaagugcagacucaaaauggauaagcugacgcuucgggggaugagcuaugugauguguacaggcucuuucaaacuggagaaggaagucgcggagacccagcacggaaccgugcucguucagaucaaguacgagggcacagacgcuccgugcaaaauuccuuuuuccacccaggaugaaaagggggugacacaaaacggaagacugaucacggccaaucccaucgucaccgacaaagagaagccugugaacauugaagccgagccgcccuucggcgagagcuauaucgugauuggggcuggagaaaaagcccugaaacuuucuugguuuaagaaaggcagcuccaucgggaagauguucgaggcuacagcccgcggcgcgcggagaauggccauucucggagauaccgcuugggacuuuggcucuaucgggggaguuuucacaagcgucggcaaacuggugcaucagaucuuugggaccgccuacggagugcuguucuccggcgucagcuggacgaugaagauugggaucggcgugcuccugaccuggcuuggacucaauucucgcuccacaagccucucuaugaccuguauugcuguuggccuggugacacuguaccuuggggucauggugcaggccgauuccggaugcguuaucaacuggaaaggccgggaacucaagugugggagcggaauuuuugugaccaaugagguccacacauggaccgaacaguauaaguuccaagcggacuccccuaaaagacugucugccgcuaucggcaaggccugggaggagggggugugcggcauucgcagcgcuacgcggcuggaaaacaucauguggaaacagaucuccaacgagcucaaucauauucugcuugaaaacgacaugaaguuuacaguuguggucggagauguggccggcauccuggcccaggggaaaaagaugauuagaccgcagcccauggaguacaaauauucuuggaaaagcuggggaaaggcuaagaucauuggcgcggacgugcaaaaugccaccuucaucaucgaugggccuaacacccccgaauguccugacgaucagcgcgcuuggaauauuugggaggucgaggacuacggauuuggcaucuucacaaccaacauuuggcucaagcugcgggauuccuauacgcagguuugcgaccacagacugaugagcgccgccaucaaagauucuaaggcugugcacgccgacaugggcuacuggauugaauccgagaaaaaugaaacauggaaacuugcgcgcgcuagcuucaucgaggugaagaccuguaucuggcccaaaucucauacacucugguccaacgggguccuggaaagcgagaugauuaucccgaagauuuauggaggcccuaucucucagcacaauuaccggcccggguacuuuacccaaacagccggaccuuggcaucugggcaaacucgagcuggauuucgaccuuugcgaagggaccacggugguuguggaugagcacugcggaaacagaggccccagccugcggaccacaaccgucacaggcaagauuauccacgaaugguguugccgcuccuguacccucccuccccugagauuuaaaggggaggacggaugcugguauggcauggagauccggccggugaaggaaaaggaggaaaaucugguuaaaagcauggugucugccggguccggagaggucgacagcuucucccuuggccuccuguguauuucuaucaugauugaagaggugaugagaagccgcuggucccggaagaugcugaugacggggacacucgcugucuuuuuccugcuuaucaugggacagcugaccuggaacgaucucauuagacugugcaucauggugggcgccaaugcgucugaccgcaugggcauggggacaaccuaccuggcucuuauggccaccuuuaaaaugagaccuauguucgccgucggacugcucuuucggcgccugacaagcagagaggugcuccugcuuacgauuggccugucccucguggcuucugucgaacugcccaacagccuggaggaacuuggggauggacuggccaugggcaucaugauccucaagcugcucaccgacuuccagucccaucaacugugggcuacacuucugagccucaccuuuauuaaaacaaccuucucucugcacuaugccuggaagacgauggcgaugguucuguccaucgugagccuuuuuccccugugucucucuacaaccucccagaagaccacauggcugccugugcuccuggggagccuuggaugcaaaccgcugaccauguuccugauugccgagaauaagaucuggggccggaaaucuuggccccucaacgaaggcauuauggcugucgggaucguguccauccugcuuagcucccugcucaagaacgauguuccucuggccggaccccucauugcuggcgggaugcugaucgccuguuacgugauuagcggaucuagcgccgaccuuucccuggagaaagcugcggaggucucuugggaagaggaagccgagcauagcggcgcuucccacaauauccugguggaaguucaggaugacgggccuaugaagauuaaagaugaggagcgcgacgauaugcucacaauccugcuuaaggccacgcugcucgccgugucuggagucuauccccugagcaucccugcuacccucuucgugugguacuuuuggcagaagaaaaagcaaagauccggcguccugugggacacacccucuccgccugaaguggagcgggccguucuugaugacggcauuuaucgcaucaugcagagagggcugcugggacggagccaggugggcgucgggguguuccaggaaaacguuuuucauaccauguggcacgugacacgcggagcgguccucauguaccaaggcaaaagacuggagcccuccugggcuagcgugaagaaagaccuuauuucuuacgggggaggcuggcggcugcagggcuccuggaauaccggggaggaagugcagguuaucgccgucgagccuggaaagaaccccaagaaugugcagacggccccgggcaccuucaaaacaagcgaaggggaggugggagcuauugcccucgauuuuaagccuggcaccucugggucccccaucgucaacagagaaggaaaaauugugggccuguauggcaaugggguugugacaaccagcggaacauacgucuccgcgaucgcucaagccaaggccucucaggagggcccucuccccgagaucgaagacgagguguuccgcaaacggaaccugacgauuauggaucuucaccccgggagcggaaagaccagacgcuaucugccugcuaucguucgggaagccauuaagagaaaacugcgcacacucauccuggcuccgacccggguggucgccuccgagauggcggaagcccuuaagggcaugcccauuagauaccagaccacagcugugaaaagcgagcauacggggaaggagaucguugaccugaugugccacgccaccuuuacaaugcgccuccugucuccugugcggguccccaauuauaacaugaucauuauggaugaagcucauuucaccgacccuuccagcaucgccgccagaggcuacauuucuacacgggugggaaugggcgaggcugcggccaucuuuaugaccgcuacgcccccugggagcauggaagccuucccgcaauccaaugccgugauucaggaugaggaacgcgacauccccgagagaucuuggaacagcggauaugaguggaucacagauuuuccuggcaaaaccgucugguucguucccuccauuaagucugggaaugacaucgcuaacugucugcggaagaauggaaaacgcgugauucagcucagcagaaagaccuucgauacagaauaccagaaaaccaagaacaacgacugggacuacguggucacaaccgauaucuccgagaugggcgccaauuuucgggcggacagagugauugauccucgccggugccuuaaacccguuauccugaaggacgggccggaaagagugauucuggcuggcccuaugcccgucacgguggccagcgccgcucaacgccggggaagaaucggccgcaaccacaauaaggagggggaucaguauaucuacaugggacagccccucaacaaugacgaggaucaugcccacuggacagaagcgaaaaugcugcuugacaacauuaauaccccugagggcaucauucccgcccuguucgaaccugagcgggaaaagucugcugccaucgauggggaguauagacuccgcggagaggcuagaaaaacauuuguugaacugaugcggcgcggcgaccugccgguguggcucuccuacaaggucgccagcgagggguuccaguauuccgauagacgguggugcuuugacggcgaacgcaacaaucaagugcuugaggaaaacauggaugucgagauuuggaccaaagagggagaaagaaagaaacugcggcccagauggcuggacgcucgcacguacucugacccucucgcccugcgggaguucaaggaauuugcggccggcagacgcagcguguccggggaucuuauccuggagaucggaaagcucccccagcaccugacccagcgggcucagaaugcccuggacaaccucguuauucuucauaauucugaacaaggcgggagagcuuaucggcacgccauggaggagcugccugauacaaucgaaacccugaugcuccuggcccuuauugcugugcugacaggaggcgugacccucuucuuucugagcggccgcgggcugggaaaaacauccaucggccuccuuugugucauggcgagcucuguucugcuguggauggccuccguggagccccauuggauugcugccagcaucauccucgaguucuuucugauggugcuucugauuccggagccugacagacagcggacaccccaggauaaccagcucgccuacgucgugaucgggcugcuguucaugauucucacgguugcugccaaugagaugggacuucuggaaacaaccaagaaagaccugggcaucgggcacguggcggucgagaaccaccaucacgccgcuaugcucgauguggaccugcauccugccucugcuuggacccuuuacgccgucgcgacaaccauuaucacacccaugaugcgccacacgauugaaaacaccacagccaauaucucccugaccgcuaucgccaaccaagcugccauucucaugggacuggauaagggcuggccuaucagcaaaauggacauuggcgugccccugcucgcucuugggugcuauucucagguuaauccgcugacacugaccgccgcggugcucaugcuggucgcccauuacgcuaucauuggaccuggccuucaggccaaggcuacgagagaggcccaaaagcggaccgccgcggggaucaugaaaaaccccacaguggauggaaucguugcuauugaccuggaucccguggucuaugacaccaaguuugaaaaacagcucggccagaucaugcugcugauucucuguacaagccagauccuucugaugcgcaccacgugggcccugugcgaguccauuacacucgcuaccgggccucugacaacccuuugggagggaucuccgggcaaguucuggaauaccacaaucgccgugagcauggccaacaucuucagaggcuccuaccuggcuggggccggacucgcguuuagccugaugaaaucccugggcgggggacggcgcggcacgggggcccaaggagaaacccucggcgagaaguggaagagacagcuuaaucagcugucuaaaagcgaguucaacacauauaagcgguccggcauuauggagguggacagaucugaagcuaaagaggggcugaagcgcggagagaccacaaaacacgccguuagccggggcaccgcuaagcucagaugguuugucgaacgcaaucuggugaagcccgaggggaaagugaucgaucuuggauguggcagagggggaugguccuacuauugcgccggccugaagaaagucacggaaguuaagggcuacacaaaagggggaccuggccacgaggaacccauuccuauggcgaccuacggguggaaccucgugaagcugcauucuggaaaagacguguucuuuauucccccugagaagugugauacccugcucugcgacauuggcgagagcuccccgaaucccacaaucgaagaggggagaacccuucgcguccugaagaugguggaaccuuggcugcggggaaaccaguucuguauuaaaauccucaaucccuauaugccuagcguuguggagacacuggagcaaaugcagagaaagcacggcggcaugcuuguccgcaacccccugucuagaaauuccacgcaugaaauguacugggugagcugcgggaccggaaacaucguuucugccgugaauaugacauccagaaugcuccugaaccgcuuuaccauggcucaccggaaaccgacauaugagagagaugucgaccugggcgccgggacccgccacguggcuguggaaccugaggucgccaaccucgauauuaucggacagagaauugaaaauaucaagcaugagcacaaaagcacguggcauuacgacgaggauaaccccuauaagaccugggcuuaccacggcucuuaugaaguuaagcccuccgggagcgccuccagcauggugaauggaguggucaaacugcuuacaaagccuugggacgugauucccaugguuacccagaucgcgaugacagauaccacaccuuucggccaacagcggguguuuaaagagaaggucgacacccgcacgccgaaagccaagagaggcacagcucagaucauggaagugaccgccaaguggcuguggggguuccucucucggaacaaaaagcccagaauuuguacccgggaggaauuuacacgcaaaguuagaagcaaugcugccaucggagccguguucgucgacgagaaccaauggaacuccgcgaaggaggcuguggaagaugagcgguuuugggaccugguucaucgcgaaagagagcuucacaaacagggcaagugcgccacgugcguguacaacaugauggggaagcgggagaagaagcugggagaguucggcaaagccaaggggucucgcgcuauuugguacauguggcucggcgccagauuccuggaguuugaagcucugggauucaugaaugaggaucacugguuuagccgggaaaacucccucucuggcgucgagggggagggacugcauaaacuuggcuauauccugcgcgacauuagcaagaucccugggggaaauauguacgccgaugacaccgcgggcugggauacaagaaucaccgaagacgaucuccagaacgaggccaaaauuacagacaucauggaacccgagcacgcucugcuugccaaguccauuuucaagcugaccuaucagaauaaagugguccgggugcaacgcccugcuaagaacgggacaguuauggaugugaucucuagacgggaccagcgcggcagcggacaggucggcaccuacgggcucaauacguuuaccaacauggaagcccagcugauuagacaaauggaguccgagggaaucuucagccccucugaacuggagacaccgaaccucgcgggccgggugcuggauuggcuugaaaaacaugggguggagagacugaagcgcauggccaucuccggagacgacuguguugugaaaccuauugaugaccgguuugcuaccgcccucacagcucugaaugauaugggcaaggucagaaaggacaucccccagugggaaccuagcaaaggguggaacgauuggcaacaggugcccuucugcucucaccacuuucaucaacuuauuaugaaggacggccgcgagaucguugugccuugucggaaucaggaugagcuggucggacgggcccgcgugucccagggcgcuggguggagccuccgggaaaccgccugccugggaaaauccuaugcgcagauguggcaacugauguacuuccacagacgcgaccuccggcuggccgcuaacgccauuuguucugccguccccguggauuggguuccgacgagcagaacaaccugguccauccaugcucaccaucaguggaugacaaccgaggacaugcuuagcguguggaaucgcgucuggauugaagagaacccuuggauggaagauaagacgcacaucucuuccuggggcgacgugcccuaucuggggaaacgggaggaccaguggugcggaagccucaucggccugaccgccagagcgacaugggcuaccaauauucaaguugccaucaaccaggugcggagacuuauugggaaugagaacuaccuggauuacaugacaucuaugaagcgcuuuaagaaugaaaucgaccccgagggcgcccucugguga

SEQ ID NO: 18950 - RNA, 9879 nt, Artificial Sequence
  derived and/or modified CDS sequence (opt5) from DENV-1__FJ410244__SS-prME
agcgugaccaugcugcucaugcugaugcccaccgcccuugcuuuccaccugacgaccagaggcggggaaccucauaugaucgucuccaagcaggaacggggaaaaucucuccuguuuaagacgagcgccggcguuaauaugugcacccuuauugcgauggaccugggggaguucugugaagauacaaugaccuacaaaugcccgcgcaucacagaagcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaaugaacaagcugacgcuuaaagggaugucuuaugugauguguacaggcuccuucaagcuggagaaggaagucgccgagacccagcacggaaccgugcucguucagaucaaauacgagggcacagaugcgccgugcaagauuccuuuuagcacccaggacgaaaaaggggugacacaaaauggacggcugaucacggcuaaccccaucgucaccgauaaggagaaaccugugaauauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagacaccgccugggauuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacugaacuccagaagcacaucucucuccaugaccuguauugccguuggccuggugacacuguaccuuggggucauggugcaggcugacagcggaugcguuaucaauuggaagggccgcgaacucaaguguggguccggaauuuuugugaccaacgagguccacacauggaccgaacaguauaaauuccaagccgauucuccuaagcggcugagcgcggccaucggcaaggcuugggaggagggggugugcggcauuagauccgccacgcgccuggaaaacaucauguggaagcagaucucuaaugagcucaaccauauucugcuugaaaaugacaugaaauuuacaguuguggucggagacguggcuggcauccuggcccaggggaagaaaaugauucggccgcagcccauggaguacaaguauagcuggaaguccuggggaaaagccaagaucauuggcgcugaugugcaaaacaccaccuucaucaucgacgggccuaauacacccgaauguccugaugaccagagagcguggaacauuugggaggucgaggauuacggauuuggcaucuucaccacgaauauuuggcucaaccugcgcgacagcuauacacagguuugcgaucaccggcugaugucugccgcuaucaaagacuccaaggccgugcacgccgauaugggcuacuggauugaaagcgagaaaaaugaaaccuggaaacuugcuagagccucuuucaucgaggugaagacauguaucuggcccaaaucccauacccucuggagcaacgggguccuggaaucugagaugauuaucccgaagauuuauggaggcccuaucagccagcacaauuaccgccccggguacuuuacacaaaccgcgggaccuuggcaucugggcaaacucgagcuggacuucgaucuuugcgaagggacgaccgugguuguggacgagcacugcggaaaccggggccccucccugagaacaaccacagucaccggcaagauuauccacgaaugguguugccggagcuguacgcucccuccccugcgcuuuaaaggggaggauggaugcugguauggcauggagaucagaccggugaaggaaaaggaggaaaaucugguuaaaucuaugguguccgcugggagcggagaggucgacuccuucucucuuggccuccuguguauuagcaucaugauugaagaggugaugcgguccagauggucucgcaagaugcugaugacagggacccucgccgucuuuuuccugcuuaucaugggacagcugacauggaacgaccucauucggcugugcaucauggugggcgccaaugcuagcgauagaaugggcauggggaccaccuaccuggcccuuauggcgacauuuaaaaugcgcccuauguucgcugucggacugcucuuuagacggcugacgucccgcgaggugcuccugcuuaccauuggccugucucucguggccagcgucgaacugcccaacucccuggaggaacuuggggacggacuggccaugggcaucaugauccucaagcugcucacagauuuccagagccaucaacugugggcuacccuucugucucucacauuuauuaaaaccacguucucccugcacuaugccuggaagacaauggcuaugguucugagcaucgugucucuuuuuccccugugucucuccaccaccagccagaagacaaccuggcugccugugcuccuggggucucuuggaugcaaaccgcugacaauguuccugauugccgagaacaagaucuggggcagaaaauccuggccccucaaugaaggcauuauggcggucgggaucgugagcauccugcuuuccagccugcucaagaacgacguuccucuggccggaccccucauugcuggcgggaugcugaucgccuguuacgugauuucuggaagcuccgcugaucuuucucuggagaaagccgccgaggucagcugggaagaggaagcugagcauuccggcgcgucucacaauauccugguggaaguucaggacgaugggacgaugaagauuaaagacgaggagcgggaugacacccucacaauccugcuuaaggccacccugcucgcugugagcggagucuauccucuguccauccccgccacacucuucgugugguacuuuuggcagaagaaaaagcaacgcucuggcguccugugggauaccccuuccccucccgaaguggagagagccguucuugacgauggcauuuaucggaucaugcagcgcgggcugcugggaagaucccaggugggcgucgggguguuccaggaaaacguuuuucauacgauguggcacgugacccggggagcuguccucauguaccaaggcaaacgccuggagcccagcugggccucugugaagaaagaccuuauuuccuacgggggaggcuggagacugcagggcagcuggaauacaggggaggaagugcagguuaucgcggucgagcccggaaagaacccuaagaaugugcagaccgcucccggcacauucaaaaccucugaaggggaggugggagccauugcccucgacuuuaagccgggcacauccgggagcccuaucgucaaccgggaaggaaaaauugugggccuguauggcaaugggguugugacgaccuccggaacauacgucucugcuaucgcccaagcgaaggcuagccaggagggcccccucccugagaucgaagaugagguguucagaaaacgcaaccugaccauuauggaccuucaccccggguccggaaagacccggagauaucugcccgccaucguucgcgaagccauuaagcggaaacugagaacacucauccuggcuccuacgcgcguggucgccagcgagauggcugaagcccuuaagggcaugccgauucgguaccagaccacagcggugaaaucugagcauaccgggaaggagaucguugaucugaugugccacgccacauuuaccaugagacuccugucccccgugcgcgucccuaauuauaacaugaucauuauggacgaagcucauuucacggaucccagcucuaucgccgcucggggcuacauuagcacaagagugggaaugggcgaggccgccgcuaucuuuaugaccgcgaccccucccggguccguggaagccuucccucaaucuaaugcuauuauccaggacgaggaacgggauaucccggagcgcagcuggaacuccggauaugaguggauuacagacuuucccggcaaaaccgucugguucguuccuucuaucaagagcgggaaugauauugccaacugucugagaaagaacggaaaacgggugauccagcucucccgcaagacauucgacaccgaauaccagaaaacgaagaauaacgauugggacuacguggucacaaccgacauuagcgagaugggcgccaauuuuagagcugaucgggugaucgaccccagacgcugccuuaaaccuguuauucugaaggaugggcccgaacgggugauccuggccggcccgaugccugucacaguggcgucugcugcccaaagacgcggacggaucggcagaaaccacaauaaggagggggaccaguauauuuacaugggacagccccucaacaaugaugaggaccaugcccacuggaccgaagcuaaaaugcugcuugauaacaucaauacgcccgagggcauuaucccugcccuguucgaacccgagcgcgaaaaguccgcggccauugacggggaguaucggcucagaggagaggcucgcaaaaccuuuguugaacugaugagacggggcgaucugccuguguggcucagcuacaaggucgccuccgagggguuccaguauucugaccgcagauggugcuuugauggcgaacggaacaaucaagugcuugaggaaaacauggacgucgagaucuggacaaaagagggagaacgcaagaaacugagaccgcgguggcuggaugcuagaaccuacagcgacccccucgcccugcgcgaguucaaggaauuugcugccggccggagauccgugucuggggaccuuauccuggagauuggaaagcucccucagcaccugacacagcgcgcgcagaaugcccuggauaaccucguuaugcuucauaauagcgaacaaggcgggcgggcuuauagacacgccauggaggagcugcccgacaccaucgaaacacugaugcuccuggcucuuauugccgugcugaccggaggcgugacacucuucuuucuguccggccgggggcugggaaaaacaagcaucggccuccuuugugucauggccucuuccguucugcuguggauggcuagcguggagccucauuggauugcggccucuaucauccucgaguucuuucugauggugcuucugauucccgagccggaucgccagagaaccccucaggacaaccagcucgcuuacgucgugaucgggcugcuguucaugauucucaccguugccgccaacgagaugggacuucuggaaacaaccaagaaagaucugggcaucgggcacguggcugucgagaaucaccaucacgccgcgaugcucgacguggaucugcaucccgccuccgcuuggacacuuuacgccgucgcuacgaccauuaucacaccuaugaugcggcacaccauugaaaacacaaccgccaauaucagccugacggcgaucgccaaccaagcugccauucucaugggacuggacaagggcuggcccaucucuaaaauggauauuggcgugccucugcucgcucuugggugcuauagccagguuaauccccugacccugacagccgcugugcucaugcuggucgcccauuacgcgaucauuggaccgggccuucaggccaaggcuacccgcgaggcccaaaagagaacagcugccgggaucaugaaaaacccuaccguggacggaaucguugccauugaucuggaccccguggucuaugaugcgaaguuugaaaaacagcucggccagaucaugcugcugauucucuguacgucccagauccuucugaugcggacaaccugggcucugugcgagucuauuacacucgccaccgggccccugaccacacuuugggagggaagcccuggcaaguucuggaauacgaccaucgcuguguccauggccaacaucuuccgcggcagcuaccuggccggggcuggacucgccuuuucccugaugaaaucucugggcgggggaagacggggcacaggggcgcaaggagaaacccucggcgagaaguggaagcgccagcuuaaucagcugagcaaauccgaguucaacacauauaagagaucuggcauuauggagguggaccggagcgaagccaaagaggggcugaagagaggagagaccacgaaacacgcuguuucccgcggcacagccaagcuccggugguuugucgaaagaaaucuggugaagccggaggggaaagugaucgaccuuggauguggccgcgggggauggucuuacuauugcgcuggccugaagaaagucaccgaaguuaagggcuacaccaaagggggacccggccacgaggaaccuauucccauggccacauacggguggaaccucgugaagcugcauagcggaaaagauguguucuuuaucccucccgagaagugugacacccugcucugcgauauuggcgaguccagcccuaauccgacaaucgaagaggggcggacgcuuagaguccugaagaugguggaacccuggcugcgcggaaaccaguucuguauuaaaauccucaauccuuauaugcccucuguuguggagacccuggagcaaaugcagcggaagcacggcggcaugcuugucagaaacccucugucccgcaauagcacacaugaaauguacugggugucuugcgggaccggaaacaucguuuccgcggugaacaugacaagccggaugcuccugaauagauuuaccauggcccaccgcaaacccacguaugagcgggacgucgaucugggcgcugggaccagacacguggccguggaaccggaggucccuaaccucgacauuaucggacagcgcauugaaaauaucaagcaugagcacaaaucuacauggcauuacgaugaggacaaccccuauaagaccugggcuuaccacggcuccuaugaaguuaagcccagcggguccgccagcucuauggugaauggaguggucaaacugcuuacaaagccuugggaugugauucccaugguuacccagaucgcuaugacagacaccacgccuuucggccaacagagaguguuuaaagagaaggucgauacacggaccccgaaagccaagcgcggcaccgcgcagaucauggaagugacagccaaguggcuguggggguuccucagcagaaacaaaaagccccggauuuguacgagagaggaauuuacccggaaaguucgcuccaaugcugccaucggagcuguguucgucgacgagaaccaauggaacucugccaaggaggccguggaagacgagagauuuugggaucugguucaucgggaacgcgagcuucacaaacagggcaagugcgcgacaugcguguacaacaugauggggaagagagagaagaagcugggagaguucggcaaagcuaaggggagccgggccauuugguacauguggcucggcgcccgcuuccuggaguuugaagcucugggauucaugaaugaggaccacugguuuuccagagaaaacucucucagcggcgucgagggggagggacugcauaaacuuggcuauauccugcgggauauuuccaagaucccugggggaaauauguacgccgacgauaccgcuggcugggacacacgcaucaccgaagaugaccuccagaacgaggccaaaauuacagauaucauggaacccgagcacgcgcugcuugccaagucuauuuucaagcugaccuaucagaauaaaguggucagagugcaacggccugcuaagaacgggacgguuauggacgugaucagccgcagagaucagcggggcuccggacaggucggcaccuacgggcucaacacauuuaccaauauggaagcccagcugauucgccaaauggagagcgagggaaucuucucucccuccgaacuggagacaccgaaccucgcuggcagagugcuggacuggcuugaaaaacaugggguggagcggcugaagagaauggccaucagcggagaugacuguguugugaaaccuauugacgaucgcuuugcgaccgcccucacggcucugaaugacaugggcaagguccggaaggaugugccccagugggaaccuucuaaaggguggaacgacuggcagcagguucccuucugcucccaccacuuucaucaacuuaucaugaaggauggcagagagauuguggucccuugucgcaaucaggacgagcuggugggacgggccagagucagccagggcgcuggguggucccuccgcgaaacagccugccugggaaaaucuuaugcucagauguggcaacugauguacuuccaccggagagaucuccgccuggccgcgaacgccaucuguagcgcugugcccguugacugggugccgaccucccggacaaccuggagcauucaugcccaccaucaguggaugacgaccgaggauaugcuuucugucuggaauagaguguggaucgaagagaacccuuggauggaagacaagacacacauuuccagcuggggcgauguucccuaucuggggaaacgcgaggaccaguggugcggaucucucaucggccugaccgcccgggcuacaugggccaccaauauccaaguggcgauuaaccaggucagacggcuuaucgggaaugagaacuaccuggacuacaugacaagcaugaagagauuuaagaaugaauccgaucccgagggcgcucucugguga

SEQ ID NO: 18951 - RNA, 9879 nt, Artificial Sequence
  derived and/or modified CDS sequence (opt5) from DENV-1__FJ410245__SS-prME
agcgugaccaugcugcucaugcugaugcccacagcccuugcuuuccaccugacgacccggggcggggaaccucauaugaucgucuccaagcaggaacggggaaaaucucuccuguuuaagaccagcgccggcguuaacaugugcacccuuauugcgauggaccugggggaacucugugaagauacaaugaccuacaaaugccccagaaucacagagaccgaacccgacgauguggacuguuggugcaaugcuacggauaccugggugacauauggaaccuguucccaaacaggcgagcaccggcgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccaggccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucaaaggggaggacggaugcugguauggcauggagauuagaccggugaaggaaaaggaggaaaaucuuguuaaaagcauggugucugcuggguccggagaggucgacagcuuuucccucggccugcuguguaucucuauuaugaucgaagaggugaugcggagcagauggucccgccggaugcucaugacagggacccuggccguuuucuuucuucugauuaugggacagcucacauggaacgaucugaucagacugugcauuauggugggcgccaaugcuucugaccgcaugggcauggggaccaccuaccuugcccugauggcgacauucaagaugagaccuauguuugcugucggacuccuguuccggcgccucacgagcagagaggugcugcuucugaccaucggccucucccugguggccucugucgaacugcccaacagccuugaggaacugggggauggacucgccaugggcaucaugauucugaaacuccugacagacuuucaaucccaucagcuuugggcuacccugcucagccugacauucaucaagaccacguuuucucugcacuaugccuggaaaacaauggcuaugguucuuuccauugugagccuguucccccucugucugucuaccaccucccagaagacaaccuggcucccugugcugcuugggagccugggaugcaagccgcugacaauguuucucaucgccgagaauaaaauuuggggccggcgcucuuggccccugaacgaaggcaucauggcggucgggaucguguccauucuucugagcucccuccugaagaacgauguuccucucgccggaccccugaucgcuggcgggaugcuuauugccuguuacgugaucagcggaucuagcgcugaccugucccuggagaaagccgccgaggucucuugggaagaggaagcugagcauagcggcgcgucccacaauauucucguggaaguucaggaugacgggacgaugaagaucaaagaugaggagagagacgauacccugacaauccuucugaaggccacccuccuggcugugucuggagucuauccucucagcauucccgccacacuguucgugugguacuucuggcagaagaagaagcagcgguccggcguccuuugggacaccccuucucccccggaaguggagcgcgccguucuggaugacggcaucuauagaauuaugcagcgggggcugcucggacgcagccaggugggcgucgggguguuucaagaaaacguuuuccauacgauguggcacgugaccagaggagcuguccugauguaccagggcaaacggcuugagccuuccugggccagcgugaagaaagaccugaucucuuacgggggaggcuggagacuccagggcuccuggaauauuggggaggaagugcagguuaucgcggucgagcccggaaagaacccuaaaaaugugcaaacagcucccggcaccuuuaagacaccggaaggggaggugggagccauugcccuggauuucaagccuggcaccagcgggucucccaucgucaaccgcgaaggaaaaaucgugggccucuauggcaaugggguugugacaacguccggaaccuacgucagcgcuauugcccaggcgaaggcuucccaggagggcccucugcccgagaucgaagacgagguguuucggaaaagaaaccuuacaauuauggaucugcaccccgggucuggaaagacccgccgguaucugccugccaucguuagagaagccauuaaaaagaagcuccgcacccugauccuugcuccgacacggguggucgccagcgagauggcugaagcccugaaaggcaugcccaucagauaccaaacgaccgcggugaaguccgagcauacagggaaagagauuguugaccucaugugccacgccaccuucacaaugcgccugcugagcccugugcggguccccaauuauaacaugaucauuauggaugaagcucauuuuaccgacccuucuuccaucgccgcuagaggcuacauuagcacgcgggugggaaugggcgaggccgccgcuaucuucaugacagcgacacccccugggucuguggaagccuuuccgcagagcaaugcugucauccaggaugaggaacgcgacauucccgagagauccuggaacucuggauaugaguggaucaccgauuucccuggcaagacaguuugguuugugcccagcauuaaauccgggaaugacaucgccaacugucuccggaagaauggaaagcgcgugauucagcuuucuagaaaaaccuucgauacagaauaccaaaagaccaaaaacaacgacugggacuacgucgugacgacagauaucagcgagaugggcgccaauuuccgggcugacagaguuauugauccucgccggugccugaagcccgugauccugaaagacgggccggaaagagucauccucgccggcccuaugcccgugaccguugcguccgcugcccagcgccggggaagaauuggccgcaaccacaauaaggagggggaucaguauaucuacaugggacagccccugaacaaugacgaggaucaugcccacuggacagaagcuaagaugcuucuggacaacauuaauaccccugagggcaucauucccgcccucuuugaaccugagcgggaaaagagcgcggccaucgauggggaguauagacugcgcggagaggcuagaaagacguucguggagcugaugcggcgcggcgaccucccggucuggcuuucuuacaaaguggccuccgagggguuucaauauagcgauagacgguggugcuucgacggcgaacgcaacaaucagguccuggaggaaaacauggauguggagaucuggaccaaggagggagaacgcaagaagcugcggcccagauggcucgacgcucgcacauacuccgacccucuggcccuucgggaguuuaaagaguucgcugccggcagacgcucuguuagcggggaucugauucucgagaucggaaagcugccccagcaccugacccagcgggcgcaaaaugcccucgacaaccuugugaugcugcauaauuccgaacagggcgggagagcuuaucggcacgccauggaggagcugccugauacaauugaaacccucaugcugcuugcucugaucgccgugcucacaggaggcgucacccuguuuuuccugucuggccgcgggcucggaaagacgagcauuggccuucuguguguuauggccuccagcgugcugcucuggauggcuucuguggagccccauuggaucgcggccuccaucauucuggaauuuuuccuuaugguccugcucaucccggagccugacagacagcggacaccccaggauaaccaacuggcuuacgugguuauugggcugcucuuuaugauccuuaccguggccgccaaugagaugggacugcuggaaaccaccaaaaaggaccucggcauugggcacgucgcuguggagaaccaccaucacgccgcgaugcuggaugucgaccuucauccugccagcgcuuggacccuguacgccguggcuacaacgaucauuacccccaugaugcgccacacaaucgaaaacaccacagccaauaucucucucaccgcgauugccaaccaggcugccauccugaugggacuggauaaaggcuggccuauuuccaagauggacaucggcguuccccuccuugcucuggggugcuauagccaggugaauccgcugacgcucaccgccgcuguccugaugcuuguggcccauuacgcgauuaucggaccuggccugcaagccaaagcuacaagagaggcccagaagcggaccgcugccgggaucaugaagaaccccacaguugauggaauuguggccaucgaccucgaucccgucguguaugacgcgaaauucgaaaagcagcugggccagauuaugcugcucauccuuuguaccucucaaauucugcugaugcgcacgacaugggcucucugcgagagcaucacccuggccacagggccucuuaccacccugugggagggauccccgggcaaauuuuggaauacaacgaucgcugugucuauggccaacauuuucagaggcagcuaccucgccggggcuggacuggccuucucccugaugaaaagccucggcgggggacggcgcggcaccggggcgcagggagaaacacuuggcgagaaauggaagagacagcugaaucagcuguccaagucugaauuuaacaccuauaaacggagcggcaucauggagguugacagauccgaagccaaggaggggcucaaacgcggagagacaaccaagcacgcugucucucggggcacggccaaacugagaugguucguggaacgcaaucuugugaagcccgaggggaaggucauugaucugggauguggcagagggggauggagcuacuauugcgcuggccucaaaaagguuacagaagugaaaggcuacaccaaagggggaccuggccacgaggaacccaucccuauggccaccuacggguggaaccuggugaaacugcauuccggaaaggacgucuuuuucauucccccugagaaaugugauacacuccuuugcgacaucggcgagucuagcccgaaucccaccauugaagaggggagaacacugcgcgugcugaagaugguugaaccuuggcuccggggaaaccaauuuuguaucaagauccugaaucccuauaugccuuccguggucgagacgcuugagcagaugcagagaaaacacggcggcaugcuggugcgcaacccccucagcagaaauucuacccaugaaauguacuggguuuccugcgggacaggaaacauugugagcgcggucaauaugaccucuagaaugcugcugaaccgcuucacaauggcccaccggaagccgaccuaugagagagauguggaccucggcgcugggacgcgccacguggccgucgaaccugagguugcuaaccuggauaucauuggacagagaaucgaaaauauuaaacaugagcacaaguccaccuggcauuacgacgaggauaaccccuauaaaacaugggccuaccacggcagcuaugaagugaagcccucuggguccgcuagcuccauggugaauggagucgugaaacuucugaccaaaccuugggacguuauccccauggugacacaaaucgccaugaccgauacaaccccuuuuggccagcagcgggucuucaaggagaaaguggacacgcgcacaccgaaggcgaaaagaggcaccgcccaaauuauggaaguuaccgcuaaguggcucuggggguuucugagccggaacaagaaacccagaaucuguacacgggaggaguucacgcgcaaggugagaucuaaugccgcuauuggagccgucuuuguggacgagaaccaguggaauagcgccaaagaggcgguugaagaugagcgguucugggaccuugugcaucgcgaaagagagcugcacaagcagggcaaaugcgcuaccugcgucuacaacaugauggggaagcgggaaaagaaacucggagaguuuggcaaggccaaagggucccgcgccaucugguacauguggcugggcgcuagauuccuggaguucgaagcccucggauuuaugaaugaggaucacugguucucucgggaaaacagccuguccggcguggagggggagggacuucauaagcugggcuauauucuccgcgacaucucuaaaaucccugggggaaauauguacgcugaugacacagccggcugggauaccagaauuacagaagacgaucugcagaacgaggcgcggaucaccgacauuauggaacccgagcacgcccuucuggcuaagagcaucuuuaaacucacauaucaaaauaaggucgugcgcguucagagaccugccaagaacgggaccgugauggaugucauuucccggcgcgaccagagaggcucuggacaggugggcacguacgggcugaauaccuucacaaacauggaagcucaacugauccggcagauggagagcgagggaaucuuuucccccagcgaacucgagaccccgaaccuggccgaaagagugcuugauuggcuggagaaauauggcguugaacgccucaagcggauggcgauuucuggggacgacuguguggucaaaccuaucgaugacagauucgccacagcucugaccgcccuuaaugauaugggaaaggugcgcaaagacauuccccagugggagccuuccaagggcuggaacgauuggcagcaaguucccuuuugcagccaucacuuccaccagcugaucaugaaggacgggcgggagauuguggucccuuguagaaaucaggaugaacucgugggccgcgcucgggucucucagggagccggcuggucccugagagagacggcuugccuggggaaaagcuacgcccaaauguggcagcucauguauuuucaucgccgggaccugagacuugcggccaacgcuaucuguuccgccgugcccguugauuggauuccgacaucucgcaccacauggagcauccacgcccaucaccaguggaugaccacggaagacaugcuguccguguggaaucgggucuggaucgaggaaaacccuuggauggaggauaagacccauauuagcucuuggggagacgugcccuaccucggcaaaagagaggaccaauggugcgggucccugaucggacuuacagcucgggccaccugggcgacaaauauucagguugcuaucaaccaggugagacgccugauuggcaaugaaaacuaccucgauuauaugaccagcaugaagcgguucaaaaaugagucugaccccgaaggggcccugugguga

SEQ ID NO: 18952 - RNA, 9879 nt, Artificial Sequence
  derived and/or modified CDS sequence (opt5) from DENV-1__FJ410246__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaauaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagauaagccugugaacaucgaggccgaaccgcccuucggcgagucuuauauugugaucggggccggagagaaagcucugaaacuuagcugguuuaagaaaggcuccucuauugggaagauguucgaagccaccgcuagaggcgcccgccggauggcgauccucggagacacagccugggauuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugacagcggaugcguuauuaacuggaaaggccgcgagcucaaguguggguccggaaucuuugugacaaaugaaguccacaccuggacagagcaauauaaguuccaggccgacucuccuaaacggcugagcgcggccauuggcaaggcuugggaagagggggugugcggcaucagauccgccacccgccuggagaacaucauguggaaacagauuucuaacgaacucaaucauauccugcuugagaacgauaugaaguuuacgguuguggucggagacguggcuggcauucuggcccaggggaaaaagaugauccggccgcaacccauggaauacaaauauagcuggaaguccuggggaaaggccaaaauuaucggcgcugaugugcagaauacaaccuucaucauugacgggccuaacacccccgaguguccugaugaccagagagcguggaauaucugggaagucgaggauuacggauuuggcauuuucacaaccaacaucuggcucaagcugcgcgacagcuauacgcagguuugcgaucaccggcugaugucugccgcuauuaaagacuccaaggccgugcacgccgauaugggcuacuggaucgagagcgagaagaaugagacauggaaacuugcuagagccucuuucaucgaagugaagaccuguauuuggcccaaaucccauacacucuggagcaacgggguccuggagucugaaaugaucauuccgaagaucuauggaggcccuauuagccaacacaauuaccgccccggguacuuuacccagacagcgggaccuuggcaucugggcaaacucgagcuggacuucgaucuuugcgaggggaccacggugguuguggacgaacacugcggaaaccggggccccucccugagaaccacaaccgucacaggcaagaucauccacgagugguguugccggagcuguacccucccuccccugcgcuuuaaaggggaagacggaugcugguauggcauggagauuagaccggugaaggagaaggaagagaaucugguuaaaucuaugguguccgcugggagcggagaagucgauuccuucucucuuggccuccuguguaucagcauuaugacggaggaagugaugcgguccagauggucucgcaagaugcugaugacagggacccucgccgucuuuuuccugcuuaucaugggacagcugacauggaacgaccucauucggcugugcaucauggugggcgccaaugcuagcgauagaaugggcauggggaccaccuaccuggcccuuauggcgacauuuaaaaugcgcccuauguucgcugucggacugcucuuuagacggcugacgucccgcgaggugcuccugcuuaccauuggccugucucucguggccagcgucgagcugcccaacucccuggaagaacuuggggacggacuggccaugggcaucaugauccucaagcugcucacagauuuccaaagccaucagcugugggcuacccuucugucucucacauuuauuaaaaccacguucucccugcacuaugccuggaagacaauggcuaugguucugagcaucgugucucuuuuuccccugugucucuccaccaccagccagaagacaaccuggcugccugugcuccuggggucucuuggaugcaaaccgcugacaauguuccugauugccgaaaauaagaucuggggcagaaaauccuggccccucaacgagggcauuauggcggucgggaucgugagcauccugcuuuccagccugcucaagaacgacguuccucuggccggaccccucauugcuggcgggaugcugaucgccuguuacgugauuucuggaagcuccgcugaucuuucucuggaaaaagccgccgaggucagcugggaggaagaggcugaacauuccggcgcgucucacaauauccugguggagguucaggacgaugggacgaugaagauuaaagacgaagaacgggaugacacccucacaauccugcuuaaggccacccugcucgcugugagcggagucuauccucuguccauccccgccacacucuucgugugguacuuuuggcaaaagaaaaagcagcgcucuggcguccugugggauaccccuuccccucccgagguggaaagagccguucuugacgacggcauuuaucggaucaugcagcgcgggcugcugggaagaucccaggugggcgucgggguguuccaagagaacguuuuucauacgauguggcacgugacccggggagcuguccucauguaccagggcaaacgccuggaacccagcugggccucugugaagaaagaucuuauuuccuacgggggaggcuggagacugcagggcagcuggaauacaggggaggaggugcagguuaucgcggucgaacccggaaagaacccuaagaaugugcaaaccgcucccggcacauucaaaaccucugagggggaagugggagccauugcccucgacuuuaagccgggcacauccgggagcccuaucgucaaccgggagggaaaaauugugggccuguauggcaaugggguugugacgaccuccggaacauacgucucugcuaucgcccaggcgaaggcuagccaggaaggcccccucccugagaucgaggaugaaguguucagaaaacgcaaccugaccauuauggaccuucaccccggguccggaaagacccggagauaucugcccgccaucguucaugaggccauuaagcgcaaacugcggacacucauccuggcuccuacgagaguggucgccagcgaaauggcugaggcccuuaagggcaugccgauucgcuaccaaaccacagcggugaaaucugaacacaccgggaaggagaucguugaucugaugugccaugccacauuuaccaugcggcuccugucccccgugagagucccuaauuauaacaugaucauuauggacgaggcucacuucacggaucccagcucuaucgccgcucgcggcuacauuagcacacgggugggaaugggcgaagccgccgcuaucuuuaugaccgcgaccccucccggguccguggaggccuucccucagucuaaugcugucauucaggacgaagagagagauaucccggaacggagcuggaacuccggauaugaguggaucacagacuuucccggcaaaaccguuugguucgugccuucuauuaagagcgggaaugauaucgccaacugucugcgcaagaauggaaaaagagugauucagcucucccggaagacauucgacaccgaguaccagaagacgaagaacaacgacugggauuacgucgugacaaccgacaucagcgaaaugggcgccaauuuucgcgcugauagaguuauugacccccggagaugccuuaaaccugugauccugaaggaugggcccgagcgcgucauucuggccggcccgaugccugugacaguugcgucugcugcccagcggagaggacgcaucggccggaaccauaauaaggaaggggaccaguauguguacaugggacagccccucaacaaugaugaggaccacgcccacuggaccgaggcuaaaaugcugcuugauaacaucaauacgcccgaaggcauuaucccugcccuguucgagcccgaaagagagaaguccgcggccauugacggggaauaucgccuccggggagaggcuagaaaaaccuuugucgagcugaugcgcagaggcgaucugccuguguggcucagcuacaaggucgccuccgaaggguuccaauauucugaccggcgcuggugcuuugauggcgagagaaacaaucaggugcuugaagagaacauggacguugaaaucuggacaaaagagggagagcggaagaaacugcgcccgagauggcuggacgcucggaccuacagcgauccccucgcccugagagaguucaaggaguuugcugccggccgccgguccgugucuggggaccuuauucuggaaaucggaaagcucccucagcaucugacacagagagcgcaaaaugcccuggauaaccucgugaugcuucacaauagcgagcagggcgggcgcgcuuaucggcaugccauggaggaacugcccgacaccaucgagacacugaugcuccuggcucuuauugccguccugaccggaggcguuacgcuguucuuucuguccggcagagggcugggaaaaacaagcaucggccuccuuugugugauggccucuuccgugcugcuguggauggcuagcgucgaaccucacuggauugcggccucuaucauucucgaguucuuucugauggugcuucugauccccgaaccggaucggcagcgcaccccucaggacaaccaacucgcuuacguugugaucgggcugcuguucaugauucucaccgucgccgccaaugagaugggacuucuggagacaaccaagaaagaucugggcaucgggcacguggcugucgaaaaccaucaccaugccgcgaugcucgacguggaucugcaccccgccuccgcuuggacacuuuacgccguugcuacgaccauuaucacaccuaugaugagacauaccauugagaacacaaccgccaauaucagccugacggcgauugccaaccaggcugccauccucaugggacuggacaagggcuggcccaucucuaaaauggauauuggcgugccucugcucgcucuugggugcuauagccaggucaauccccugacccugacagccgcugugcucaugcugguugcccacuacgcgaucauuggaccgggccuucaagccaaggcuacccgggaagcccagaagcgcacagcugccgggaucaugaaaaacccuaccguggacggaauugucgccaucgaucuggaccccgugguguaugacgcgaaguuugagaaacagcucggccagaucaugcugcugauucucuguacgucccaaauccuucugaugagaacaaccugggcucugugcgaaucuauuacacucgccaccgggccccugaccacacuuugggagggaagcccuggcaaguucuggaauacgaccaucgcuguuuccauggccaacauuuuccggggcagcuaccuggccggggcuggacucgccuuuucccugaugaaaucucugggcgggggacgcagaggcacaggggcgcagggagagacccucggcgaaaaguggaagcggcagcuuaaucagcugagcaaauccgaguucaacacauauaagcgcucuggcaucauggaagucgauagaagcgaggccaaagaagggcugaagcggggagagaccacgaaacacgcuguguccagaggcacagccaagcuccgcugguuuguggagcggaaucuggucaagccggaagggaaaguuaucgaccuuggauguggcagagggggauggucuuacuauugcgcuggccugaagaaagugaccgaggugaagggcuacaccaaagggggacccggccaugaggaaccuauucccauggccacauacggguggaaccucgucaagcugcacagcggaaaagauguguucuuuaucccucccgaaaagugugacacccugcucugcgauauuggcgaguccagcccuaauccgacaaucgaggaagggcgcacgcuucggguucugaagaugguggagcccuggcugagaggaaaccaauucuguauuaaaauccucaauccuuauaugcccucugucguggaaacccuggagcagaugcagcgcaagcauggcggcaugcuuguucggaacccucuguccagaaauagcacacacgagauguacugggugucuugcgggaccggaaacauugucuccgcggugaauaugacaagccgcaugcuccugaaccgguuuaccauggcccacagaaaacccacguaugaacgcgacguggaucugggcgcugggacccggcaugucgccguugagccggaaguggcuaaccucgacaucaucggacagagaauugagaauaucaagcacgaacauaaaucuacauggcacuacgaugaggacaacccuuauaagaccugggccuaccauggcuccuaugaggugaagcccagcggguccgcuagcucuauggucaauggagugguuaaacugcuuacaaagcccugggaugugauuccuauggucacccaaaucgccaugacagacaccacgcccuucggccagcagcgcguguuuaaagaaaagguugacacaagaaccccuaaagcgaagcggggcaccgcccaaauuauggaggugacagcuaaguggcuguggggguuccucagccgcaacaaaaagccgagaaucuguacgcgggaagaguuuaccagaaaaguccgguccaaugccgcuaucggagccguguucguugaugaaaaccaguggaacucugccaaggaggcgguggaggacgaacgcuuuugggaucugguccacagagagcgggaacuucacaaacagggcaagugcgcuacaugcguguacaacaugauggggaagcgcgagaaaaagcugggagaguucggcaaagccaaggggagcagagccauuugguacauguggcucggcgcucgguuccuggaguuugaggcccugggauucaugaaugaagaccauugguuuucccgcgagaacucucucagcggcgucgaaggggagggacugcacaaacuuggcuauauccugagagauauuuccaagauccccgggggaaauauguacgcugacgauaccgccggcugggacacacggauuaccgaggaugaccuccagaacgaagcgaaaaucacagauaucauggagccugaacaugcccugcuugcuaagucuauuuucaagcugaccuaucaaaauaaagugguucgcgugcagagacccgccaagaacgggacggucauggacgugaucagccggcgcgaucagagaggcuccggacaggugggcaccuacgggcucaauacauuuaccaacauggaggcucaacugauucggcagauggaaagcgagggaaucuucucuccuuccgagcuggaaacacccaaccucgccggccgcguucuggacuggcuugagagacacgggguggaacggcugaaaagaauggcgauuagcggagacgauugugucgugaagccgaucgacgaucgcuuugccaccgcucucacggcccugaaugacaugggcaaaguucggaaggauaucccucagugggagcccucuaagggguggaacgacuggcagcaagugccuuucugcucccaccauuuucaccagcuuauuaugaaagauggcagagaaaucgucgugcccugucgcaaucaggacgagcuggucggacgggcuagagugagccagggcgccggguggucccuccgcgagacagcuugccugggaaagucuuaugcccaaauguggcagcugauguacuuccaucggagagaucuccgccuggcggccaacgcuauuuguagcgccguuccuguggacuggguccccaccucccggacaaccuggagcauccacgcccaucaccaguggaugacgaccgaagauaugcuuucuguguggaauagaguuuggauugaggaaaacccguggauggaggacaaaacacacaucuccagcuggggcgacgugccuuaucuggggaagcgcgaagaucaauggugcggaucucucauuggccugaccgcucgggccacaugggcgaccaauauccaggucgcuaucaaccaggugagacggcuuauugggaaugagaacuaccuggacuacaugacaagcaugaaaagauuuaagaaugaguccgaucccgaaggcgcccucugguga

SEQ ID NO: 18953 - RNA, 9879 nt, Artificial Sequence
  derived and/or modified CDS sequence (opt5) from DENV-1__FJ410247__SS-prME
agcgugaccaugcugcucaugcugaugcccaccgcgcuugcuuuccaccugacgaccagaggaggggaaccucauaugaucguguccaagcaggaacggggaaaaucucuccuguuuaagacaagcgccggcguuaacaugugcacccuuauugcgauggaccugggggagcucugugaagauaccaugaccuacaaaugccccagaaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuauucugcgcaaacuuugcaucgaagccaagauuuccaauacgacaaccgauagcagauguccgacccaaggagaggcgacacugguugaagaacaggacgccaacuucgugugccggcgcaccuuuguggauagaggcuggggcaauggguguggacucuucggcaaagggucucugaucacaugcgcuaaguuuaagugcgucacgaaacuugagggaaagaucgugcaguacgaaaaccugaaauauuccguuauugugaccguccacacaggcgaccagcaucaaguggggaaugagagcaccgaacacggaacaaccgccacgaucacaccccaggcuccuacaaccgagauucagcucacagacuacggcgcccugacccuggauuguucuccccggacgggccucgacuucaacgaaaugguucugcuuacaaugaaggagaaauccuggcuggugcauaagcagugguuucucgaucugccucuucccuggaccagcggggccuccacaucucaagagaccuggaaucgccaggaccugcucgucaccuucaaaacagcucacgcgaagaagcaggaaguggucgugcugggaagccaagagggcgccaugcacacggcucugaccggggccacagaaauccagaccuccggaacaaccacgauuuuugccggccaucucaaaugcagacugaagauggauaaacuuacacugaaggggaugagcuauguuauguguaccggcucuuucaaacucgagaaggaaguggcugagacccagcacggaacaguccuggugcagaucaaguacgagggcaccgacgccccgugcaaaaucccuuucuccacacaagaugaaaaggggguuacgcagaacggacggcugauuaccgcgaaucccaucgugacagacaaagagaagccugucaacauugaagcugagccgcccuuuggcgagagcuauaucgugauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauuccuauacccaggucugcgaccaccggcuuaugagcgcggccaucaaagauucuaaggcuguucacgccgacaugggcuacuggaucgaauccgagaaaaaugaaacauggaagcucgccagagcuagcuucauugaggugaagaccuguaucuggcccaaaucucauacacugugguccaacggggugcuggaaagcgagaugauuaucccgaagauuuauggaggcccuaucucucaacacaauuaccgccccggguacuucacccagacggccggaccuuggcaucucggcaaacuggagcuugauuuugaccugugcgaagggaccacagucgugguugaugagcacugcggaaaccggggccccagccucagaaccacaaccgugacgggcaagaucauucacgaaugguguugccgguccuguacacugccuccccugcgcuucagaggggaggacggaugcugguauggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugaccgggacacuggcuguguuccuucugcucaucaugggacagcugaccuggaacgaucugauuagacuuugcaucaugguuggcgccaaugccucugaccgcaugggcauggggaccacauaccuggcucucauggccacguuuaagaugagaccuauguucgcggugggacugcucuuucggcgccugaccagcagagagguccuucugcucacaaucggccugucccugguggcuucuguggaacuucccaacagccuggaggaacucggggauggacuggccaugggcauuaugauccucaaacugcuuaccgacuuccaaucccaucagcugugggccacacuccugagccugaccuuuauuaagacgacauucucucuucacuaugcuuggaaaaccauggccaugguccuguccaucguuagccucuuuccccugugucucucuaccacaucccagaagaccacauggcugccugugcuucuggggagccugggaugcaagccgcucacgauguuccugauugcugagaaucggaucuggggccgcagaucuuggccccuuaacgaaggcaucauggccguggggauugucuccauccugcucagcucccugcucaaaaacgaugugccucuggcgggaccccuuauugccggcgggaugcugaucgcuuguuacguuauuagcggaucuagcgccgaccugucccucgagaaggcugccgaggugucuugggaagaggaagccgagcauagcggcgcuucccacaauauccuggucgaagugcaggaugacgggaccaugaaaaucaaggaugaggagcgggacgauacacuuaccauucugcucaaagcgacacugcucgccguuucuggaguguauccucugagcauccccgcuacccuuuuugucugguacuucuggcaaaagaaaaagcagcgcuccggcgugcugugggacacgccuucucccccggaagucgagagagccgugcuggaugacggcauuuaucggaucaugcagcgcgggcuccugggaagaagccagguuggcgugggggucuuccaagaaaacguguuucauaccauguggcacguuacacggggagccgugcuuauguaccagggcaagagacuggagccuuccugggcuagcgucaaaaaggaccucauuucuuacgggggaggcuggcgccugcagggcuccuggaauaccggggaggaaguccaggugaucgccguugagcccggcaagaacccuaagaauguccaaacaacccccggcacauucaaaacgccggaaggggaggugggagcgauugcucucgauuuuaagccuggcaccagcgggucucccaucgugaaccgggaaggaaagaucgucggccuguauggcaauggggugguuacaaccuccggaaccuacgugagcgccauugcccaggcuaaagccucccaggagggcccucuucccgagaucgaagacgaggucuucagaaagcgcaaccugacaauuauggaucugcaccccgggucuggaaaaacgcggagauaucucccugcgaucgugcgcgaagcuauuaagcggaaacugagaacccuuauccuggccccgacacgcguuguggccagcgagauggcugaagcccucaagggcaugcccauccgguaccaaaccacagcugucaaguccgagcauaccgggaaagagauuguggaccugaugugccacgccacguuuacaaugagacugcucagcccuguucgggugcccaauuauaacaugaucauuauggaugaagcgcauuucaccgacccuucuuccaucgccgcucgcggcuacauuagcaccagagucggaaugggcgaggccgcugccaucuuuaugacagccacacccccugggucuguggaggcuuucccgcagagcaaugcggugauccaggaugaggaacgggacauucccgagcgcuccuggaacucuggauaugaguggaucacagauuuuccuggcaagaccgucugguucguucccagcauuaaauccgggaaugacaucgccaacugucuuagaaagaauggaaaacgggugauucagcugucuagaaagacguuugauacagaauaccaaaagaccaaaaacaacgacugggacuacguggucacaaccgauaucagcgagaugggcgcuaauuuccgcgccgaccgggugauugauccuagacgcugccugaagcccguuauccucaaagacgggccggaacgggugauccuggccggcccuaugcccgucacgguggcuuccgccgcgcagagacgcggacggauuggcagaaaccacaauaaggagggggaucaguauaucuacaugggacagccccuuaacaaugacgaggaucaugcucacuggaccgaagccaaaaugcugcucgacaacauuaauacaccugagggcaucauucccgcccuguucgaaccugagcgcgaaaagagcgcugccaucgauggggaguauagacugcggggagaggcgcgcaagaccuuuguugaacucaugagacggggcgaccuuccgguguggcugucuuacaaagucgccuccgagggguuccaauauagcgaucgcagauggugcuuugacggcgaacggaacaaucaggugcuggaggaaaacauggaugucgagaucuggacaaaggagggagaacgcaaaaagcuccgcccccgguggcuggacgcuagaaccuacuccgacccucuugcccugcgcgaguucaaagaauuugcugccggccggagaucugugagcggggaucucauucuggagaucggaaagcugccccagcaccucacacagcgggcucaaaaugcccuugacaaccugguuaugcugcauaauuccgaacagggcgggcgcgcguauagacacgccauggaggagcucccugauaccauugaaacgcugaugcuucuggcucucaucgccgugcugacaggaggcgugacccuguucuuucucucuggccgggggcuuggaaaaaccagcauuggccugcugugugucauggcuuccagcguucuccuguggauggccucuguggagccccauuggaucgccgcuuccaucauucuugaguucuuucugauggugcuccugaucccggagccugaccgccagagaacaccccaggauaaccaacuggcguacgucgugauugggcuccuuuucaugauccugaccguugccgcuaaugagaugggacugcucgaaacaacgaagaaggaccugggcauugggcacguggccgucggaaaccaccaucacgccgcuaugcuugauguggaccugcauccugccagcgcguggacccucuacgccgucgcuacaaccaucauuacacccaugaugcggcacaccaucgagaacacgaccgccaauaucucucugacagcuauugccaaccaggcggccauccugaugggccucgauaaaggcuggccuauuuccaagauggacaucggggugccccuucuggcucugggaugcuauagccagguuaauccgcucacccugacagccgcugugcuuaugcuggucgcccauuacgcuauuaucggcccugggcuccaagccaaagcgacccgcgaagcccagaagagaacggcugccggaaucaugaaaaaccccacaguggauggcauuguugcuaucgaccuggaucccguggucuaugacgccaaguuugagaagcagcuggggcagauuaugcuccuuauccuguguaccucucaaauucugcucaugcggacaaccugggcccugugcgaaagcaucacccuugcgacaggaccucugacgacccucugggagggcuccccgggcaaauucuggaauacaaccaucgcugugucuauggccaacauuuuucgcgggagcuaccuggcuggagccggccuggccuucucccucaugaaaagccuugggggaggcagacgggggacaggagcucagggcgagacccugggcgaaaaauggaagagacagcugaaucagcucuccaaaucugaguucaacacguauaagcgcagcgggaucauggaaguggaccgguccgaggccaaggaaggacugaaaagaggcgagacaaccaagcacgcgguuucucgcgggaccgccaaacuucggugguuugucgagagaaaucuggugaagcccgaaggaaaagugauugaucucggcugugggcgcggaggcuggagcuacuauugcgcuggccugaagaaggucacagagguuaaaggguacaccaagggaggcccugggcacgaagaacccaucccuauggccacauacggauggaaccuggugaaacuccauuccggcaaggacguguucuuuauucccccugaaaaaugugauacgcuucugugcgacaucggggagucuagcccgaaucccaccauugaggaaggacggacacugagaguccucaagaugguggagccuuggcugcgcggcaaccaauucuguaucaaaauccuuaaucccuauaugccuuccguuguggaaacccuggagcagaugcagcggaagcacggcgggaugcucgucagaaacccccugagccgcaauucuacacaugagauguacuggguguccugcggaaccggcaacauuguuagcgcugugaauaugacgucucggaugcugcucaacagauuuaccauggcccaccgcaagccgacauaugaaagagaugucgaccugggggcgggaacccggcacguggccguggagccugaagucgcuaaccuugauaucauuggccagcgcaucgagaauauuaaacaugaacacaaguccacauggcauuacgacgaggauaaccccuauaaaaccugggccuaccacgggagcuaugagguuaagcccucuggauccgcuagcuccauggugaauggcguggucaaacugcucacaaagccuugggacgugauccccaugguuacccaaaucgccaugacggauacaaccccuuucggccagcagagaguguuuaaggaaaaagucgacacccggacaccgaaggcuaaacaagggacggcccagauuauggaggugaccgcgaaguggcuguggggauuccuuagcagaaacaaaaagccccggaucuguacacgcgaagaguuuaccagaaagguucggucuaaugccgcuauuggcgccguguucgucgacgaaaaccaguggaauagcgcuaaagaggccguggaggaugaacgcuuuugggaccugguucauagagagcgggaacuccacaagcaggggaaaugcgccacaugcguguacaacaugaugggaaagcgcgagaaaaagcugggcgaguucgggaaggcgaaaggcuccagagcuaucugguacauguggcugggagcccgguuucucgaguucgaggcccugggcuucaugaaugaagaucacugguuuucucgcgagaacagccuuuccggggucgaaggagagggccugcauaagcucggguauauucugagagacaucucuaaaaucccuggaggcaauauguacgcugaugacaccgccgggugggauacacggauuaccgaggacgaucuucaaaacgaagcucgcaucacggacauuauggagcccgaacacgcccugcucgccaagagcaucuucaaacugaccuaucagaauaagguggucagagugcagcggccugccaaaaacggcacaguuauggaugugauuucccgcagagaccagcggggaucuggccaagucgggaccuacggacugaauacauuuaccaacauggaggcucagcucaucagacagauggaaagcgagggcaucuucucccccagcgagcuggaaacgccgaaccuugccgagcgcgugcuggauuggcucgaaaaguaugggguggagcggcugaagagaauggcuauuucuggagacgacuguguugugaaaccuaucgaugaccgcuuugccacagcgcuuaccgcccugaaugauaugggcaagguccggaaagacauuccccagugggaaccuuccaagggguggaacgauuggcaacaggugcccuucugcagccaucacuuucaccagcucaucaugaaagacggcagagagauuguugugccuugucgcaaucaggaugagcuggucggacgggcuagagugucucaaggcgccggguggucccugcgcgaaacagcuugccucggaaagagcuacgcccagauguggcagcugauguauuuccaucggagagaccuucgccuggcugccaacgcgaucuguuccgccguccccguggauuggauuccgaccucucggacgaccuggagcauccacgcucaucaccaauggaugacaaccgaggacaugcucuccguuuggaauagaguguggaucgaagagaacccuuggauggaagauaagacacauauuagcucuuggggcgacguccccuaccuggggaaacgggaggaccaguggugcggaucccuuaucggccugaccgccagagccacaugggcuaccaauauucagguggccaucaaccagguucgccggcucauugggaaugagaacuaccuggauuauaugacgagcaugaagagauuuaaaaaugaaucugaccccgagggcgcgcugugguga

SEQ ID NO: 18954 - RNA, 9879 nt, Artificial Sequence
  derived and/or modified CDS sequence (opt5) from DENV-1__FJ410248__SS-prME
agcgugaccaugcugcucaugcugaugcccacggcccuugcuuuccaccugacgaccagaggcggggagccucauaugaucgucuccaagcaggaacggggaaaaucucuccuguuuaagacaagcgccggcguuaauaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuucuaccgagauccagcucacagacuacggcgcccugacccuggauuguagcccccggacaggccucgacuucaacgaaauggugcugcuuaccaugaaggagaaaagcuggcugguccauaagcagugguuucucgaucugccucuucccuggacguccggggcuucuacaagccaagagaccuggaaucgccaggaccugcucgugacauucaaaaccgcgcacgccaagaagcaggaagucgugguucugggaucccaagagggcgcuaugcacaccgcccugacaggggccacggaaauucagaccagcggaacaaccacaaucuuugcuggccaucucaaaugcagacugaagauggauaaacuuacccugaaggggaugucuuaugugauguguacgggcuccuucaaacucgagaaggaagucgccgagacacagcacggaaccgugcugguucagauuaaguacgagggcaccgacgcgccgugcaaaaucccuuucagcacacaagaugaaaagggggugacccagaacggacggcugaucacagcuaaucccauugucacggacaaagagaagccugugaacaucgaagccgagccgcccuuuggcgagucuuauauugugaucggggccggagaaaaagcucuuaagcucagcugguucaagaaaggcuccucuauugggaagauguuuguugccaccgcuagaggcgcccgccggauggcgauccugggagauacagccugggacuucggcagcaucgggggagucuuuaccuccgugggcaaacuggugcaucagauuuucgggacagcuuacggaguccucuuuagcggcgugucuuggaccaugaagaucgggauuggcguucugcuuacguggcugggacucaauuccagaagcaccucucuguccaugacauguaucgccgugggccuggucacccuuuaccucggggugaugguucaggcugauagcggaugcgugauuaacuggaaaggccgcgagcugaaguguggguccggaaucuucgucacaaaugaagugcacaccuggacagagcaauauaaguuucaggccgacucuccuaaacggcugagcgcggccauuggcaaggcuugggaagaggggguuugcggcaucagauccgccacccgccucgagaacaucauguggaaacagauuucuaacgaacugaaucauauccuucuggagaacgacaugaaguucacgguggucgugggagauguggcuggcauucucgcccaggggaaaaagaugauccggccgcaacccauggaauacaaauauagcuggaaguccuggggaaaggccaaaauuaucggcgcugacguccagaauacaaccuuuaucauugaugggccuaacacccccgaguguccugacgaucagagagcguggaauaucugggaaguugaggacuacggauucggcauuuuuacaaccaacaucuggcugaagcugcgcgauagcuauacacaggugugcgaccaccggcuuaugucugccgcuauuaaagauuccaaggccgugcacgccgacaugggcuacuggaucgagagcgagaagaaugagacauggaagcucgcuagagccucuuucaucgaagucaagaccuguauuuggcccaaaucccauacacuguggagcaacggggugcuggagucugaaaugaucauuccgaagaucuauggaggcccuauuagccaacacaauuaccgccccggguacuucacccagacagcgggaccuuggcaucucggcaaacuggagcuugauuuuaaccugugcgaggggaccacgguuguggucgacgaacacugcggaaaucggggccccucccucagaaccacaaccgugacaggcaagaucauccacgagugguguugccggagcuguacccugccuccccugcgcuucaaaggggaagauggaugcugguauggcauggagauuagaccgguuaaggagaaggaagagaaccuugugaaaucuauggucuccgcugggagcggagaaguggacuccuuuucucucggccugcuguguaucagcauuaugaucgaggaaguuaugcgguccagauggucucgcaagaugcucaugacggggacacuggccguguucuuucuucugauuaugggacagcucaccuggaaugaccugauccggcugugcauuauggucggcgccaacgcuagcgauagaaugggcauggggacaaccuaccuugcccugauggcgaccuucaaaaugcgcccuaugcucgcugugggacugcucuuuagacggcugacaucccgcgaggugcuucugcucacgaucggccugucucuggucgccagcguugagcuucccaauucccuggaagaacucggggacggacuggccaugggcaucaugauucucaagcugcuuaccgauuuccaaagccaucagcugugggcuacacuccugucucugaccuuuaucaaaacaaccuauucccuucacuacgccuggaagacgauggcuauggugcugagcauugugucucucuucccccugugucucuccacaaccagccagaagaccacauggcugccuguccuucuggggucucugggaugcaaaccgcucaccauguuucugaucgccgaaaacaagauuuggggcagaaaauccuggccccuuaacgagggcaucauggcgguggggaucguuagcauucugcucuccagccugcucaagaaugacgugccucuggccggaccccuuaucgcuggcgggaugcugauugccuguuaugucaucucuggaagcuccgcugaucugucucucgaaaaagccgccgaggugagcugggaggaagaggcugaacauuccggcgcgucucacaacauucugguugaggugcaggacgaugggacaaugaagaucaaagacgaggaacgggaugacacgcuuaccauccugcucaaggccacacugcucgcugucagcggaguguacccucuguccauucccgccacccuuuucgucugguauuuuuggcaaaagaaaaagcagcgcucuggcgugcugugggauacaccuuccccucccgagguugaaagagccgugcuggacgauggcaucuaccggauuaugcagcgcgggcuccugggaagaucccaggucggcguggggguuuuccaagagaauguguuccauaccauguggcacgucacgcggggagcugugcuuauguaccagggcaaacgccuggaacccagcugggccucugugaagaaagaccucaucuccuaugggggaggcuggagacugcagggcagcuggaacaccggggaggagguucaggucauugcgguggaacccggaaagaauccuaagaacgugcaaacagcucccggcaccuuuaaaacaucugagggggaagucggagccaucgcccucgacuucaagccgggcaccuccgggagcccuauugugaaucgggagggaaaaaucguuggccuguacggcaacgggguggucacaacguccggaaccuaugugucugcuaucgcccaggcgaaggcuagccaggaaggcccccuuccugagauugagaaugaaguuuuuagaaaacgcaaccugacaaucauggaucugcaccccggguccggaaagacccggagauaccuccccgccauugugcgcgaggccaucaagcggaaacugagaacccuuauucuggcuccuacacgcgucguggccagcgaaauggcugaggcccucaagggcaugccgauccgguaucaaacgaccgcgguuaaaucugaacauacagggaaggagaucguggaccugaugugccacgccaccuucacaaugagacugcucucccccguccgcgugccuaauuacaacaugauuaucauggaugaggcucauuuuaccgaccccagcucuauugccgcucggggcuauaucagcacgagagugggaaugggcgaagccgccgcuauuuucaugacagcgaccccucccggguccgucgaggccuuuccucagucuaaugcuguuauccaggaugaggaacgggacaucccggaacgcagcuggaacuccggauacgaguggauuaccgauuuccccggcaaaacagugugguuugugccuucuaucaagagcgggaaugacauugccaacugucuuagaaagaacggaaaacgggucauccagcugucccgcaagaccuucgauacagaguaccagaaaaccaagaauaacgacugggauuaugugguuacgacagacauuagcgaaaugggcgccaauuuuagagcugaccgggugaucgaucccagacgcugccugaaaccugucauucucaaggacgggcccgagcgggugauccuggccggcccgaugccuguuaccguggcgucugcugcccagagacgcggacggaucggcagaaaccacaauaaggaaggggaucaguacauuuauaugggacagccccuuaacaaugacgaggaucaugcccacuggacagaggcuaaaaugcugcucgacaacaucaauacccccgaaggcauuaucccugcccuguucgagcccgaacgcgagaaguccgcggccauugauggggaauaccggcugagaggagaggcucgcaaaacguucgucgagcucaugagacggggcgaccuuccuguguggcugagcuauaaggucgccuccgaaggguuucaauacucugaucgcagauggugcuucgacggcgagcggaacaaucaggugcuggaagagaacauggauguugaaaucuggaccaaagagggagagcgcaagaaacucagaccgcgguggcuggacgcuagaacauauagcgauccccuugcccugcgcgaauuuaaggaguucgcugccggccggagauccgugucuggggaccucauccuggaaauuggaaagcugccucagcaccucacccagcgcgcgcaaaaugcccuugacaaccuggugaugcugcauaauagcgagcagggcgggcgggcuuacagacacgccauggaggaacuccccgauacaaucgagacccugaugcuucuggcucucauugccguccugacaggaggcguuacccuguuuuuccucuccggccgggggcuuggaaaaacgagcaucggccugcugugugugauggccucuuccgugcuccuguggauggcuagcgucgaaccucauuggauugcggccucuaucauccuugaguuuuuccugauggugcuccugauucccgaaccggaccgccagagaacaccucaggauaaccaacuggcuuacguugugaucgggcuccuuuuuaugauucugaccgucgccgccaacgagaugggacugcucgagaccacaaagaaagaccugggcaucgggcacguggcugucgaaaaucaccaucacgccgcgaugcuugauguggaccugcaucccgccuccgcuuggacccucuaugccguugcuacaacgauuaucaccccuaugaugcggcacacaauugagaacaccacagccaauaucagccugaccgcgaucgccaaccaggcugccauucugaugggacucgauaagggcuggcccaucucuaaaauggacauuggcgugccucuucuggcucuggggugcuacagccaggucaauccccucacgcugaccgccgcugugcuuaugcugguugcccauuaugcgaucauuggaccgggccuccaagccaaggcuacacgcgaagcccagaagagaaccgcugccgggaucaugaaaaacccuacaguggauggaaucgucgccauugaccuggaucccgugguguacgacgcgaaguucgagaaacagcugggccagaucaugcuccuuauucuguguaccucccaaauccugcucaugcggacgacaugggcucugugcgaaucuauuacccuugccacagggccccugaccacccucugggagggaagcccuggcaaguuuuggaauacaacgaucgcuguuuccauggccaacaucuuccgcggcagcuaucuggccggggcuggacuggccuuuucccucaugaaaucucuuggcgggggaagacggggcaccggggcgcagggagagacacugggcgaaaaguggaagcgccagcugaaucagcucagcaaauccgaguucaacaccuacaagagaucuggcauuauggaagucgaucggagcgaggccaaagaagggcugaagagaggagagacaaccaaacacgcugugucccgcggcacggccaaacuucggugguucguggagagaaaucuggucaagccggaagggaaaguuaucgaccucggauguggccgcgggggauggucuuauuacugcgcuggccugaagaaagugacagaggugaagggcuacaccaaagggggacccggccacgaggagccuauucccauggccaccuauggguggaaccuggucaagcuccauagcggaaaagacguguuuuucaucccucccgaaaagugugauacacuucugugcgacauuggcgaguccagcccuaauccgaccaucgaggaagggcggacacugagaguucucaagaugguggagcccuggcugcgcggaaaccaauuuuguauuaaaauccuuaauccuuacaugcccucugucguggaaacgcuggagcagaugcagcggaagcacggcggcaugcucguuagaaacccucugucccgcaauagcacccaugagauguauugggugucuugcgggacaggaaacaucgucuccgcggugaacaugaccagccggaugcugcucaauagauucacaauggcccaccgcaaacccaccuacgaaaaggauguggaccugggcgcugggacgcggcacgucgccguugagccggaaguggcuaaccuugauauuaucggacagagaauugagaauaucaaacaugaacacaagucuaccuggcauuaugacgaggauaacccuuacaagacaugggccuaucacggcuccuacgaggugaaacccagcggguccgcuagcucuauggucaauggagugguuaagcugcucaccaaacccugggacgugauuccuauggucacacaaaucgccaugaccgauacaacccccuuuggccagcagcgcguguucaaggaaaaaguugacacgagaacaccuaaggcgaagcggggcaccgcccaaaucauggaggugaccgcuaaauggcuguggggguuucuuagccgcaacaagaaaccgagaauuuguacacgggaagaguucacgagaaagguccgguccaaugccgcuaucggagccguguuuguugaugaaaaccaguggaacucugccaaagaggcgguggaggacgaacgcuucugggaccugguccauagagagcgggaacuccacaagcagggcaagugcgcuaccugcguguacaacaugauggggaaacgcgagaagaaacugggagaauuuggcaaggccaaagggagcagagccauuugguauauguggcugggcgcucgguuccucgaguuugaggcccugggauucaugaaugaagaucacugguucucccgcgagaacucucuuagcggcgucgaaggggagggacugcauaagcucggcuacauccugagagacauuuccaaaauccccgggggaaauauguaugcugaugacacagccggcugggauacccggaucacagaggacgaucuucagaacgaagcgaagauuaccgacaucauggagccugaacacgcccugcucgcuaagucuauuuuuaaacugacauaccaaaauaaggugguucgcgugcagagacccgccaaaaacgggaccgucauggaugugaucagccggcgcgaccagagaggcuccggacaggugggcacguaugggcugaacaccuucacaaauauggaggcucaacucauucggcagauggaaagcgagggaaucuuuucuccuuccgagcuggaaacccccaaccuugccggccgcguucuggauuggcucgagaagcaugggguggaaagacugaaacggauggcgaucagcggagacgauugugucgugaagccgauugacgacagauucgccacagcucuuaccgcccugaaugauaugggcaagguucgcaaagacaucccucagugggagcccucuaagggguggaacgauuggcagcaagugccuuuuugcucccaccacuuccaucagcucauuaugaaagacggccgggaaaucgucgugcccuguagaaaucaggaugagcuggucggacgcgcucgggugagccagggcgccggguggucccugagagagacggcuugccucggaaagucuuacgcccaaauguggcagcugauguauuuucaccgccgggaccuuagacuggcggccaacgcuauuuguagcgccguuccuguggauuggguccccacaucccgcaccacauggagcauccaugcccaccaucaguggaugaccacggaagacaugcucucuguguggaaucggguuuggauugaggaaaacccguggauggaggauaaaacccacaucuccagcuggggcgacgugccuuaccuggggaagagagaagaucaauggugcggaucucuuaucggccugacagcucgcgccaccugggcgacaaauauucaggucgcuaucaaccaggugcggagacucauugggaaugagaacuaccuggacuauaugaccagcaugaagcgguucaaaaaugaguccgaccccgaaggcgcccugugguga

SEQ ID NO: 18955 - RNA, 9879 nt, Artificial Sequence
  derived and/or modified CDS sequence (opt5) from DENV-1__FJ410249__SS-prME
agcgugaccaugcugcugaugcugaugcccaccgcccuugcuuuccaccugacgacccggggcggggaaccucauaugaucgucuccaagcaggaacggggaaagucucuccuguuuaagacgagcgccggcguuaauaugugcacccuuauugcgauggaccugggggaguucugugaagauacaaugaccuacaagugcccgcgcaucacagaggcugaacccgacgauguggacuguuggugcaaugccaccgauacgugggugaccuauggaacauguucccaaaccggcgagagacggcgcgacaagagaucugucgcccucgcuccucacguggggcugggacuggagacacggaccgaaacguggaugagcuccgagggcgccuggaaacagauucagcgcguugaaacaugggcucucagacaucccggcuuuaccgugaucgcccuguuccuugcgcacgccauugggacaucuaucacccagaagggaaucauuuuuauccugcucaugcuggucaccccuagcauggcuaugcggugcgugggcguugggucccgcgauuucguggagggacuuagcggcgccacaugggucgacguggugcuggagcaugggucuugugucacgaccauggcuaaggauaaacccacacucgacauugaacugcugaagaccgagguuacaaacccugccgugcucagaaaacugugcaucgaagcgaagauuuccaauaccacgacagauagccgguguccgacccaaggagaggccacccuuguggaagaacaggacgcuaacuuugucugccgcagaacauucguggaucggggcuggggcaauggguguggacuguuuggcaaagggucucucauuaccugcgccaaguucaagugcguuacaaaacuggagggaaagacggugcaguacgaaaaccuuaaauauuccgucauugugaccguucacacaggcgaccagcaccaaguggggaaugagagcaccgaacauggaacaaccgcuacgaucacaccccaggccccuucuacagagauccagcugaccgacuacggcgcccucacacuggauuguucccccagaaccggccuggacuuuaacgaaaugguccuccugacgaugaaggagaaaagcuggcuugugcacaagcagugguuccuggaucucccucugcccuggacauccggggcuucuaccagccaagagacauggaauagaaaagaccuucuggucaccuuuaagaccgcgcaugccaagaaacaggaagugguugugcucggaucccaggagggcgcuaugcacacagcccugacgggggccaccgaaauucaaacaagcggaaccacaaccaucuucgcuggccaccugaagugccggcucaaaauggauaagcugacgcuuaaagggaugucuuaugucauguguacaggcuccuucaagcuggagaaggaaguggccgagacccagcauggaaccguucucgugcagauuaaauacgagggcacagacgcgccgugcaagaucccuuuuagcacccaggaugaaaaaggggucacacaaaacggaagacugauuacggcuaaucccaucgugaccgacaaggagaaaccugugaacaucgaagccgagccgcccuucggcgagucuuauauuguuaucggggccggagaaaaggcucugaaacuuagcugguuuaaaaagggcuccucuauugggaaaauguucgaggccacagcucgcggcgcccggagaauggcgauccucggagauaccgccugggacuuuggcagcauugggggagucuucacauccgugggcaagcuggugcaccagaucuuuggggcugccuacggaguccuguucagcggcgugucuuggaccaugaaaaucgggauuggcguucuccugacguggcuuggacucaauucccgcagcaccucucucuccaugacauguaucgcugugggccuggucacccuguaccuuggggugaugguucaggccgauagcggaugcgugauuaacuggaagggccgggaacucaaguguggguccggaaucuuugucacaaaugaggugcauaccuggacagaacaguauaaauuccaagcggacucuccuaagagacugagcgccgcuauuggcaaagccugggaggaggggguuugcggcauccgcuccgcuacccggcuggaaaacauuauguggaagcagaucucuaacgagcucaaucacauccugcuugaaaacgacaugaaauuuacgguggucgugggagauguggccggcauucuggcccaggggaagaaaaugaucagaccgcagcccauggaguacaaguauagcuggaaguccuggggaaaagcuaagauuaucggcgcggacguccaaaauacaaccuucauuaucgaugggccuaacacccccgaauguccugacgaucagcgcgccuggaauaucugggagguugaggacuacggauuuggcauuuucacaaccaacaucuggcucaaacugcgggauagcuauacacaggugugcgaccauagacugaugucugcugccauuaaggauuccaaagccgugcacgcugacaugggcuacuggaucgaaagcgagaagaaugaaacauggaaacuugcccgcgcgucuuucauugaggucaagaccuguaucuggcccaagucccacacacucuggagcaacggggugcuggaaucugagaugaucauuccgaaaaucuauggaggcccuauuagccagcauaauuaccggcccggguacuuuacccaaacagcuggaccuuggcaccugggcaagcucgagcuggauuucgaccuuugcgaagggaccacgguuguggucgaugagcauugcggaaacagaggccccucccugcggaccacaaccgugacaggcaaaaucauucacgaaugguguugccgcagcuguacccucccuccccugagauuuaagggggaggacggaugcugguauggcauggagauccggccgguuaaggaaaaagaggaaaaucuggugaagucuauggucuccgccgggagcggagagguggacuccuucucucuuggccuccuguguaucagcauuaugaucgaagagguuaugagaucccgcuggucucggaaaaugcugaugacggggacacucgccguguuuuucuuucugauuaugggacagcuuaccuggaacgaucugaucagacucugcauuauggucggcgcuaaugccagcgaccgcaugggcauggggacaaccuaccuggcgcugauggcuaccuucaagaugagaccuauguuugccgugggacuucuguuccggcgccucacauccagagaggugcugcuccugacgaccggccuuucucuggucgccagcguugaacuccccaacucccuggaggaacugggggauggacuugcuaugggcaucaugauucugaaacuccugacagacuuucagagccaccaacucugggccacccugcuuucucugacauucaucaagaccacguuuucccuccauuaugcuuggaagacaauggccauggugcugagcaucgugucucuguucccccuuugucuguccaccaccagccagaaaacaaccuggcucccuguccugcucgggucucugggaugcaagccgcuuacaauguuccugauugcggagaauaaaaucuggggccggaaguccuggccccugaacgaaggcauuauggccguggggaucguuagcauucuccuguccagccuucugaaaaacgaugugccucucgcuggaccccugaucgccggcgggaugcucaucgcuuguuacgucauuucuggaagcuccgccgaccugucucuugagaaggccgcugaggugagcugggaagaggaagcggagcacuccggcgccucucauaauauccugguugaagugcaggaugacgggacgaugaaaauuaaggaugaggagcgcgacgauacccugacaauccuccugaaggcuacccuucuggccgucagcggaguguauccucucuccauucccgccacacuguuugucugguacuucuggcagaaaaagaaacaaagaucuggcgugcucugggacaccccuagcccucccgaaguugagcgggcugugcuggaugacggcaucuaucgcaucaugcagagagggcuucugggacggucccaggucggcguggggguuuuucaggaaaacguguuccacacgauguggcaugucacccgcggagccgugcugauguaccaaggcaagagacucgagcccagcugggcgucugugaaaaaggaccugauuuccuacgggggaggcuggcggcuucagggcagcuggaauacaggggaggaaguucaggucaucgcuguggagcccggaaagaacccuaaaaaugugcagaccgcccccggcacauuuaagaccucugaaggggaggucggagccauugcucuggauuucaaaccgggcacauccgggagcccuaucgugaacagagaaggaaagauuguuggccucuauggcaaugggguggucacgaccuccggaacauacgugucugccaucgcgcaagcuaaagccagccaggagggcccccugccugagauugaagacgagguuuuucgcaagcggaaccucaccaucauggaucugcaccccggguccggaaagaccagacgcuaucuucccgccaucgugcgggaagcuauuaaaagaaagcugcgcacacugauccucgccccuacgcgggucguggcuagcgagauggccgaagcgcugaaaggcaugccgauuagauaccagaccacagccguuaagucugagcacaccgggaaagagaucguggaccuuaugugccaugcuacauucaccaugcgccugcucucccccguccgggugccuaauuauaacaugauuaucauggaugaagcccacuuuacggaccccagcucuaucgcugccagaggcuacauuagcacacgggugggaaugggcgaggccgcugcgaucuucaugaccgccaccccucccggguccgucgaggcuuuuccucaaucuaaugccguuauucaggaugaagaacgcgacaucccggagagaagcuggaacuccggauaugaguggauuacagauuuccccggcaagaccgugugguucgugccuucuaucaagagcgggaaugacaucgccaacugucugcggaaaaauggaaagcgcgucauucagcuguccagaaaaacauuugauaccgaauaccagaagacgaaaaacaacgacugggacuacgugguuacaaccgauaucagcgagaugggcgcuaauuuccgggccgacagagugauugauccccgccggugccucaagccugucauccuuaaggacgggcccgaaagagugauucuggcgggcccgaugccuguuacaguggcuucugccgcccaacgccggggaagaaucggccgcaaccauaauaaagagggggaucaguauauuuacaugggacagccccugaacaaugacgaggaucacgcucauuggaccgaagccaagaugcuccuggacaacaucaauacgcccgagggcaucauuccugcgcuuuuugaacccgagcgggaaaaauccgccgcuaucgauggggaguauagacugcgcggagaggccagaaagaccuucgucgaacucaugcggcgcggcgaccugccuguguggcugagcuacaaagucgcuuccgagggguuucaguauucugauagacgguggugcuucgacggcgaacgcaacaaucaagugcucgaggaaaacauggauguugagauuuggacaaaggagggagaacgcaagaaacuucggccgagauggcuggacgcccgcaccuacagcgacccccuggcucuccgggaguuuaaggaguucgccgcgggcagacgcuccgugucuggggaucugauccuugagauuggaaaacugccucagcaccucacacagcgggcccagaaugcucuggacaaccuggugaugcuccacaauagcgaacaaggcgggagagccuaucggcaugcuauggaggagcuucccgauaccaucgaaacacugaugcugcucgcccugaucgccguccuuaccggaggcguuacgcuguuuuuccucuccggccgcgggcugggaaagacaagcauuggccugcucugugugauggcuucuuccgugcuucuguggauggcgagcgucgagccucacuggaucgccgcuucuauuauccuggaauuuuuccucauggugcugcuuauucccgagccggacagacagcggaccccucaggauaaccagcuggccuacguugugaucgggcuccuguuuaugauccugaccgucgccgcuaaugagaugggacuccuugaaacaaccaaaaaggaccugggcauugggcauguggccgucgagaaccaccaccaugcggccaugcuggauguggaccuccaccccgcuuccgccuggacacuguacgcuguugccacgaccaucauuacaccuaugaugcgccauaccaucgaaaacacaaccgcgaauauuagccuuacggccaucgcuaaccaagccgcuauucugaugggacucgauaaaggcuggcccaucucuaagauggacaucggcgugccucugcuggcccucgggugcuauagccaggucaauccccuuacccugacagcugccgugcugaugcucguugcgcacuacgccauuaucggaccgggccugcaggcuaaggccaccagagaggcucaaaaacggacagccgccgggauuaugaagaacccuaccguggauggaaucgucgcgauugaccuugaucccgugguguaugacgcuaaauucgaaaagcagcugggccagaucaugcuccugauccuguguacgucccagauucuccuuaugcgcacaaccugggcccugugcgagucuaucacacuggcuaccgggccccucaccacacugugggagggaagcccuggcaaauucuggaauacgaccauugccguuuccauggccaacaucuuuagaggcagcuaccuugcuggggccggacuggcguucucccucaugaagucucugggcgggggacggcgcggcacaggggcccaaggagaaacccugggcgagaaguggaaaagacagcucaaucagcuuagcaaguccgaauuuaacacauauaaacggucuggcauuauggaggucgacagaagcgaagcuaaggaggggcugaaacgcggagagaccacgaagcaugccgugucccggggcacagcuaagcugagaugguucguggaacgcaaucucgucaaaccggaggggaagguuaucgaucugggauguggcagagggggauggucuuacuauugcgccggccuuaaaaaggugaccgaagugaaaggcuacaccaaagggggacccggccacgaggaaccuauccccauggcgacauacggguggaaccuggucaaacuccacagcggaaaggacguguuuuucauuccucccgagaagugugauacccugcugugcgacaucggcgaguccagcccuaauccgacaauugaagaggggagaacgcuccgcguucuuaaaaugguggaacccuggcugcggggaaaccaguuuuguaucaagauucugaauccuuauaugcccucugucguggagacccucgagcaaaugcagagaaaacauggcggcaugcugguucgcaacccucuuucccggaauagcacacacgaaauguacugggugucuugcgggaccggaaacaucgucuccgccgugaauaugacaagcagaaugcugcucaaccgcuucaccauggcucaucggaagcccacguaugagagagauguggaccugggcgccgggacccgccacgucgcuguugaaccggagguggccaaccuggauauuaucggacagagaaucgaaaauauuaaacacgagcauaagucuacauggcacuacgacgaggauaacccuuauaagaccugggcuuaccauggcuccuaugaagugaaacccagcggguccgccagcucuauggucaauggagugguuaagcuccugacaaaacccugggacgugaucccuauggucacccagauugcgaugacagauaccacgcccuuuggccaacagcggguguucaaggagaaaguugacacacgcaccccuaaggccaagagaggcaccgcucagaucauggaagugacagccaaauggcuuuggggguuucugagccggaacaagaaaccgagaauuuguacgcgggaggaguucacccgcaaggucagauccaaugcugccaucggagccguguuuguugacgagaaccaauggaacucugcgaaagaggcuguggaagaugagcgguucugggaccucguccaccgcgaaagagagcugcauaagcagggcaagugcgccacaugcguguacaacaugauggggaaacgggaaaagaaacuuggagaguucggcaaggccaaagggagccgcgcuaucugguacauguggcugggcgccagauuucucgaguucgaagcucugggauuuaugaaugaggaucacugguucucccgggaaaacucucugagcggcgucgagggggagggacuccacaagcugggcuauauucuucgcgacaucuccaaaauucccgggggaaauauguacgccgaugacaccgcgggcugggauacaagaaucaccgaagacgaucugcagaacgaggccaagauuacagacaucauggaaccugagcaugcucuccuggccaagucuaucuuuaaacuuaccuaucagaauaaggugguucgggugcaacgccccgcuaaaaacgggacggucauggaugugauuagcagacgggaccagcgcggcuccggacaggugggcaccuacgggcugaauacauucaccaacauggaagcccagcucaucagacaaauggagagcgagggaaucuuuucuccuuccgaacuggagacacccaaccuggcgggccggguucucgauuggcuggaaaagcacgggguggagagacuuaaacgcauggccaucagcggagacgacugugucgugaagccgauugaugaccgguucgcuaccgcccugacggcucucaaugauaugggcaagguuagaaaagacgugccucagugggaacccucuaagggguggaacgauuggcagcaggucccuuuuugcucccaucacuuccaccaacugaucaugaaagacggccgcgagaucgugguccccugucggaaucaggaugagcuugugggcagagcccgcguuagccagggagcuggguggucccugcgggaaacagccugccucggaaagucuuaugcgcagauguggcaacugauguacuuucauagacgcgaccugcggcucgccgcuaacgccauuuguagcgccgugccugucgauugggugcccaccuccagaacaaccuggagcauccacgcucaucaccaguggaugacgaccgaggacaugcugucuguuuggaaucgcguguggauugaagagaacccguggauggaagauaaaacacauaucuccagcuggggcgacgucccuuaucuugggaagcgggaggaccaguggugcggaucucugauuggccucaccgccagagcgacaugggcuaccaauauccaaguggccauuaaccaggugcggagacugaucgggaaugagaacuaccuugauuacaugacaagcaugaagcgcuucaaaaaugaauccgaccccgagggcgcccugugguga

SEQ ID NO: 18956 - RNA, 9879 nt, Artificial Sequence
  derived and/or modified CDS sequence (opt5) from DENV-1__FJ410251__SS-prME
agcgugaccaugcugcucaugcugaugcccaccgcccuugcuuuccaccugacgacccggggaggggagccucauaugaucgucacaaagcaggaacggggaaaaucccuccuguuuaagaccucugccggcguuaacaugugcacacuuauugcgauggaccugggggagcucugugaagauaccaugacauacaaaugcccccgcaucaccgaggcugaacccgacgauguggacuguuggugcaaugccacggauaccugggugacauauggaaccuguagccagacaggcgagcacagacgggacaagcgcuccguugcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaggaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggaggcaaagcucuuaagcucucuugguucaagaaagggagcuccauuggcaagauguuugaagccacagcuagaggagcccgccggauggcgauccugggcgauaccgccugggacuucgggucugugggaggcguuuuuacaagcgucgggaaacuggugcaucagaucuucggaaccgcuuacggcgugcucuuuuccggggucagcuggacgaugaagauuggcaucggagugcugcuuaccuggcugggccucaauucuagauccacaagccugucuaugaccuguauugccguugggcuggugacacuuuaccucggagucauggugcaggcugauuccggcugcguuaucaacuggaaagggcgcgagcugaaguguggaagcggcauuuucgugaccaaugaaguccacacauggaccgagcaauauaaguuucaggccgacuccccuaaacggcugucugcggccaucgggaaggcuugggaagagggcgugugcggaauuagaagcgccacgcgccucgagaacaucauguggaaacagaucuccaacgaacugaaucauauucuucuggagaacgacaugaaguucacaguuguggucggcgaugugguggggauccucgcucagggcaaaaagaugauucggccgcaacccauggaacacaaauacucuuggaaaagcuggggcaaggccaagaucauuggggccgacguccagaauaccaccuuuaucaucgauggaccuaacacacccgaguguccugacgaucagagagcuuggaauauuugggaaguugaggacuauggcuucggcaucuuuaccacgaacauuuggcugaagcugcgcgauuccuacacacaggugugcgaccaccggcuuaugagcgcggccaucaaagauucuaaggcugugcaugccgacaugggguauuggauugaguccgagaaaaaugagaccuggaagcucgccagagcuagcuucaucgaagucaagacauguaucuggcccaaaucucacacccugugguccaacggagugcuggagagcgaaaugauuaucccgaagauuuacggcgggccuaucucucaacauaauuaucgccccggauacuucacacagaccgccggcccuuggcaccucgggaaacuggagcuugauuuugaccugugcgagggaacgaccguuguggucgaugaacacugcggcaaccggggccccagccucagaacaaccacagugaccgggaagauuauccaugagugguguugccgguccuguacgcugccuccccugcgcuucaaaggagaagacggcugcugguacgggauggagaucagaccgguuaaggagaaggaagagaaucuugugaaaagcauggucucugcgggauccggcgaaguggacagcuuuucccucgggcugcuguguauuucuaucaugauugaggaaguuaugcggagcagauggucccgcaagaugcucaugacaggaacccuggcuguguuccuucugcucaucaugggccagcugacauggaacgaucugauucggcuuugcaucauggucggcgccaaugccucugacagaauggggaugggaaccaccuaucuggcucucauggccacauuuaaaaugcgcccuauguucgcggugggccugcucuuuagacggcugacgagccgcgaggugcuucugcucaccauugggcugucccuggucgcuucuguugagcuucccaacagccuggaagaacugggagauggccuggccauggggaucaugauccucaagcugcuuacagacuuccaaucccaccagcugugggccacccuccugagccugacauuuauuaaaaccacgcuuucucugcauuacgcuuggaagacaauggccauggugcucuccaucgugagccuguucccccucugucugucuaccaccucccagaagacaaccuggcuuccuguccugcugggaagccucggcugcaaaccgcugacaauguuucuuauuacggaaaauaagaucuggggcagaaaaucuuggccccugaacgaggggauuauggcugugggaguuguguccauccuccugagcucccuccugaagaacgaugucccucuugccggcccccugaucgccgggggaaugcugauugccuguuaugugaucagcggcucuagcgcugaccucucccuggaaaaagccgcugagguuucuugggaggaagaggccgaacacagcggggccucccauaauauucuuguggagguccaggaugacggaaccaugaagaucaaagaugaggaacgggacgauacacugaccauucuccugaaggcuacacuccuggcggugucuggcgucuacccucuuagcauccccgccacccuguucgugugguauuuuuggcaaaagaaaaagcagcgcuccggcguucugugggacacgccuucucccccggagguggaaagagcuguccucgaugacgggaucuaccggauuaugcagcgcggacugcuuggcagaagccagguggggguuggaguguuccaagagaacgucuuccacaccauguggcacgugacacggggcgccgugcugauguaucaggggaaacgccucgaaccuuccugggccagcguuaagaaagaccugaucucuuacggaggcggcuggagacuccagggguccuggaauaccggagaggagguccaggugauugcuguggaacccggcaagaacccuaagaauguccaaacagcccccgggaccuuuaaaacaccggagggagaagugggcgcgaucgcucuggauuucaagccugggacgagcggaucucccauuguuaaccgggagggcaaaaucgugggccuuuacgggaauggagucgugaccacauccggcaccuauguuagcgccauugcccaggcuaaggccucccaggaagggccucugcccgagaucgaggacgaaguguuuagaaaacgcaaccugaccaucauggaucuccaucccggaucuggcaagacacggagauaccugccugcgauuguccgcgaggcuaucaagcggaaacuuagaacgcugauucucgccccgacccgcgugguugccagcgaaauggcugaggcccugaaggggaugcccauccgguaucaaacaaccgcugugaaauccgaacacacaggcaaggagauugucgaccugaugugccaugccaccuucacgaugagacuccuuagcccugugcgcgugcccaauuacaacaugaucaucauggaugaggcgcacuuuacagacccuucuuccauugccgcucggggauauaucagcaccagagucggcaugggggaagccgcugccauuuucaugaccgccacacccccuggaucuguugaggcuuuuccgcagagcaaugcggugauccaggaugaggaacgggacauucccgaacgcuccuggaacucuggcuacgaguggaucaccgauuucccugggaaaacagugugguuuguccccagcaucaaguccggaaaugacauugccaacugucugagaaagaauggcaaacgggugauccagcugucucgcaagaccuucgauacggaguaucagaaaaccaagaacaacgacugggacuacguugugaccacagauauuagcgaaaugggggcuaauuuuagagccgaccgggucaucgauccuagacgcugccucaaacccgugauucugaaggacggcccggagcggguuauccuugccggaccuaugcccgugaccgucgcuuccgccgcgcagagacgcggccggauugggagaaaccauaauaaggaaggagaucaguacaucuauaugggccagccccugaacaaugacgaggaucacgcucacuggacggaggccaaaaugcuccuggacaacaucaauaccccugaagggauuauccccgcccuguucgagccugaacgcgaaaagagcgcugccauugauggagaauaccggcucagaggcgaggcgcgcaaaacauucguggagcuuaugagaagaggggaccugccggucuggcugucuuauaagguggccuccgaaggcuuucaauacagcgaucgcagauggugcuucgacggagagcggaacaaucagguucucgaagagaacauggauguggaaaucuggaccaaagagggcgagcgcaagaaacugagaccccgguggcuugacgcuagaacauauuccgacccucuggcccuccgcgaauuuaaggaguucgcugccgggcggagaucugugagcggagaucugauucuggaaaucggcaagcucccccagcaucuuacccagcgcgcucaaaaugcccuggacaaccuggucaugcuccacaauuccgagcaagggggacgggcguacagacaugccauggaggaacugccugauacaaucgagacccuuaugcugcucgcucugauugccguucugacgggcggcgugacacucuuuuuccuuucugggcggggacugggcaaaaccagcaucgggcugcucugugugauggcuuccagcguccugcuuuggauggccucuguggaaccccacuggauugccgcuuccaucauucuggaguuuuuccucaugguucugcugaucccggaaccugaccgccagagaacaccccaggauaaccaacucgcguauguggucaucggacuucuguuuaugauucugacaguggccgcuaaugagaugggccuccuggagaccacaaagaaagaccuugggaucggacacgucgccguggaaaaccaucaccaugccacgaugcuggauguugaccuccacccugcuagcgccuggacccuguacgcgguggccacaaccauuaucacacccaugaugcggcauaccauugagaacacgaccgcuaauaucucucugacagccauugcuaaccaggccgcgauccucaugggccuugauaagggcuggccuaucuccaaaauggacauuggggucccccugcuggcccucggaugcuacagccaggugaauccgcugacccuuacagcugccguucugaugcucguggcucacuaugccaucauuggcccugggcugcaagcuaaggccacccgcgaagcgcagaagagaacggccgcuggaaucaugaaaaaccccacagucgauggcauuguggccaucgaccuggaucccgugguuuacgacgcuaaguucgagaaacagcucgggcagaucaugcuucugauucuguguaccucucaaauccuccugaugcggacaaccugggcccuuugcgaaagcauuacccuggccacaggaccucucacgacccugugggagggcuccccgggcaaguuuuggaauacaaccaucgcggucucuauggcuaacauuuuccgcgggagcuaucuggccggagcuggccucgccuuuucccuuaugaaaagccucgggggaggcagacgggggacaggagcccagggcgagacccugggcgaaaaguggaagcgccagcucaaucagcuguccaaaucugaguucaacaucuacaagagaagcgggaucauggaaguggaccgguccgaggcuaaagaaggacuuaagagaggcgagacgacacgccacgccgugucucgggggaccgcgaaacugagaugguucgucgagcgcaaucucguuaagcccgaaggaaaggugauugaucugggcugugggcggggaggcuggagcuauuacugcgccggccugaaaaaggugaccgaggucaaaggguauacaaagggaggcccugggcaugaggagcccaucccuauggcuaccuacggauggaaccucgugaaacuucacuccggcaaggacgucuuuuucacacccccugaaaaaugugauacgcugcugugcgacauuggggagucuagcccgaaucccaccaucgaggaaggaagaacacuccgcgugcugaagauggucgagccuuggcuucggggcaaccaauuuuguauuaagauccugaaucccuacaugccuuccgugguugaaacccucgagcagaugcagagaaaacauggcgggaugcuggugcgcaacccccugagcagaaauucuacacacgagauguauugggucuccugcggaaccggcaacauugugagcgccgugaauaugacgucuagaaugcuccugaaccgcuucaccauggcucaccggaagccgacauacgaaagagaugucgaccuuggggccggaacccgccauguugcgguggagccugaaguggccaaccuggauaucaucggccagagaauugagaauaucaaacacgaacauaaguccacauggcacuaugacgaggauaaccccuacaaaaccugggcuuaucaugggagcuacgaggucaagcccucuggauccgccagcuccauggugaauggcguugugaagcuccugacaaaaccuugggacgucauucccauggugacccaaaucgcuaugacggauacaaccccuuuuggccagcagcggguuuucaaggaaaaaguggacacccgcacaccgaaggccaaaagagggacggcucaaauuauggaggucaccgcccgguggcuuuggggauuucugagcagaaacaagaagccccggaucuguacacgcgaagaguucaccagaaaagugcggucuaaugcggccaucggcgcuguuuuuguggacgaaaaccaguggaauagcgccaaggaggcugucgaggaugaacgcuucugggaccucgugcagaaagagagagaacugcacaagcaggggaaaugcgccacaugcgucuauaacaugaugggaaagcgggagaagaaacugggcgaauuugggaaggccaaaggcucccgcgcgauuugguacauguggcucggagcuagauuccuggaguuugaggcccuuggcuucaugaaugaagaucacugguucucucgggagaacagccuguccgggguggaaggagagggccuccauaagcugggguacauccuucgcgacauuucuaaaaucccuggaggcaauauguaugccgaugacaccgcugggugggauacaagaauuaccgaggacgaucugcaaaacgaagccaagaucacggacaucauggagcccgaacacgcucuccuggccaccagcauuuuuaaacugacauaccagaauaagguugugcggguccagcgcccugcgaagaacggcaccgugauggaugugaucuccagacgggaccagcgcggaucuggccaaguugggacauauggacucaauaccuucacgaacauggaggcccagcugauuagacagauggaaagcgagggcaucuuucuucccuccgagcuggaaacaccgaaccucgcugagcgggugcuggauuggcuugaaaaauacggggucgagagacugaagcgcauggccauuagcggagacgacugugugguuaaaccuaucgaugaccgguucgcuaccgcccucacagcgcugaaugauaugggcaaggugagaaaagacaucccccagugggaaccuucuaagggguggaacgauuggcaacagguccccuuuugcucccaucacuuccaccagcugauuaugaaggacggccgcgagaucguggucccuugucggaaucaggaugagcucgugggacgggcgcgcguuagccaaggcgcuggguggucucugcgggaaaccgccugccuuggaaaauccuaugcucagauguggcagcugauguacuuucauagacgcgaccuccggcuggccgcuaacgccauuuguagcgcggugcccgucgauugggugccgacguccagaaccacauggucuauccacgcccaucaccaauggaugaccacagaggacaugcuuagcguuuggaaucgcguguggauugaagagaacccuuggauggaagauaagacccaugucuccagcuggggcgacgugcccuaucuggggaaacgggaggaccaguggugcggaucucucaucggccugacagcuagagccaccugggccuccaauauucagguggcuaucaaccagguucggagacugaucgggaaugagaacuaccucgauuacaugacgagcaugaagcgcuucaaaaaugaaggcgaccccgagggagcccugugguga

SEQ ID NO: 18957 - RNA, 9879 nt, Artificial Sequence
  derived and/or modified CDS sequence (opt5) from DENV-1__FJ410252__SS-prME
uccgugaccaugcugcucaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugcccccgcaucacagaagcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacacuggucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuucuaccgagauccagcucacagacuacggcgcccugacccuggauuguagcccccggacaggccucgacuucaacgaaauggugcugcuuaccaugaaggagaaaagcuggcugguccauaagcagugguuucucgaucugccucuucccuggacguccggggcuucuacaagccaagagaccuggaaucgccaggaccugcucgugacauucaaaaccgcgcacgccaagaagcaggaagucgugguucugggaucccaagagggcgcuaugcacaccgcccugacaggggccacggaaauucagaccagcggaacaaccacaaucuuugcuggccaucucaaaugcagacugaagauggauaaacuuacccugaaggggaugucuuaugugauguguacgggcuccuucaaacucgagaaggaagucgccgagacacagcacggaaccgugcugguucagauuaaguacgagggcaccgacgcgccgugcaaaaucccuuuccugacacaagaugaaaagggggugacccagaacggacggcuuaucacagcuaaucccauugucacggacaaagagaagccugugaacaucgaagccgagccgcccuuuggcgagagcuauauugugaucggggccggagaaaaagcucucaagcugucuugguucaagaaaggcagcuccauugggaagauguuugaggccaccgcuagaggcgcccgccggauggcgauccugggagauacagccugggacuucggcucuaucgggggaguuuuuaccagcgucggcaaacucgugcaucagauuuucgggacagcuuacggagugcuguuuuccggcgucagcuggaccaugaagaucgggauuggcgugcuucugacguggcucggacucaauucuagauccaccagccugucuaugacauguaucgccguuggccuugugacccucuaccugggggucauggugcaggcugauuccggaugcguuauuaacuggaaaggccgcgaacugaagugugggagcggaaucuucgugacaaaugagguccacaccuggacagaacaauauaaguuucaggccgacuccccuaaacggcucucugcggccauuggcaaggcuugggaggagggggugugcggcaucagaagcgccacccgccuggaaaacaucauguggaaacagauuuccaacgagcuuaaucauauccugcucgaaaacgacaugaaguucacgguuguggucggagauguggcuggcauucuggcccaggggaaaaagaugauccggccgcaacccauggaguacaaauauucuuggaaaagcuggggaaaggccaagauuaucggcgcugacgugcagaauacaaccuuuaucauugaugggccuaacacccccgaauguccugacgaucagagagcguggaauaucugggaggucgaggacuacggauucggcauuuuuacaaccaacaucuggcugaaacuucgcgauuccuauacgcagguuugcgacuaccggcucaugagcgccgcuauuaaagauucuaaggccgugcacgccgacaugggcuauuggaucgaauccgagaaaaaugaaacauggaagcuggcuagagccagcuucaucgaggugaagaccuguauuuggcccaaaucucacacacugugguccaacgggguccucgaaagcgagaugaucauuccgaagaucuacggaggcccuauuucucaacauaauuaccgccccggguauuucacccagacagcgggaccuuggcaccugggcaaacuugagcuggauuuugaccucugcgaagggaccacggugguuguggaugagcauugcggaaaccggggccccagccugagaaccacaaccgucacaggcaagaucauccacgaaugguguugccgguccuguacccugccuccccuucgcuucaaaggggaggacggaugcugguacggcauggagauuagaccggugaaggaaaaggaggaaaaucucguuaaaagcauggugucugcuggguccggagaggucgacagcuuuucccugggccugcucuguaucucuauuaugaucgaagaggugaugcggagcagauggucccgcaagaugcugaugacggggacacuugccguuuucuuucugcucauuaugggacagcugaccuggaacgaucugauccggcuuugcauuauggugggcgccaaugcuucugacagaaugggcauggggacaaccuaucuggcccucauggcgaccuucaaaaugcgcccuauguuugcugucggacugcuguucagacggcugacaagccgcgaggugcuucugcucacgaucggccugucccugguggccucugucgaacuucccaacagccuggaggaacucggggauggacuggccaugggcaucaugauucucaagcugcuuaccgacuuucaaucccaccagcugugggcuacacuccugagccugaccuucaucaaaacaaccuuuucucuucauuacgccuggaagacgauggcuaugguucuguccauugugagccucuucccccugugucucucuacaaccucccagaagaccacauggcugccugugcuucuggggagccugggaugcaaaccgcucaccauguuucugaucgccgagaauaagauuuggggcagaaaaucuuggccccuuaacgaaggcaucauggcggucgggaucguguccauucugcucagcucccugcucaagaacgauguuccucuggccggaccccuuaucgcuggcgggaugcugauugccuguuaugugaucagcggaucuagcgcugaccugucccucgagaaagccgccgaggucucuugggaagaggaagcugagcacagcggcgcgucccauaauauucugguggaaguucaggaugacgggacaaugaagaucaaagaugaggagcgggacgauacgcuuaccauccugcucaaggccacacugcucgcugugucuggagucuacccucugagcauucccgccacccuuuucgugugguauuucuggcaaaagaaaaagcagcgcuccggcguccugugggacacaccuucucccccggaaguggagagagccguucuggaugacggcaucuaccggauuaugcagcgcgggcuccugggaagaagccaggugggcgucgggguguuucaagaaaacguuuuccacaccauguggcaugugacgcggggagcuguccuuauguaccagggcaaacgccuggagccuuccugggccagcgugaagaaagaccucaucucuuaugggggaggcuggagacugcagggcuccuggaauaccggggaggaagugcagguuauugcggucgagcccggaaagaacccuaagaaugugcaaacagcucccggcaccuuuaaaacaagcgaaggggaggugggagccaucgcccucgauuucaagccgggcaccucuggguccccuauugucaaccgggaaggaaaaaucgugggccuguacggcaaugggguugugacaacgagcggaaccuaugucuccgcuaucgcccaggcgaaggcuucucaggagggcccccuuccugagauugaagacgagguguuuagaaaacgcaaccugacaaucauggaucugcaccccgggagcggaaagacccggagauaccuccccgccauuguucgcgaagccaucaagcggaaacugagaacccuuauucuggcuccuacacgcguggucgccuccgagauggcugaagcccucaagggcaugccgauccgguaucaaacgaccgcggugaaaagcgagcacacagggaaggagaucguugaccugaugugccaugccaccuucacaaugagacugcucucucccgugcgcgucccuaauuacaacaugauuaucauggaugaagcucacuuuaccgaccccuccagcauugccgcucggggcuauaucucuacgagagugggaaugggcgaggccgccgcuauuuucaugacagcgaccccucccgggagcguggaagccuuuccucaguccaaugcugucauccaggaugaggaacgggacaucccggagcgcucuuggaacagcggauacgaguggauuaccgauuuccccggcaaaacaguuugguuugugccuuccaucaagucugggaaugacauugccaacugucuuagaaagaauggaaaacgggugauccagcugagccgcaagaccuucgauacagaauaccagaagaccaagaacaacgacugggacuaugucgugacgacagauauuuccgagaugggcgccaauuucagagcugaccggguuaucgaucccagacgcugccugaaaccugugauucucaaggacgggcccgaacgggucauccuggccggcccgaugccugugaccguugcgagcgcugcccagagacgcggacggaucggcagaaaccauaauaaggagggggaucaguacauuuauaugggacagccccuuaacaaugacgaggaucacgcccauuggacagaagcuaaaaugcugcucgacaacaucaauacccccgagggcauuaucccugcccuguuugaacccgagcgcgaaaagucugcggccauugauggggaguaccggcugagaggagaggcucgcaaaacguucguggaacucaugagacggggcgaccuuccugucuggcuguccuauaagguggccagcgagggguuucaauacuccgaucgcagauggugcuucgacggcgaacggaacaaucagguccuggaggaaaacauggauguggagaucuggaccaaagagggagaacgcaagaaacucagaccgcgguggcuggacgcuagaacauauucugacccccuugcccugcgcgaguuuaaggaguucgcugccggccggagaagcguuuccggggaucucauccuggagauuggaaagcugccucagcaccucacccagcgcgcgcaaaaugcccuugacaaccuggugaugcugcacaauucugaacagggcgggcgggcuuacagacaugccauggaggagcuccccgauacaaucgaaacccugaugcuucuggcucucauugccgugcugacaggaggcgucacccuguuuuuccucagcggccgggggcuuggaaaaacguccaucggccugcuguguguuauggccagcucugugcuccuguggauggcuuccguggagccucacuggauugcggccagcaucauccuugaauuuuuccugaugguccuccugauucccgagccggaccgccagagaacaccucaggauaaccaacuggcuuacgugguuaucgggcuccuuuuuaugauucugaccguggccgccaaugagaugggacugcucgaaaccacaaagaaagaccugggcaucgggcaugucgcuguggagaaccaccaccaugccgcgaugcuugaugucgaccugcaccccgccucugcuuggacccucuaugccguggcuacaacgauuaucaccccuaugaugcggcauacaauugaaaacaccacagccaauaucucccugaccgcgaucgccaaccaggcugccauucugaugggacucgauaagggcuggcccaucagcaaaauggacauuggcguuccucuucuggcucuggggugcuacucucaggugaauccccucacgcugaccgccgcuguccuuaugcugguggcccacuaugcgaucauuggaccgggccuccaagccaaggcuacacgcgaggcccagaagagaaccgcugccgggaucaugaaaaacccuacaguugauggaaucguggccauugaccuggaucccgucguguacgacgcgaaguucgaaaaacagcugggccagaucaugcuccuuauucuguguaccagccaaauccugcucaugcggacgacaugggcucugugcgaguccauuacccuugccacagggccccugaccacccucugggagggaucuccuggcaaguuuuggaauacaacgaucgcugugagcauggccaacaucuuccgcggcuccuaucuggccggggcuggacuggccuucagccucaugaaaucccuuggcgggggaagacggggcaccggggcgcagggagaaacacugggcgagaaguggaagcgccagcugaaucagcucucuaaaagcgaauuuaacaccuacaagagauccggcauuauggagguugaccggucugaagccaaagaggggcugaagagaggagagacaaccaaacaugcugucagccgcggcacggccaaacuucggugguucguggaaagaaaucuggugaagccggaggggaaagucaucgaucucggauguggccgcgggggaugguccuauuacugcgcuggccugaagaaaguuacagaagugaagggcuacaccaaagggggacccggccacgaggaaccuauucccauggccaccuauggguggaaccuggugaagcuccacucuggaaaagacgucuuuuucaucccucccgagaagugugauacacuucugugcgacauuggcgagagcuccccuaauccgaccaucgaagaggggcggacacugagagugcucaagaugguugaacccuggcugcgcggaaaccaauuuuguauuaaaauccuuaauccuuacaugcccagcguggucgagacgcuggagcagaugcagcggaagcauggcggcaugcucgugagaaacccucugucucgcaauuccacccacgaaauguauuggguuagcugcgggacaggaaacaucgugucugcggucaauaugaccucccggaugcugcucaacagauucacaauggcccaucgcaaacccaccuacgagcgggauguggaccugggcgcugggacgagacacguggccgucgaaccggagguugcuaaccuugauauuaucggacagcgcauugaaaauaucaagcacgagcauaaaagcaccuggcacuaugacgaggauaacccuuacaagacaugggccuaucauggcucuuacgaagugaagcccuccgggagcgcuuccagcauggugaauggagucgugaaacugcucaccaagcccugggacguuauuccuauggugacacaaaucgccaugaccgauacaacccccuuuggccagcagagagucuucaaagagaagguggacacgcggacaccuaaagcgaagcgcggcaccgcccaaaucauggaaguuaccgcuaaguggcuguggggguuucuuucuagaaacaaaaagccgcggauuuguacaagagaggaguucacgcggaaagugcgcagcaaugccgcuaucggagccgucuuuguggacgagaaccaguggaacuccgccaaggaggcgguugaagaugagagauucugggaccuggugcaccgggaacgcgagcuccauaaacagggcaagugcgcuaccugcgucuacaacaugauggggaagagagagaagaagcugggagaguuuggcaaagccaaggggucucgggccauuugguauauguggcugggcgcucgcuuccucgaguucgaagcccugggauuuaugaaugaggaucacugguucagcagagaaaacucccuuucuggcguggagggggagggacugcacaaacucggcuacauccugcgggacauuagcaagauccccgggggaaauauguaugcugaugacacagccggcugggauacccgcaucacagaagacgaucuucagaacgaggcgaaaauuaccgacaucauggaaccugagcaugcccugcucgcuaaguccauuuuuaagcugacauaccaaaauaaagucgugagaguucagcggcccgccaagaacgggaccgugauggaugucaucucucgcagagaccagcggggcagcggacaggugggcacguaugggcugaauaccuucacaaacauggaagcucaacucauucgccagauggaguccgagggaaucuuuagcccuucugaacuggagacccccaaccuugccggcagagugcuggauuggcucgaaaaacacgggguugagcggcugaagagaauggcgaucuccggagacgacuguguggucaaaccgauugaugaccgcuucgccacagcucuuaccgcccugaaugauaugggcaaggugcggaaggacaucccucagugggaacccagcaaaggguggaacgauuggcagcaaguuccuuuuugcucucaucacuuccaccagcucauuaugaaggacggcagagagaucgugguccccugucgcaaucaggaugagcuggugggacgggcuagagucucccagggcgccggguggagccugcgcgaaacggcuugccucggaaaauccuacgcccaaauguggcagcugauguauuuucaucggagagaccuucgccuggcggccaacgcuauuuguucugccgugccuguugauugggugcccacaagccggaccacaugguccauccacgcccaucaccaguggaugaccacggaggacaugcucagcgucuggaauagaguguggauugaagagaacccguggauggaagauaagacccauaucucuuccuggggcgacguuccuuaccuggggaaacgcgaggaccaauggugcggaagccuuaucggccugacagcucgggccaccugggcgacaaauauucagguggcuaucaaccaggucagacggcucauugggaaugagaacuaccuggauuauaugaccucuaugaagagauucaagaaugaaagcgaccccgagggcgcccugugguga

SEQ ID NO: 18958 - RNA, 9879 nt, Artificial Sequence
  derived and/or modified CDS sequence (opt5) from DENV-1__FJ461331__SS-prME
agcgugaccaugcugcucaugcugaugcccaccgcccuugcuuuccaccugacgaccagaggaggggagccucauaugaucguguccaagcaggaacggggaaaaucucuccuguuuaagaccagcgccggcguuaauaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaggaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacugauucaucagaucuucgggaccgcuuacggagugcucuuuuccggcgugagcuggacgaugaagauugggaucggcguccugcuuaccuggcugggacucaauucuagauccacaagccugucuaugaccuguauugccgugggccugguuacacuuuaccucggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcugucugcggccaucggcaaggcuugggaggagggggucugcggcaucagaagcgccacgcgccucgaaaacauuauguggaaacagaucuccaacgagcugaaucauauucuucuggaaaacgacaugaagcucacagugguugugggagaugucgcuggcauccuggggcagggcaagaagaugauucggccgcaacccauggaguacaaauauucuuggaaaagcuggggcaaggccaagaucaucggggccgacgcucagaauaccaccuucauuaucgauggaccuaacacacccgaauguccugacgaucagagagcguggaauauuugggagguggaggacuacggcuuuggcaucuucaccacgaacauuuggcugaaacuucgcgauuccuauacacaggugugcgaccaccggcucaugagcgccgcuaucaaagauucuaaggccguccacgccgacaugggguacuggaucgaauccgagaaaaaugaaaccuggaagcuggcuagagccagcuuuauugagguuaagacauguaucuggcccaaaucucauacccugugguccaacggagugcucgaaagcgagaugauuaucccgaagauuuauggcgggccuaucucucaacacaauuaccgccccggauacuucacacagaccgcgggcccuuggcaucuggggaaacuugagcuggauuucgaccucugcgaaggaacgaccguggucguggaugagcacugcggcaaccggggccccagccugagaacaaccacaguuaccgggaagaucauucacgaaugguguugccgguccuguacgcugccuccccuucgcuuuagaggagaggacggcugcugguaugggauggagauccggccggugaaagaaaaggaggaaaaucucgucaagagcauggugucugcuggauccggcgagguugacagcuucucccuggggcugcucuguauuucuaucaugauugaagaggugaugagaagccgcuggucccggaaaaugcugaugacaggaacccuugccgucuuuuuccugcucaucaugggccagcugacauggaacgaucugauuagacuuugcaucauggugggcgccaaugcuuuugaccgcauggggaugggaaccaccuaccuggcccucauggcgacauucaagaugagaccuauguuugcuguuggccuccuguuccggcgccugacgucuagagaggugcuucugcucaccaucgggcugagccuggucgccuccguggaacuucccaacucucuggaggaacucggagauggccuggccauggggauuaugauccucaaacugcuuacagacuuucaaagccaucagcugugggcuacccuccugucccugacauucauuaagaccacguuuagccuucacuaugccuggaaaacaauggcuauggugcugucuaucgucucccucuucccccugugucucagcaccaccucucagaagacaaccuggcugccuguucuucugggaucccugggcugcaagccgcucacaauguuucugauugccgagaauaaaaucuggggccggaaguccuggccccuuaacgaagggaucauggcggugggaauugugucuauccugcucuccagccugcucaaaaacgaugucccucuggccggcccccuuauugcugggggaaugcugaucgccuguuacgugauuuccggcagcucugcugaccugagccucgagaaggccgccgagguuuccugggaagaggaagcugagcauucuggggcgagccacaauauccugguggaaguccaggaugacggaacgaugaaaaucaaggaugaggagcgcgacgauacccuuacaauucugcucaaagccacccugcucgcuguguccggcguuuauccucugucuauccccgccacacuuuucgugugguacuucuggcaaaagaagaaacagagaagcggcguccugugggacaccccuagcccucccguggucgaacgggccgugcuggaugacgggauuuaucgcaucaugcagagaggacuccugggccggucucagguuggggugggagucuuucaagagaacguguuccauacgauguggcacguuacccgcggcgcugugcuuauguaccaggggaagagacuggaacccagcugggccuccgucaaaaaggaccucauuagcuacggaggcggcuggcggcugagagggucuuggaauacaggagaggagguccaggugaucgcgguugaacccggcaaaaacccuaagaauguccagaccgcucccgggacauuuaagaccccggagggagaagugggcgccauugcccucgauuucaaaccugggacauccggaagccccaucgugaaccgcgagggcaagaucgucggccuguaugggaauggagugguuacgaccucuggcacauacguguccgcuauugcccaagcgaaagcuagccaggaagggccucuucccgagaucgaggacgaagucuuucggaagagaaaccugaccauuauggaucugcaccccggauccggcaaaacccgccgguaucucccugccaucgugagagaggccauuaagcgcaagcugcggacacuuauccuggcuccgacgagaguuguggccucugaaauggcugaggcccucaaagggaugcccauccgcuaccagaccacagcggucaagagcgaacauaccggcaaagagauuguggaccugaugugccacgccacauucaccaugcggcugcucuccccuguuagagugcccaauuauaacaugaucauuauggaugaggcucauuuuacggacccuagcucuaucgccgcucggggauacauuuccacacgcgucggcaugggggaagccgccgcuaucuucaugaccgcgacacccccuggaagcguggaggccuuuccgcaaucuaaugcugugauccaggaugaagagagagacauucccgaacggagcuggaacuccggccacgaguggaucacagauuucccugggaagaccgucugguuuguucccucuauuaaaagcggaaaugacaucgccaacugucuucgcaagaauggcaagagagugauucagcugucccggaaaacauucgauaccgaguaucagaagacgaaaaacaacgacugggacuacguggucacaaccgauaucucugaaaugggggccaauuucagagcugaccgcgugauugauccucggagaugccugaagcccguuauccucaaagacggcccggagcgcgugauccuggccggaccuaugcccgucacaguggcgagcgcugcccaacggagaggccgcauugggcggaaccauaauaaggaaggagaucaguacaucuauaugggccagccccuuaacaaugacgaggaucacgcccacuggaccgaggcuaagaugcugcucgacaacauuaauacgccugaagggaucauucccgcccuguuugagccugaaagagagaaauccgcggccguugauggagaauaccgccugagaggcgaggcucggaagaccuucguggagcucaugcgcagaggggaccuuccggucuggcugagcuauaaaguggccucugaaggcuuucaguacuccgaucggcgcuggugcuucgacggagagagaaacaaucaaguccuggaagagaacauggauguggaaaucuggacaaaggagggcgagcggaaaaagcucagaccccgcuggcuggacgcucggaccuauagcgacccucuugcccugagagaauuuaaagaguucgcugccgggcgccgguccguuucuggagaucucauccuggaaauuggcaagcugccccagcaucucacacagagagcgcagaaugcccuugacaaccuggugaugcugcacaauagcgagcaagggggacgggcuuaccgccaugccauggaggaacucccugauaccaucgagacacugaugcuucuggcucucauugccgugcugaccggcggcgucacgcuguuuuuccucuccgggagaggacuuggcaagacaucuaucgggcugcuguguguuauggccagcuccgugcuccuguggauggcuagcguggaaccccacuggauugcggccucuaucauccuugaguuuuuccugaugguccuccugauuccggaaccugaccggcagcgcacaccccaggauaaccagcuggcuuaugugguuaucggacuccuuuuuaugauucugaccguggccgccaaugagaugggccugcucgagacaaccaaaaaggaccuggggaucggacacgucgcuguggaaaaccaucaccaugccgcgaugcuugaugucgaccugcacccugccuccgcuuggacacucuacgccguggcuacgaccauuaucacacccaugaugagacauaccauugagaacacaaccgccaauaucagccugacggcgaucgccaaccaagcugccauucugaugggccucgauaaaggcuggccuaucucuaagauggacauugggguuccccuucuggcucugggaugcuacucccaggugaauccgcucacccugacagccgcuguccuuaugcugguggcccacuaugcgaucauuggcccugggcuccaggccaaagcuacccgggaagcccaaaagcgcacagcugccggaaucaugaagaaccccaccguugauggcaucguggccauugaccuggaucccgucguguacgacgcgaaauucgagaagcagcuggggcagaucaugcuccuuauucuguguacgagccagauccugcucaugagaacaaccugggcucugugcgaaucuauuacacuugccaccggaccucugaccacacucugggagggcagcccgggcaaauuuuggaauacgaccaucgcuguguccauggccaacaucuuccgggggucuuaucuggccggagcuggccuggccuucagccucaugaagucccuugggggaggccgcagagggacaggagcgcaaggcgagacccugggcgaaaaauggaagcggcagcugaaucagcucagcaaguccgaguuuaacacauacaaaagaucugggauuauggaaguugaccgcagcgaggccaaggaaggacugaaacggggcgagaccacgaagcacgcugucuccagagggacagccaaacuucgcugguucguggagcggaaucuggugaagcccgaaggaaaggucaucgaucucggcugugggagaggaggcuggucuuauuacugcgcuggccugaaaaagguuaccgaggugaaaggguauaccaagggaggcccugggcaugaggaacccauuccuauggccacauacggauggaaccuggugaaacuccacagcggcaaggacgucuuuuucauucccccugaaaaaugugauacccuucugugcgacaucggggaguccucuccgaaucccacaaucgaggaaggacgcacgcugcgggugcucaagaugguugagccuuggcugagaggcaaccaguuuuguauuaagauccuuaaucccuacaugccuagcguggucgaaacccuggagcaaaugcagcgcaaacauggcgggaugcucgugcggaacccccuguccagaaauagcacacacgagauguauuggguuucuugcggaaccggcaacaucguguccgcggucaauaugacaagccgcaugcugcucaaccgguucaccauggcccacagaaagccgacguacgaacgcgauguggaccuggggaccggaacaagacauguggcugucgagccugaaguugccaaccuugauauuaucggccagcggauugagaauaucaaacacgaacauaagucuaccuggcacuaugacgaggauaaccccuacaaaacaugggcuuaucauggguccuacgaggugaagcccagcggaucugccuccagcauggugaauggcgucgugaagcugcucaccaaaccuugggacguuauucccauggugacacagaucgcuaugaccgauacgacaccuuuuggccaacagcgcgucuucaaggaaaaaguggacaccagaaccccgaaggccaaacgggggacagcgcagaucauggagguuacggccagauggcuguggggauuucuuucccggaacaagaagccccgcauuuguaccagagaagaguucacacggaaagugcgcagcaaugcugccaucggcgcugucuuuguggacgaaaaccaauggaacucugccaaggaggccguugaggaugaaagauucugggaccuggugcaccgggagcgcgaacuccacaaacaggggaagugcgcgaccugcgucuauaacaugaugggaaaaagagagaagaagcugggcgaauuugggaaagcuaagggcagccgggccauuugguacauguggcugggagcccgcuuccucgaguucgaggcucugggcuuuaugaaugaagaucauugguucuccagagagaacucucuuagcgggguggaaggagagggccugcacaaacucggguacauccugcgggacauuuccaagaucccuggaggcaauauguaugccgaugacacagcugggugggauacccgcaucacagaggacgaucuucagaacgaagccaaaauuaccgacaucauggagcccgaacaugcgcugcucgccaaggcuauuuuuaaacugacguaccagaauaaggucgugagaguucaacggccugccaagaacggcaccgugauggaugucaucucucgcagagaccagcggggaagcggccagguggggacauauggacugaauaccuucacaaacauggaggcucagcucauuagacaaauggaauccgagggcaucuuuucucccagcgagcuggaaaccccgaaccuugccgagcgcgcgcuggauuggcucgaaaaauacgggguggagcggcugaagagaauggccaucuccggagacgacuguguugugaaaccuauugaugaccgcuucgcuacggcccuuacagcucugaaugauaugggcaagguccggaaagacaucccccagugggaaccuagcaagggguggaacgauuggcaacaggugcccuuuugcucucaccacuuccaucaacucauuaugaaggacggcagagagaucguugugccuugucgcaaucaggaugagcuggucggacgggccagagugucccagggcgcuggguggagccugcgcgaaaccgccugccucggaaaaucuuaugcgcagauguggcaacugauguacuuucaccggagagaccuucgccuggccgcuaacgccauuuguuccgccguccccguggauuggguuccgacaagccggaccacgugguccauccaugcucaccaucaguggaugaccacagaggacaugcucucuguguggaauagagucuggauugaagagaacccuuggauggaagauaagacccacaucagcuccugggaggacgugcccuaucugggcaaacgggaggaccaguggugcgggagccuuaucggacugacagccagagcgaccugggcuacaaauauucaaguugccaucaaccaggugcgccggcucauuggcaaugaaaacuaccuggauuacaugaccucuaugaagagauucaaaaaugaguccgaccccgaaggggcccugugguga

SEQ ID NO: 18959 - RNA, 9879 nt, Artificial Sequence
  derived and/or modified CDS sequence (opt5) from DENV-1__FJ410256__SS-prME
agcgugaccaugcugcugaugcugaugcccaccgcccuugcuuuccaccugacgaccagaggaggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaagcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagaagguugaaacaugggcucuccggcaccccggcuuuaccgugaucgcccuguuccuugcgcaugccauugggacaucuaucacccagaagggaaucauuuuuauccugcucaugcuggucaccccuagcauggcuaugcgcugcgugggcauuggguccagagauuucguugagggacuuagcggcgccacauggguggacgucgugcuggagcacgggucuugugugacgaccauggcuaaagauaagcccacacucgacaucgaacugcugaaaaccgaggucacaaacccugccguucuccggaagcugugcauugaagcgaaaaucuccaauaccacgacagauagccgcuguccgacccaaggagaggccacccuuguggaagaacaggacacaaacuuugugugcagacggaccuucgucgaucgcggcuggggcaauggguguggacuguuuggcaaggggucucucauuacaugcgcuaaguucaaaugcgugacgaagcuggagggaaaaaucguucaguacgaaaaccuuaaguauuccgugaucgucaccgugcacacaggcgaccagcaucaaguugggaaugagagcaccgaacacggaacaaccgccacgauuacaccccaggcuccuucuacagagauccagcugaccgacuacggcgcccucacacuggauuguucccccagaaccggccuggacuuuaacgaaauggugcuccugacgaugaaagaaaagagcuggcuuguccauaaacagugguuccuggaucucccucugcccuggacauccggggccucuaccagccaagagacauggaaucggaaggaccuucuggugaccuuuaagaccgcucacgcgaaaaagcaggaagucgugguucucggaucccaggagggcgccaugcacacagcucugacgggggccaccgaaauucaaacaagcggaaccacaaccaucuucgccggccaucugaaaugccgccucaagauggauaaacugacgcuuaaggggaugucuuaugugauguguacaggcuccuucaagcuggagaaagaagucgcugagacccagcacggaaccgugcucguucagauuaaguacgagggcacagacgccccgugcaaaaucccuuuuagcacccaggaugaaaagggggugacacaaaacggaagacugaucacggcgaaucccauugucaccgacaaagagaagccugugaacaucgaagcugagccgcccuucggcgagucuuauauugugaucggggccggagaaaaggcccugaaacuuagcugguuuaagaaaggcuccucuauugggaagauguucgaggcuacagcccggggcgcuagacgcauggccauccucggagauaccgcgugggacuuuggcagcaucgggggaguuuucacauccgucggcaaacuggugcaucagauuuuugggaccgccuacggagugcuguucagcggcgucucuuggacgaugaagaucgggauuggcgugcuccugaccuggcuuggacucaauucccggagcacaucucucuccaugaccuguaucgcuguuggccuggugacacuguaccuuggggucauggugcaggccgauagcggaugcguuauuaacuggaagggcagagaacucaaauguggguccggaaucuuugugaccaaugagguccacacauggaccgaacaguauaaguuccaagcugacucuccuaaacgccugagcgccgcgauuggcaaggccugggaggagggggugugcggcauccgguccacgacaagacuggaaaacaucauguggaaacagauuucuaacgagcucaaucauauccugcuugaaaacgacaugaaguuuaccguuguggucggagauguggcuggcauucuggcccaggggaaaaagaugauccgcccgcagcccauggaguacaaguauagcuggaaauccuggggaaaggcuaaaauuaucggcgccgacgugcaaaauaccacauucaucauugaugggccuaacacccccgaauguccugacgaucagcgggccuggaauaucugggaggucgaggacuacggauuuggcauuuucacgacaaacaucuggcucaagcugagagauagcuauacccagguuugcgaccaccgccugaugucugcugcgauuaaagauuccaaggccgugcacgcugacaugggcuacuggaucgaaagcgagaagaaugaaacauggaaacuugcccgggccucuuucaucgaggugaagaccuguauuuggcccaaaucccauacacucuggagcaacgggguccuggaaucugagaugaucauuccgaagaucuauggaggcccuauuagccagcacaauuacagacccggguacuuuacccaaacggcuggaccuuggcaucugggcaaacucgagcuggauuucgaccuuugcgaagggaccacagugguuguggaugagcacugcggaaaccgcggccccucccugcggaccacaaccgucacgggcaagaucauccacgaaugguguugcagaagcuguacacucccuccccugcgguuuaagggggaggacggaugcugguauggcauggagauucgcccggugaaagaaaaggaggaaaaucugguuaaaucuaugguguccgccgggagcggagaggucgacuccuucucucuuggccuccuguguaucagcauuaugaucgaagaggugaugagaucccgguggucuagaaagaugcugaugaccgggacacucgcggucuuuuuccugcuuauuaugggacagcugaccuggaacgaucucauccgccugugcauuauggugggcgcuaaugccagcgaccggaugggcauggggaccacauaccuggcccuuauggcuacguuuaaaaugagaccuauguucgccgucggacugcucuuucgcagacugaccucccgggaggugcuccugcuuacaaucggccugucucucguggcgagcgucgaacugcccaacucccuggaggaacuuggggauggacuggcuaugggcaucaugauucucaagcugcucaccgacuuccagagccaucaacugugggccacacuucugucucucaccuuuaucaagacgacauucucccugcacuaugccuggaaaaccauggcuaugguucugagcauugugucucuuuuuccccugugucucuccaccacaagccagaagaccacauggcugccugugcuccuggggucucuuggaugcaaaccgcugacgauguuccugaucgccgagaauaagauuuggggccgcaaauccuggccccucaacgaaggcaucauggcugucgggaucgugagcauucugcuuuccagccugcucaagaacgauguuccucuggccggaccccucaucgcgggcgggaugcugauugccuguuacgugaucucuggaagcuccgcugaccuuucucuggagaaagccgcugaggucagcugggaagaggaagccgagcauuccggcgccucucacaauauucugguggaaguucaggaugacgggaccaugaagaucaaggaugaggagagagacgauacacucaccauccugcuuaaagcuacacugcucgcggugagcggagucuauccucuguccauucccgccacccucuucgugugguacuuuuggcagaagaaaaagcaacggucuggcguccugugggacacgccuagcccucccgaaguggagcgcgcuguucuugaugacggcaucuauagaauuaugcagcgggggcugcugggacgcucccaggugggcgucgggguguuccaggaaaacguuuuucauaccauguggcacgugacaagaggagccguccucauguaccaaggcaaacggcuggagcccagcugggccucugugaagaaggaccuuaucuccuacgggggaggcuggcgccugcagggcagcuggaauaccggggaggaagugcagguuauugcugucgagcccggcaaaaauccuaagaaugugcagacagcccccggcaccuucaaaacaucugaaggggaggugggagcgaucgcucucgauuuuaagccgggcacguccgggagcccuauugucaacagagaaggaaaaaucgugggccuguauggcaaugggguugugaccacauccggaaccuacgucucugccaucgcccaagcuaaggccagccaggagggcccccucccugagauugaagacgagguguuccggaagagaaaccugaccaucauggaucuucaccccggguccggaaaaacacgccgguaucugcccgcgauuguuagagaagcuaucaagcgcaaacugcggacgcucauucuggccccuaccagaguggucgccagcgagauggcugaagcccuuaagggcaugccgauccgcuaccagacaaccgcugugaaaucugagcauacagggaaggagaucguugaccugaugugccacgccaccuuuacgaugcggcuccugucccccgugagagucccuaauuauaacaugauuaucauggaugaagcgcauuucacagaccccagcucuauugccgcucgcggcuacaucagcacccgggugggaaugggcgaggccgcugccauuuuuaugaccgccacaccucccggguccguggaggcuuucccucaaucuaaugcggucauccaggaugaggaaagagacaucccggagcggagcuggaacuccggauaugaguggauuaccgauuuucccggcaagacaguuugguucgugccuucuaucaaaagcgggaaugacauugccaacugucugcgcaagaauggaaaaagagugauccagcucucccggaagaccuucgauacggaauaccagaaaacaaagaacaacgacugggacuacgucgugaccacagauauuagcgagaugggcgcuaauuuucgcgccgacagaguuaucgauccccggagaugccuuaagccugugauucugaaagacgggcccgaacgcgucauccuggccggcccgaugccugugaccguugcuucugccgcgcaacggagaggacgcaucggccggaaccacaauaaggagggggaucaguauauuuacaugggacagccccucaacaaugacgaggaucaugcucacuggacggaagccaaaaugcugcuugacaacaucaauacccccgagggcauuaucccugcccuguucgaacccgagagagaaaaguccgcugccauugauggggaguaucgccuccggggagaggcgagaaaaacauuuguggaacugaugcgcagaggcgaccugccugucuggcucagcuacaagguggccuccgagggguuccaguauucugaucggcgcuggugcuuugacggcgaaagaaacaaucaaguccuugaggaaaacauggauguggagaucuggaccaaagagggagaacggaagaagcugcgcccgagauggcuggacgcucggacauacagcgacccccucgcccugagagaguucaaagaauuugcugccggccgccgguccguuucuggggaucuuauccuggagauuggaaagcucccucagcaccugacccagagagcucagaaugcccuggacaaccucgugaugcuucauaauagcgaacaaggcgggcgcgcguaucggcacgccauggaggagcugcccgauacaaucgaaacccugaugcuccuggcucuuauugccgugcugacgggaggcgucacacucuucuuucuguccggcagagggcugggaaaaaccagcaucggccuccuuuguguuguggcuucuuccgugcugcuguggauggccagcgucgagccucauuggauugccgcuucuaucauccucgaguucuuucugauggugcuucugauucccgagccggaccggcagcgcaccccucaggauaaccagcucgcguacguugugaucgggcugcuguucaugauucucacagucgccgcuaaugagaugggacuucuggaaaccacaaagaaagaccugggcaucgggcacguggccgccgagaaccaccaucacgcugccaugcucgaugucgaccugcaucccgcguccgccuggacgcuuuacgcuguggccaccacaauuaucaccccuaugaugagacacacaauugaaaacaccacggcuaauaucagccugaccgccaucgcgaaccaagccgcuauucucaugggacuggauaagggcuggcccaucucuaagauggacauuggcguuccucugcucgcccuugggugcuauagccaggugaauccccugacacugaccgcugccguccucaugcugguggcucauuacgccaucauuggaccgggccuucaggcgaaagccacacgggaggcucaaaagcgcaccgccgcugggaucaugaaaaacccuacgguugauggaaucguggccauugaccuggaucccgucguguaugacgccaaguuugaaaaacagcucggccagaucaugcugcugauucucuguacaucccagauccuucugaugagaaccacaugggcgcugugcgagucuauuacccucgcuaccgggccccugacaacgcuuugggagggaagcccuggcaaguucuggaauaccacaaucgccguguccauggcuaacaucuuccggggcagcuaccuggccggggccggacucgcuuuuucccugaugaagucucugggcgggggacgcagaggcaccggggcccaaggagaaacacucggcgagaaauggaagcggcagcuuaaucagcugagcaaauccgaguucaacaccuauaagcgcucuggcauuauggagguugacagaagcgaagcgaaagaggggcugaagcggggagagacgacaaagcacgccgucuccagaggcaccgcuaaacuccgcugguuuguggaacggaaucuggugaagccggaggggaaagucaucgaucuuggauguggcagagggggauggucuuacuauugcgccggccugaagaaaguuaccgaagugaagggcuacacaaaagggggacccggccacgaggaaccuauucccauggcuaccuacggguggaaccucgugaagcugcauagcggaaaggacgucuucuuuaucccucccgagaaaugugauacacugcucugcgacauuggcgaguccagcccuaauccgacgaucgaagaggggcgcacccuucgggugcugaagaugguugaacccuggcugagaggaaaccaguucuguauuaaaauccucaauccuuauaugcccucuguggucgagacacuggagcaaaugcagcgcaagcacggcggcaugcuugugcggaacccucuguccagaaauagcacccaugaaauguacuggguuucuugcgggacaggaaacaucguguccgccgucaauaugaccagccgcaugcuccugaaccgguuuacgauggcgcacagaaaacccaccuaugagcgcgauguggaccugggcgccgggacacggcacguggcugucgaaccggagguugccaaccucgauauuaucggacagagaauugaaaauaucaagcaugagcacaagucuaccuggcauuacgacgaggauaacccuuauaaaacaugggcuuaccacggcuccuaugaagugaagcccagcggguccgccagcucuauggugaauggagucgugaaacugcuuaccaagcccugggacguuauuccuauggugacacagaucgcuaugaccgauacgacacccuucggccaacagcgcgucuuuaaagagaagguggacaccagaaccccuaaggccaaacggggcacagcgcagaucauggaaguuacggccaaguggcuguggggguuccucagccgcaacaaaaagccgagaauuuguacccgggaggaauuuacaagaaaagugcgguccaaugcugccaucggagcugucuucguggacgagaaccaauggaacucugccaaggaggccguugaagaugagcgcuuuugggaccuggugcauagagaacgggagcuucacaagcagggcaaaugcgcgaccugcgucuacaacaugauggggaagcgcgagaaaaagcugggagaguucggcaaagcuaaggggagcagagccauuugguacauguggcucggcgcccgguuccuggaguuugaagcucugggauucaugaaugaggaucacugguuuucccgcgaaaacucucucagcggcguggagggggagggacugcauaaacuuggcuauauccugagagacauuuccaagauccccgggggaaauauguacgccgaugacacagcuggcugggauacccggaucacagaagacgaucuccagaacgaggccaagauuaccgacaucauggaaccugagcacgcgcugcuugccaaaucuauuuucaagcugacguaucagaauaaagucgugcgcguucaaagacccgcuaagaacgggaccgugauggaugucaucagccggcgcgaccagagaggcuccggacaggugggcacauacgggcucaauaccuuuacaaacauggaagcccagcugauucggcaaauggagagcgagggaaucuucucuccuuccgaacuggagacccccaaccucgcuggccgcgugcuggauuggcuugaaaaacauggggccgagagacugaagcggauggcgaucagcggagacgacuguguugugaagccgauugaugacagauuugccacggcucucacagcccugaaugauaugggcaaaguccgcaaggacaucccucagugggaacccucuaaaggguggaacgauuggcaacaggugccuuucugcucccaccacuuucaucaacuuauuaugaaggacggccgggagaucguugugcccuguagaaaucaggaugagcuggucggacgcgcucgggugagccagggcgccggguggucccucagagaaaccgcuugccugggaaaaucuuaugcccagauguggcaacugauguacuuccaccgccgggaccucagacuggcggccaacgcuauuuguagcgccgucccuguggauuggguucccacaucccgcaccacguggagcauccaugcccaccaucaguggaugaccacagaggacaugcuuucuguguggaaucgggucuggauugaagagaacccguggauggaagauaagacccacaucuccagcuggggcgacgugccuuaucuggggaagagagaggaccaguggugcggaucucucaucggccugacagcucgcgccaccugggcgacaaauauucaaguugcuaucaaccaggugcggagacuuauugggaaugagaacuaccuggauuacaugaccagcaugaaacgguuuaagaaugaauccgaccccgagggcgcccucugguga

SEQ ID NO: 18960 - RNA, 9879 nt, Artificial Sequence
  derived and/or modified CDS sequence (opt5) from DENV-1__FJ410257__SS-prME
agcgugacaaugcugcugaugcugaugcccacagcccuugcuuuccaccugacgacaagaggaggggagccucauaugaucguguccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucaccacacaagaugaaaagggggugacgcagaacggacggcugaucaccgcuaaucccauugucacagacaaagagaagccugugaacaucgaagccgagccgcccuuuggcgaguccuauauugugaucggggccggagaaaaagcucuuaagcucagcugguucaagaaaggcucuagcauugggaagauguuugaggccaccgcuagaggcgcccgccggauggcgauccugggagauacagccugggacuucggcuccaucgggggaguuuuuaccucugucggcaaacuggugcaucagauuuucgggacggcuuacggagugcucuuuagcggcgucuccuggaccaugaagaucgggauuggcgugcugcuuacauggcugggacucaauagcagaucuaccucccugagcaugacauguaucgccguuggccuggugacccuuuaccucggggucauggugcaggcugauucuggaugcguuauuaacuggaaaggccgcgaacugaaguguggguccggaaucuucgugacaaaugagguccacaccuggacggaacaauauaaguuucaggccgacagcccuaaacggcuguccgcggccauuggcaaggcuugggaggagggggugugcggcaucagaucugccacacgccucgaaaacaucauguggaaacagauuagcaacgagcugaaucauauccuucuggaaaacgacaugaagcucaccguuguggucggagauguggcuggcauucuggggcagggcaagaagaugauccggccgcaacccauggaguacaaauauuccuggaagucuuggggcaaggccaaaauuaucggggccgacgcucagaauaccacauucaucauugauggaccuaacacccccgaauguccugacgaucagagagcguggaauaucugggagguggaggacuacggcuuuggcauuuucacgacaaacaucuggcugaaacuucgcgauagcuauacccaggucugcgaccaccggcucauguccgccgcuauuaaagauagcaaggccguucacgccgacaugggguacuggaucgaaucugagaaaaaugaaacauggaagcuggcuagagccuccuuuaucgaggugaagaccuguauuuggcccaaaagccauacacuguggucuaacggagugcucgaauccgagaugaucauuccgaagaucuauggcgggccuauuagccaacacaauuaccgccccggauacuucacccagacggcgggcccuuggcaucuggggaaacuugagcuggauuucgaccucugcgaaggaaccacagucgugguugaugagcacugcggcaaccggggccccucucugagaaccacaaccgugacggggaagaucauccacgaaugguguugccggagcuguacacugccuccccuucgcuuuagaggagaggacggcugcugguaugggauggagauucggccggucaaagaaaaggaggaaaaucucgugaaguccaugguuagcgcuggaucuggcgagguggacuccuucagccuggggcugcucuguaucuccauuaugaucgaagaggucaugagaucucgcuggagccggaaaaugcugaugaccggaacacuugccguguuuuuccugcucauuaugggccagcugaccuggaacgaucugaucagacuuugcauuaugguuggcgccaaugcuuccgaccgcauggggaugggaaccacauaccuggcccucauggcgacguuuaagaugagaccuauguucgcugugggccugcucuuucggcgccugaccucuagagagguccuucugcucacaaucgggcugagccugguggccuccguggaacuucccaacucucuggaggaacucggagauggccuggccauggggaucaugauucucaaacugcuuaccgacuuccaaagccaucagcugugggcuacacuccugucccugaccuuuaucaagacgacauucagccuucacuaugccuggaaaaccauggcuaugguccugucuauuguuucccucuuuccccugugucucagcaccacaucucagaagaccacauggcugccugugcuucugggaucccugggcugcaagccgcucacgauguuccugaucgccgagaauaaaauuuggggccggaaguccuggccccuuaacgaagggaucauggcggugggaaucgucucuauucugcucuccagccugcucaaaaacgaugugccucuggccggcccccuuaucgcugggggaaugcugauugccuguuacguuaucuccggcagcucugcugaccugagccucgagaaggccgccgagguguccugggaagaggaagcugagcauucuggggcgagccacaauauucuggucgaagugcaggaugacggaaccaugaaaaucaaggaugaggagcgcgacgauacacuuaccauccugcucaaagccacacugcucgcuguuuccggcguguauccucugucuauucccgccacccuuuuugucugguacuucuggcaaaagaagaaacagagaagcggcgugcugugggacacgccuagcccucccgaagucgagcgggccgugcuggaugacgggaucuaucgcauuaugcagagaggacuccugggccggucucagguuggggugggagucuuccaagaaaacguguuucauaccauguggcacguuacacgcggcgcugugcuuauguaccaggggaagagacuggagcccagcugggccuccgucaaaaaggaccucaucagcuacggaggcggcuggcggcugagagggucuuggaauaccggagaggaaguccaggugauugcgguugagcccggcaaaaacccuaagaauguccagacagcucccgggaccuucaagacaccggaaggagaggugggcgccaucgcccucgauuuuaaaccugggacguccggaagccccauugugaaccgcgaaggcaagaucgucggccuguaugggaauggagugguuaccacaucuggcaccuacguguccgcuaucgcccaagcgaaagcuagccaggaggggccucuucccgagauugaagacgaggucuuccggaagagaaaccugaccaucauggaucugcaccccggauccggcaaaacacgccgguaucucccugccauugugagagaagccaucaagcgcaagcugcggacgcuuauucuggcuccgaccagaguuguggccucugagauggcugaagcccucaaagggaugcccauccgcuaccagacaaccgcggucaagagcgagcauacaggcaaagagaucguggaccugaugugccacgccaccuuuacgaugcggcugcucuccccuguuagagugcccaauuauaacaugauuaucauggaugaagcucauuucacagacccuagcucuauugccgcucggggauacaucuccacccgcgucggcaugggggaggccgccgcuauuuuuaugaccgcgacacccccuggaagcguggaagccuucccgcaaucuaaugcugugauccaggaugaggaaagagacauccccgagcggagcuggaacuccggcuaugaguggauuaccgauuuuucugggaagacagucugguucguuccuagcaucaaauccggaaaugacauugccaacugucuucgcaagaauggcaagagagugauccagcugucucggaaaaccuuugauacggaauaccagaagaccaagaacaacgacugggacuacguggucaccacagauauuagcgagaugggggccaauuucagagcugaccgcgugaucgauccccggagaugccugaagccuguuauucucaaagacggccccgaacgcgugauccuggccggaccgaugccugucaccguggcguccgcugcccaacggagaggccgcaucgggcggaacuauaauaaggagggagaucaguacauuuauaugggccagccccuuaacaaugacgaggaucacgcccauuggacggaagcuaagaugcugcucgacaacaucaauacccccgaggggauuaucccugcccuguucgaacccgagagagagaaaagcgcggccguugauggagaguaccgccugagaggcgaggcucggaagacauuuguggaacucaugcgcagaggggaccuuccugucuggcugucuuauaaaguggccuccgagggcuuccaguacagcgaucggcgcuggugcuuugacggagaaagaaacaaucaaguccuggaggaaaacauggauguggagauuuggaccaaggagggcgaccggaaaaagcucagaccgcgcuggcuggacgcucggacauauuccgauccccuugcccugagagaacucaaagaguucgcugccgggcgccggucuguuagcggagaccugauccuggaaaucggcaagcucccucagcaccuuacccagagagcgcagaaugcccuggauaaccuggugaugcuccacaauuccgagcaagggggacgggcuuaccgccaugccauggaggaacugcccgacacaauugagacccuuaugcugcucgcucugaucgccgugcugacgggcggcgucacacucuuuuuccuuucugggagaggacugggcaagaccagcauugggcugcucuguguuauggccuccagcgugcugcuuuggauggcuucuguggaaccucacuggaucgcggccuccauuauccuggaguuuuuccucaugguccugcugauccccgaaccggaucggcagcgcaccccucaggacaaccagcucgcuuacgugguuauuggacuucuguuuaugauccugacaguggccgccaaugagaugggccuccuggagaccaccaaaaaggaucuugggauuggacaugucgcuguggaaaaccaccaccaugccgcgaugcuggacgucgaucuccaccccgccagcgcuuggacgcuguaugccguggcuaccacaaucauuaccccuaugaugagacauacaaucgagaacaccacggccaauauuucucugaccgcgaucgccaaccaagcugccauccucaugggccuugacaaaggcuggcccauuuccaagauggauaucgggguuccucugcuggcucucggaugcuacagccaggugaauccccugacacuuaccgccgcuguccugaugcucguggcccacuaugcgauuaucggcccggggcugcaggccaaagcuacacgggaagcccaaaagcgcaccgcugccggaauuaugaagaacccuacgguugacggcaucguggccaucgaucuggaccccgucguguacgacgcgaaauucgagaagcagcucgggcagauuaugcuucugauccuguguacaucucagauucuccugaugagaaccacaugggcucuuugcgaaagcaucacccuggccaccggaccccucacaacgcugugggagggcuccccuggcaaauuuuggaauaccacaauugcugugucuauggccaacaucuuccgggggagcuaucuggccggagcuggccucgccuuuucccuuaugaaaagccucgggggaggccgcagagggaccggagcgcaaggcgagacacugggcgaaaaauggaagcggcagcucaaucagcuguccaagucugaguucaacaccuacaaaagaagcgggaucauggaaguugaucgcuccgaggccaaggaaggacuuaaacggggcgagacgacaaagcaugcugucucuagagggaccgccaaacugcgcugguucguggagcggaaucucgugaagccggaaggaaaggucauugaccugggcugugggagaggaggcuggagcuauuacugcgcuggccugaaaaagguuaccgaggugaaaggguacacaaagggaggccccgggcacgaggaaccuauccccauggccaccuauggauggaaccucgugaaacuucacuccggcaaggaugucuuuuucauuccucccgaaaaaugugacacacugcugugcgauaucggggagucuagcccuaauccgacgauugaggaaggacgcacccuccgggugcugaagaugguugagcccuggcuuagaggcaaccaguuuuguaucaagauucugaauccuuacaugcccuccguggucgaaacacucgagcaaaugcagcgcaaacauggcgggaugcuggugcggaacccucugagcagaaauucuacccacgagauguauuggguuuccugcggaacaggcaacaucgugagcgcggucaauaugaccucucgcaugcuccugaaccgguucacgauggcccauagaaagcccaccuacgaacgcgacguggaucuugggacaggaaccagacacguggcugucgagccggaaguugccaaccuggacaucauuggccagcggaucgagaauauuaaacacgaacauaaguccacauggcacuaugaugaggacaacccuuacaaaaccugggcuuaucaugggagcuacgaggugaagcccucuggauccgccagcuccauggugaauggcgucgugaagcuccugacaaaacccugggauguuaucccuauggugacccagauugcuaugacggacacaacccccuuuggccaacagcgcgucuucaaggaaaaaguggacaccagaacaccuaaggccaaacgggggacggcgcagaucauggagguuaccgccagauggcuuuggggauuucugagccggaacaagaagccgcgcaucuguacaagagaagaguucacccggaaagugcgcucuaaugcugccauuggcgcugucuuuguggaugaaaaccaauggaauagcgccaaggaggccguugaggacgaaagauucugggaucucgugcaccgggagcgcgaacugcauaaacaggggaagugcgcgacaugcgucuacaacaugaugggaaaaagagagaagaagcugggcgaauuugggaaagcuaagggcucccgggccaucugguauauguggcucggagcccgcuuccuggaguuugaggcucuuggcuucaugaaugaagaccacugguucucuagagagaacagccuguccgggguggaaggagagggccuccacaaacugggguacauucuucgggauaucucuaagauucccggaggcaauauguaugccgacgauaccgcugggugggacacacgcaucaccgaggaugaccugcagaacgaagccaaaaucacggauauuauggagccugaacaugcgcuccuggccaaggcuaucuuuaaacugaccuaccagaauaaggucgugagaguucaacggcccgccaagaacggcacagugauggacgucauuagccgcagagaucagcggggauccggccagguggggaccuauggacucaauacauucaccaacauggaggcucagcugaucagacaaauggaaucugagggcauuuuuagcccuuccgagcuugaaacgcccaaccuggccgagcgcgcgcucgacuggcuggaaaaauacgggguggagcggcuuaagagaauggccaucagcggagacgauuguguugugaaaccgaucgacgaucgcuucgcuacagcccugaccgcucucaaugacaugggcaagguccggaaagauauuccucagugggaacccucuaagggguggaacgacuggcaacaggugccuuuuugcucccaccauuuccaccaacugaucaugaaggauggcagagagauuguugugcccugucgcaaucaggacgagcuggucggacgggccagagugagccagggcgcuggguggucucuccgcgaaacagccugccugggaaaauccuaugcgcagauguggcaacuuauguacuuucaccggagagaucugcgccucgccgcuaacgccaucuguagcgccgucccuguggacuggguucccaccucccggacgaccuggucuauucaugcucaccaucaguggaugacaaccgaggauaugcugagcguguggaauagagucuggaucgaagagaacccguggauggaagacaagacacacauuuccagcugggaggacgugccuuaccuuggcaaacgggaggaucaguggugcgggucucugaucggacucaccgccagagcgacaugggcuaccaauauccaaguugccauuaaccaggugcgccggcugaucggcaaugaaaacuaucuggacuacaugacguccaugaagagauucaaaaaugagagcgaucccgaaggggcccucugguga

SEQ ID NO: 18961 - RNA, 9879 nt, Artificial Sequence
  derived and/or modified CDS sequence (opt5) from DENV-1__FJ461332__SS-prME
agcgugaccaugcugcucaugcugaugcccaccgcccuugcuuuccaccugacgaccagaggaggggagccucauaugaucguguccaagcaggaacggggaaaaucucuccuguuuaagaccagcgccggcguuaauaugugcacccuuauugccauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaggaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacugauucaucagaucuucgggaccgcuuacggagugcucuuuuccggcgugagcuggacgaugaagauugggaucggcguccugcuuaccuggcugggacucaauucuagauccacaagccugucuaugaccuguauugccgugggccugguuacacuuuaccucggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcugucugcggccaucggcaaggcuugggaggagggggucugcggcaucagaagcgccacgcgccucgaaaacauuauguggaaacagaucuccaacgagcugaaucauauucuucuggaaaacgacaugaagcucacagugguugugggagaugucgcuggcauccuggggcagggcaagaagaugauucggccgcaacccauggaguacaaauauucuuggaaaagcuggggcaaggccaagaucaucggggccgacgcucagaauaccaccuucauuaucgauggaccuaacacacccgaauguccugacgaucagagagcguggaauauuugggagguggaggacuacggcuuuggcaucuucaccacgaacauuuggcugaaacuucgcgauuccuauacacaggugugcgaccaccggcucaugagcgccgcuaucaaagauucuaaggccguccacgccgacaugggguacuggaucgaauccgagaaaaaugaaaccuggaagcuggcuagagccagcuuuauugagguuaagacauguaucuggcccaaaucucauacccugugguccaacggagugcucgaaagcgagaugauuaucccgaagauuuauggcgggccuaucucucaacacaauuaccgccccggauacuucacacagaccgcgggcccuuggcaucuggggaaacuugagcuggauuucgaccucugcgaaggaacgaccguggucguggaugagcacugcggcaaccggggccccagccugagaacaaccacaguuaccgggaagaucauucacgaaugguguugccgguccuguacgcugccuccccuucgcuuuagaggagaggacggcugcugguaugggauggagauccggccggugaaagaaaaggaggaaaaucucgucaagagcauggugucugcuggauccggcgagguugacagcuucucccuggggcugcucuguauuucuaucaugauugaagaggugaugagaagccgcuggucccggaaaaugcugaugacaggaacccuugccgucuuuuuccugcucaucaugggccagcugacauggaacgaucugauuagacuuugcaucauggugggcgccaaugcuuuugaccgcauggggaugggaaccaccuaccuggcccucauggcgacauucaagaugagaccuauguuugcuguuggccuccuguuccggcgccugacgucuagagaggugcuucugcucaccaucgggcugagccuggucgccuccguggaacuucccaacucucuggaggaacucggagauggccuggccauggggauuaugauccucaaacugcuuacagacuuucaaagccaucagcugugggcuacccuccugucccugacauucauuaagaccacguuuagccuucacuaugccuggaaaacaauggcuauggugcugucuaucgucucccucuucccccugugucucagcaccaccucucagaagacaaccuggcugccuguucuucugggaucccugggcugcaagccgcucacaauguuucugauugccgagaauaaaaucuggggccggaaguccuggccccuuaacgaagggaucauggcggugggaauugugucuauccugcucuccagccugcucaaaaacgaugucccucuggccggcccccuuauugcugggggaaugcugaucgccuguuacgugauuuccggcagcucugcugaccugagccucgagaaggccgccgagguuuccugggaagaggaagcugagcauucuggggcgagccacaauauccugguggaaguccaggaugacggaacgaugaaaaucaaggaugaggagcgcgacgauacccuuacaauucugcucaaagccacccugcucgcuguguccggcguuuauccucugucuauccccgccacacuuuucgugugguacuucuggcaaaagaagaaacagagaagcggcguccugugggacaccccuagcccucccguggucgaacgggccgugcuggaugacgggauuuaucgcaucaugcagagaggacuccugggccggucucagguuggggugggagucuuucaagagaacguguuccauacgauguggcacguuacccgcggcgcugugcuuauguaccaggggaagagacuggaacccagcugggccuccgucaaaaaggaccucauuagcuacggaggcggcuggcggcugagagggucuuggaauacaggagaggagguccaggugaucgcgguugaacccggcaaaaacccuaagaauguccagaccgcucccgggacauuuaagaccccggagggagaagugggcgccauugcccucgauuucaaaccugggacauccggaagccccaucgugaaccgcgagggcaagaucgucggccuguaugggaauggagugguuacgaccucuggcacauacguguccgcuauugcccaagcgaaagcuagccaggaagggccucuucccgagaucgaggacgaagucuuucggaagagaaaccugaccauuauggaucugcaccccggauccggcaaaacccgccgguaucucccugccaucgugagagaggccauuaagcgcaagcugcggacacuuauccuggcuccgacgagaguuguggccucugaaauggcugaggcccucaaagggaugcccauccgcuaccagaccacagcggucaagagcgaacauaccggcaaagagauuguggaccugaugugccacgccacauucaccaugcggcugcucuccccuguuagagugcccaauuauaacaugaucauuauggaugaggcucauuuuacggacccuagcucuaucgccgcucggggauacauuuccacacgcgucggcaugggggaagccgccgcuaucuucaugaccgcgacacccccuggaagcguggaggccuuuccgcaaucuaaugcugugauccaggaugaagagagagacauucccgaacggagcuggaacuccggccacgaguggaucacagauuucccugggaagaccgucugguuuguucccucuauuaaaagcggaaaugacaucgccaacugucuucgcaagaauggcaagagagugauucagcugucccggaaaacauucgauaccgaguaucagaagacgaaaaacaacgacugggacuacguggucacaaccgauaucucugaaaugggggccaauuucagagcugaccgcgugauugauccucggagaugccugaagcccguuauccucaaagacggcccggagcgcgugauccuggccggaccuaugcccgucacaguggcgagcgcugcccaacggagaggccgcauugggcggaaccauaauaaggaaggagaucaguacaucuauaugggccagccccuuaacaaugacgaggaucacgcccacuggaccgaggcuaagaugcugcucgacaacauuaauacgccugaagggaucauucccgcccuguuugagccugaaagagagaaauccgcggccguugauggagaauaccgccugagaggcgaggcucggaagaccuucguggagcucaugcgcagaggggaccuuccggucuggcugagcuauaaaguggccucugaaggcuuucaguacuccgaucggcgcuggugcuucgacggagagagaaacaaucaaguccuggaagagaacauggauguggaaaucuggacaaaggagggcgagcggaaaaagcucagaccccgcuggcuggacgcucggaccuauagcgacccucuugcccugagagaauuuaaagaguucgcugccgggcgccgguccguuucuggagaucucauccuggaaauuggcaagcugccccagcaucucacacagagagcgcagaaugcccuugacaaccuggugaugcugcacaauagcgagcaagggggacgggcuuaccgccaugccauggaggaacucccugauaccaucgagacacugaugcuucuggcucucauugccgugcugaccggcggcgucacgcuguuuuuccucuccgggagaggacuuggcaagacaucuaucgggcugcuguguguuauggccagcuccgugcuccuguggauggcuagcguggaaccccacuggauugcggccucuaucauccuugaguuuuuccugaugguccuccugauuccggaaccugaccggcagcgcacaccccaggauaaccagcuggcuuaugugguuaucggacuccuuuuuaugauucugaccguggccgccaaugagaugggccugcucgagacaaccaaaaaggaccuggggaucggacacgucgcuguggaaaaccaucaccaugccgcgaugcuugaugucgaccugcacccugccuccgcuuggacacucuacgccguggcuacgaccauuaucacacccaugaugagacauaccauugagaacacaaccgccaauaucagccugacggcgaucgccaaccaagcugccauucugaugggccucgauaaaggcuggccuaucucuaagauggacauugggguuccccuucuggcucugggaugcuacucccaggugaauccgcucacccugacagccgcuguccuuaugcugguggcccacuaugcgaucauuggcccugggcuccaggccaaagcuacccgggaagcccaaaagcgcacagcugccggaaucaugaagaaccccaccguugauggcaucguggccauugaccuggaucccgucguguacgacgugaaauucgagaagcagcuggggcagaucaugcuccuuauucuguguacgagccagauccugcucaugagaacaaccugggcgcugugcgaaucuauuacacuugcuaccggaccucugaccacacucugggagggcagcccgggcaaauuuuggaauacgaccaucgccguuuccauggcuaacaucuuccgggggucuuaucuggccggagccggccuggcuuucagccucaugaagucccuugggggaggccgcagagggacaggagcccaaggcgagacccugggcgaaaaauggaagcggcagcugaaucagcucagcaaguccgaguuuaacacauacaaaagaucugggauuauggaagucgaccgcagcgaggcgaaggaaggacugaaacggggcgagaccacgaagcacgccguguccagagggacagcuaaacuucgcugguucguggagcggaaucuggucaagcccgaaggaaagguuaucgaucucggcugugggagaggaggcuggucuuauuacugcgccggccugaaaaaggugaccgaggugaaaggguauaccaagggaggcccugggcaugaggaacccauuccuauggcuacauacggauggaaccuggucaaacuccacagcggcaaggacguguuuuucauucccccugaaaaaugugauacccuucugugcgacaucggggaguccucuccgaaucccacaaucgaggaaggacgcacgcugcggguucucaagaugguggagccuuggcugagaggcaaccaguuuuguauuaagauccuuaaucccuacaugccuagcgucguggaaacccuggagcaaaugcagcgcaaacauggcgggaugcucguucggaacccccuguccagaaauagcacacacgagauguauugggugucuugcggaaccggcaacaucgucuccgccgugaauaugacaagccgcaugcugcucaaccgguucaccauggcgcacagaaagccgacguacgaacgcgauguggaccuggggaccggaacaagacaugucgccguugagccugaaguggcuaaccuugauauuaucggccagcggauugagaauaucaaacacgaacauaagucuaccuggcacuaugacgaggauaaccccuacaaaacaugggccuaucauggguccuacgaggugaagcccagcggaucugcuuccagcauggucaauggcgugguuaagcugcucaccaaaccuugggacgugauucccauggucacacagaucgccaugaccgauacgacaccuuuuggccaacagcgcguguucaaggaaaaaguugacaccagaaccccgaaggcuaaacgggggacagcccagaucauggaggugacggcgagauggcuguggggauuucuuucccggaacaagaagccccgcauuuguaccagagaagaguucacacggaaaguccgcagcaaugccgcuaucggcgccguguuuguugacgaaaaccaauggaacucugcuaaggaggccguggaggaugaaagauucugggaccugguccaccgggagcgcgaacuccacaaacaggggaagugcgcgaccugcguguauaacaugaugggaaaaagagagaagaagcugggcgaauuugggaaagcgaagggcagccgggcuauuugguacauguggcugggagcccgcuuccucgaguucgaggcccugggcuuuaugaaugaagaucauugguucuccagagagaacucucuuagcggggucgaaggagagggccugcacaaacucggguacauccugcgggacauuuccaagaucccuggaggcaauauguaugcugaugacacagccgggugggauacccgcaucacagaggacgaucuucagaacgaagcuaaaauuaccgacaucauggagcccgaacaugcccugcucgcgaaggccauuuuuaaacugacguaccagaauaaggugguuagagugcaacggccugcuaagaacggcaccgucauggaugugaucucucgcagagaccagcggggaagcggccagguggggacauauggacugaauaccuucacaaacauggaggcccagcucauuagacaaauggaauccgagggcaucuuuucucccagcgagcuggaaaccccgaaccuugcugagcgcgcccuggauuggcucgaaaaauacgggguugagcggcugaagagaauggcgaucuccggagacgacuguguggucaaaccuauugaugaccgcuucgccacggcucuuacagcccugaaugauaugggcaaggugcggaaagacaucccccagugggaaccuagcaagggguggaacgauuggcagcagguucccuuuugcucucaccacuuccaucaacucauuaugaaggacggcagagagaucguggucccuugucgcaaucaggaugagcuggugggacgggcuagagucucccagggcgccggguggagccugcgcgaaaccgcuugccucggaaaaucuuaugcccagauguggcaacugauguacuuucaccggagagaccuucgccuggcggccaacgcuauuuguuccgccgugcccguugauugggugccgacaagccggaccacgugguccauccaugcccaccaucaguggaugaccacagaggacaugcucucugucuggaauagaguguggauugaagagaacccuuggauggaagauaagacccacaucagcuccugggaggacguucccuaucugggcaaacgggaggaccaguggugcgggagccuuaucggacugacagcuagagccaccugggcgacaaauauucaaguggcuaucaaccagguccgccggcucauuggcaaugaaaacuaccuggauuacaugaccucuaugaagagauucaaaaaugaguccgaccccgaaggggcccugugguga

SEQ ID NO: 18962 - RNA, 9879 nt, Artificial Sequence
  derived and/or modified CDS sequence (opt5) from DENV-1__FJ461333__SS-prME
agcgugaccaugcugcugaugcugaugcccacagcccuugcuuuccaccugacgaccagaggcggggagccucauauggugguuuccaagcaggaacggggaaagucucuccuguuuaagaccagcgccggcgugaacaugugcacccuuaucgcgauggaccugggggagcucugugaagauacaaugaccuacaaaugcccccgcauuacagaggcugaacccgacgauguggacuguuggugcaaugccaccgauacgugggucaccuauggaacauguucccaaaccggcgagcacagacgggacaagcgcucuguggcccuggcuccucauguugggcugggacucgagacaagaaccgaaacguggaugagcuccgagggcgccuggaaacagauccagcggguggaaacaugggcucugcgccaccccggcuucaccgucauugcccuuuuucuggcgcaugccaucgggacaucuauuacccagaagggaaucaucuucauucuccugaugcuugugaccccuagcauggcuaugagaugcguuggcaucgggucccgggauuuuguggagggacugagcggcgccacaugggucgacguggugcucgagcacgggucuugugucacgaccauggcuaaggauaaacccacacuggacauugaacugcucaagaccgagguuacaaacccugccauccugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggcugggcgugcuucugaccuggcucggacucaauucuagauccacaagccugucuaugaccuguauugccguuggccuugugacacucuaccugggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcucucugcggccaucggcaaggcuugggaggagggggugugcggcauuagaagcgccacgcgccuggaaaacguuauguggaaacagaucuccaacgagcuuaaucauauccugcucgaaaacgacaugaaguucacaguggucgugggagauguggcuggcauucuggcccaggggaaaaagaugauccggccgcaacccauggagcacaaauacucuuggaaaagcuggggaaaggccaagauuaucggcgcugacguccagaauaccaccuuuauuaucgaugggccuaacacacccgaauguccugacgaucagagagcguggaauaucugggagguugaggacuauggauucggcauuuuuaccacgaacaucuggcugaaacuucgcgauuccuacacacaggugugcgaccaccggcucaugagcgccgcuauuaaagauucuaaggccgugcaugccgacaugggcuauuggaucgaauccgagaaaaaugaaaccuggaagcuggcuagagccagcuucauugaggucaagacauguaucuggcccaaaucucacacccugugguccaacggggugcucgaaagcgagaugaucauuccgaagaucuacggaggcccuauuucucaacauaauuaucgccccggguacuucacacagaccgcgggaccuuggcaccugggcaaacuugagcuggauuuugaccucugcgaagggacgaccguuguggucgaugagcacugcggaaaccggggccccagccugagaacaaccacagugaccggcaagaucauucaugaaugguguugccgguccuguacgcugccuccccuucgcuucagaggggaggacggaugcugguacggcauggagauccggccgguuaaagaaaaggaggaaaaucucgucaagagcauggucucugcuggguccggagagguggacagcuuuucccugggccugcucuguaucucuauuaugaucgaagagguuaugagaagccgcuggucccggaaaaugcugaugacagggacccuugccguguuccugcuccugauuaugggacagcugacauggaacgaucuuaucagacugugcauuauggucggcgccaaugcuucugaccgcaugggcauggggaccaccuaucucgcccugauggcgacauuuaagaugagaccuauguucgcugugggacuccuguuucggcgccuuacgagcagagaggugcugcuccugaccaucggccugucccuugucgccucuguugaacugcccaacagccucgaggaacugggggauggacucgccaugggcauuaugauccugaaacuucugacagacuuccaaucccaccagcucugggcuacccugcugagccuuacauuuaucaagaccacguucucucugcauuacgccuggaaaacaauggcuauggugcucuccauugugagccuguuuccccucugucugucuaccaccucccagaagacaaccuggcuuccuguccugcuggggagccucggaugcaagccgcugacaauguuccuuaucgccgagaauaaaauuuggggccggcgcucuuggccccugaacgaaggcaucauggcgguggggauuguuuccauccuccugagcucccuccugaagaacgaugugccucuugccggaccccugaucgcuggcgggaugcugauugccuguuaugucaucagcggaucuagcgcugaccucucccuggagaaagccgccgaggugucuugggaagaggaagcugagcacagcggcgcgucccauaauauucuuguugaagugcaggaugacgggacgaugaagaucaaagaugaggagagagacgauacccugacaauucuccugaaggccacccuccuggcugucucuggaguguacccucuuagcauccccgccacacuguuugucugguauuucuggcagaagaagaagcagcgguccggcgugcugugggacaccccuucucccccggaaguugagcgcgccgugcucgaugacggcaucuacagaauuaugcagcgggggcugcuuggacgcagccaggucggcguggggguuuuccaagaaaacguguuucacacgauguggcacgucaccagaggagcugugcugauguaucagggcaaacggcucgagccuuccugggccagcgugaagaaagaccugaucucuuacgggggaggcuggagacuccagggcuccuggaauacaggggaggaaguucaggucauugcgguggagcccggaaagaacccuaaaaaugugcaaaccgcucccggcacauucaagaccccggaaggggaggucggagccaucgcccuggauuuuaagccuggcacaagcgggucucccauugugaaccgcgaaggaaaaaucguuggccuuuacggcaaugggguggucacgaccuccggaacauaugugagcgcuauugcccaggcgaaggcuucccaggagggcccucugcccgagaucgaagacgagguuuuccggaaaagaaaccugaccaucauggaucuccaucccgggucuggaaagacccgccgguaccugccugccauugugagagaagccaucaaacgcaaacuucggacacugauucucgcuccgacgagagucguggccagcgagauggcugaagcccugaagggcaugcccauccgcuaucaaaccacagcgguuaaauccgagcacaccgggaaggagauuguggaccugaugugccaugccacauuuaccaugcggcuccuuagcccugucagagugcccaauuacaacaugaucaucauggaugaagcucacuucacggacccuucuuccauugccgcucggggcuauaucagcacacgcgugggaaugggcgaggccgccgcuauuuuuaugaccgcgacacccccugggucugucgaagccuucccgcagagcaaugcuguuauccaggaugaggaaagagacauucccgagcgguccuggaacucuggauacgaguggaucacagauuuuccuggcaaaaccgugugguucgugcccagcaucaaguccgggaaugacauugccaacugucugcgcaaaaauggaaagagagucauccagcugucucggaagacauuugauaccgaauaucagaagacgaagaacaacgacugggacuacgugguuacaaccgauauuagcgagaugggcgccaauuucagagcugaccgcgugaucgauccucggagaugccucaaacccgucauucugaaggacgggccggaacgcgugauccuugccggcccuaugcccguuacaguggcguccgcugcccagcggagaggacgcauuggccggaaccauaauaaagagggggaucaguacaucuauaugggacagccccugaacaaugacgaggaucacgcccacuggaccgaagcuaagaugcuccuggacaacaucaauacgccugagggcauuauccccgcccuguucgaaccugagagagaaaagagcgcggccauugauggggaguaccgccucagaggagaggcucggaaaaccuuugucgaacuuaugcgcagaggcgaccugccgguguggcugucuuauaaggucgccuccgagggguuccaauacagcgaucggcgcuggugcuuugacggcgaaagaaacaaucaggugcucgaggaaaacauggauguugagaucuggacaaaagagggagaacggaagaaacugagaccccgcuggcuugacgcucggaccuauuccgacccucuggcccucagagaguucaaggaauuugcugccggccgccggucugugagcggggaucugauucuggagaucggaaaacucccccagcaucuuacacagagagcgcaaaaugcccuggacaaccuggugaugcuccacaauuccgaacagggcgggcgggcuuaccgccaugccauggaggagcugccugauaccaucgaaacacuuaugcugcucgcucugauugccguccugaccggaggcguuacgcuguucuuucuuucuggcagagggcugggaaagacaagcaucggccugcucugugugauggccuccagcgugcugcuuuggauggcuucugucgagccccacuggauugcggccuccaucauucuggaguucuuucucauggugcugcugaucccggagccugaccggcagcgcacaccccaagauaaccaacucgcuuauguugugaucgggcuucuguucaugauucugaccgucgccgccaaugagaugggacuccuggaaaccaccaagaaagaccuuggcaucgggcacgcugccgugggaaaccaucaccaugcggccaugcuggaugucgaccuccacccugcuagcgccuggacacuguacgcuguggccacgaccauuaucacacccaugaugagacauaccauugagaacacaaccgcgaauaucucucugacggccauugcuaaccaggccgcuauccucaugggccuugauaagggcuggccuaucuccaaaauggacauugggguuccccugcuggcccucggaugcuacagccaggugaauccgcugacccuuacagcugccguccugaugcucguggcgcacuaugccaucauuggcccugggcugcaagcuaaggccacccgggaagcucagaaacgcacagccgccggaaucaugaagaaccccaccguugauggcauuguggcgaucgaccuggaucccgucguguacgacgcuaaguuugagaaacagcucgggcagaucaugcuucugauucuguguacgucucaaauccuccugaugagaacaaccugggcccuuugcgaaagcauuacacuggcuaccggaccucucaccacacugugggagggcuccccgggcaaguucuggaauacgaccaucgccgugucuauggccaacauuuuucgggggagcuaucuggcuggagccggccucgcguucucccuuaugaaaagccucgggggaggccgcagagggacaggagcccagggcgagacccugggcgaaaaguggaaacggcagcucaaucagcuguccaagucugaguucaacacauacaagagaagcgggaucauggaaguugaccgcuccgaggcuaaagaaggacuuaagcggggcgagaccacgaaacacgccgucucuagagggacagcuaagcugcgcugguuuguggagcggaaucucgugaaacccgaaggaaaggucaucgaucugggcugugggagaggaggcuggagcuauuacugcgccggccugaagaaaguuaccgaggugaagggguauaccaaaggaggcccugggcaugaagaacccauuccuauggcgacauacggauggaaccucgugaaacuucacuccggcaaagacgucuucuuuauucccccugaaaagugugauacccugcugugcgacaucggggagucuagcccgaaucccacaaucgaggaaggacgcacgcuccgggugcugaaaaugguugagccuuggcuuagaggcaaccaauucuguauuaagauccugaaucccuacaugccuuccguggucgaaacccucgagcagaugcagcgcaagcauggcgggaugcuggugcggaacccccugagcagaaauucuacacacgagauguauuggguuuccugcggaaccggcaacauugugagcgccgucaauaugacaucucgcaugcuccugaaccgguuuaccauggcucacagaaaaccgacguacgaacgcgauguggaccuuggggccggaaccagacauguggcugucgagccugaaguugccaaccuggauaucaucggccagcggauugagaauaucaagcacgaacauaaauccacauggcacuaugacgaggauaaccccuacaagaccugggcuuaucaugggagcuacgaggugaaacccucuggauccgccagcuccauggugaauggcgucgugaagcuccugacaaagccuugggacguuauucccauggugacccaaaucgcgaugacagauaccacgccuuucggccagcagcgcgucuuuaaagaaaagguggacacaagaaccccgaaagccaagcgggggaccgcucaaauuauggagguuacagccaaauggcuuuggggauuccugagcagaaacaagaagccccggaucuguacgcgcgaagaguuuaccagaaaagugcggucuaaugcugccaucggcgccgucuucguggacgaaaaccaguggaauagcgcgaaggaggcuguugaggaugaacgcuuuugggaccucgugcacagagagcgggaacugcacaaacaggggaagugcgccacaugcgucuauaacaugaugggaaaacgcgagaagaagcugggcgaguucgggaaagccaagggcuccagagcuauuugguacauguggcucggagcccgguuucuggaguucgaggcucuuggcuucaugaaugaagaucauugguuuucucgcgagaacagccuguccgggguggaaggagagggccuccacaaacugggguacauccuuagagacauuucuaagaucccuggaggcaauauguaugccgaugacaccgcggggugggauacacggauuaccgaggacgaucugcagaacgaagcccgcaucacagacaucauggagcccgaacaugcucuccuggccaaaagcauuuucaagcugaccuaccaaaauaaagucgugagaguucagcggccugcuaagaacggcacggugauggaugucaucucccgcagagaccagcggggaucuggccagguggggaccuauggacucaauacauuuaccaacauggaggcccaacugauuagacagauggaaagcgagggcaucuucucccccagcgagcuugaaacaccgaaccuggcggagcgcgugcucgauuggcuggaaaaguacgggguugagcggcuuaaaagaauggccauuucuggagacgacuguguggucaagccuaucgaugaccgcuuugcuaccgcccugacggcucucaaugauaugggcaaagugcggaaggacaucccccagugggaaccuuccaaaggguggaacgauuggcagcaaguucccuucugcagccaccacuuucaucagcugauuaugaaggacggcagagagaucguggucccuugucgcaaucaggaugagcuggugggacgggccagagucucucagggcgcuggguggucccuccgcgaaacagccugccugggaaagagcuaugcgcaaauguggcagcuuauguacuuccaccggagagaccugcgccucgccgcuaacgccauuuguuccgccgugcccguugauuggaucccgaccucucggacaaccuggagcauucaugcucaccaucaguggaugacgaccgaggacaugcuguccguguggaauagagucuggaucgaagagaacccuuggauggaagauaaaacacacauuagcucuuggggcgacgugcccuaucuugggaagcgggaggaccaauggugcggaucccugaucggccucaccgccagagcgacaugggcuaccaauguucagguggccaucaaccagguccgccggcugauugggaaugagaacuaccuggauuacaugacaagcaugaaaagauuuaagaaugaaucugaccccgagggcgcccucugguga

SEQ ID NO: 18963 - RNA, 9879 nt, Artificial Sequence
  derived and/or modified CDS sequence (opt5) from DENV-1__FJ410262__SS-prME
agcgugaccaugcugcugaugcugaugcccaccgcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgggcuuugcgaaggaacgaccgugguuguggacgagcacugcggcaaccggggccccucccugagaacaaccacagucaccgggaaaauuauccacgaaugguguugccggagcuguacgcucccuccccugcgcuuuaagggagaggauggcugcugguaugggauggagaucagaccggugaaggaaaaagaggaaaaucugguuaagucuaugguguccgcuggaagcggcgaggucgacuccuucucucuugggcuccuguguauuagcaucaugauugaagaggugaugcgguccagauggucucgcaaaaugcugaugacaggaacccucgccgucuuuuuccugcuuaucaugggccagcugacauggaacgaccucauucggcugugcaucauggugggcgccaaugcuagcgauagaauggggaugggaaccaccuaccuggcccuuauggcgacauuuaagaugcgcccuauguucgcugucggccugcucuuuagacggcugacgucccgcgaggugcuccugcuuaccauugggcugucucucguggccagcgucgaacugcccaacucccuggaggaacuuggagacggccuggccauggggaucaugauccucaaacugcucacagauuuccagagccaucaacugugggcuacccuucugucucucacauuuauuaagaccacguucucccugcacuaugccuggaagacaauggcuaugguucugagcaucgugucucuuuuuccccugugucucuccaccaccagccagaaaacaaccuggcugccugugcuccugggaucucuuggcugcaagccgcugacaauguuccugauugccgagaauaaaaucuggggcagaaaguccuggccccucaacgaagggauuauggcggucggaaucgugagcauccugcuuuccagccugcucaaaaacgacguuccucuggccggcccccucauugcugggggaaugcugaucgccuguuacgugauuucuggcagcuccgcugaucuuucucuggagaaggccgccgaggucagcugggaagaggaagcugagcauuccggggcgucucacaauauccugguggaaguucaggacgauggaacgaugaaaauuaaggacgaggagcgggaugacacccucacaauccugcuuaaggccacccugcucgcugugagcggcgucuauccucuguccauccccgccacacucuucgugugguacuuuuggcagaaaaagaaacaacgcucuggcguccugugggauaccccuuccccucccgaaguggagagagccguucuugacgaugggauuuaucggaucaugcagcgcggacugcugggcagaucccaggugggggucggaguguuccaggaaaacguuuuucauacgauguggcacgugacccggggcgcuguccucauguaccaagggaagcgccuggagcccagcugggccucugugaaaaaggaccuuauuuccuacggaggcggcuggagacugcaggggagcuggaauacaggagaggaagugcagguuaucgcggucgagcccggcaagaacccuaaaaaugugcagaccgcucccgggacauucaagaccucugaaggagaggugggcgccauugcccucgacuuuaaaccggggacauccggaagcccuaucgucaaccgggaaggcaagauugugggccuguaugggaauggaguugugacgaccuccggcacauacgucucugcuaucgcccaagcgaaagcuagccaggaggggccccucccugagaucgaagaugagguguucagaaagcgcaaccugaccauuauggaccuucaccccggauccggcaagacccggagauaucugcccgccaucguucgcgaagccauuaaacggaagcugagaacacucauccuggcuccuacgcgcguggucgccagcgagauggcugaagcccuuaaagggaugccgauucgguaccagaccacagcggugaagucugagcauaccggcaaagagaucguugaucugaugugccacgccacauuuaccaugagacuccugucccccgugcgcgucccuaauuauaacaugaucauuauggacgaagcucauuucacggaucccagcucuaucgccgcucggggauacauuagcacaagagugggcaugggggaggccgccgcuaucuuuaugaccgcgaccccucccggauccguggaagccuucccucaaucuaaugcugucauucaggacgaggaacgggauaucccggagcgcagcuggaacuccggcuaugaguggaucacagacuuucccgggaagaccguuugguucgugccuucuauuaagagcggaaaugauaucgccaacugucugcgcaagaauggcaagcgggugauucagcucucccgcaaaacauucgacaccgaauaccagaagacgaaaaacaacgauugggacuacgucgugacaaccgacaucagcgagaugggggccaauuuuagagcugaucggguuauugaccccagacgcugccuuaagccugugauccugaaggauggccccgaacgggucauucuggccggaccgaugccugugacaguugcgucugcugcccaaagacgcggccggaucgggagaaaccacaauaaagagggagaccaguauaucuacaugggccagccccucaacaaugaugaggaccaugcccacuggaccgaagcuaagaugcugcuugauaacauuaauacgcccgaggggaucauuccugcccuguucgaacccgagcgcgaaaaauccgcggccaucgacggagaguaucggcucagaggcgaggcucgcaagaccuuuguggaacugaugagaagaggggaucugccugucuggcucagcuacaaaguggccuccgagggcuuccaguauucugaccgcagauggugcuuugauggagaacggaacaaucaaguccuugaggaaaacauggacguggagauuuggacaaaggagggcgaacgcaaaaagcugagaccgcgguggcuggaugcuagaaccuacagcgacccccucgcccugcgcgaguucaaggaauuugcugccgggcggagauccguuucuggagaccuuauccuggagaucggcaaacucccucagcaccugacacagcgcgcgcagaaugcccuggauaaccucgugaugcuucauaauagcgaacaagggggacgggcuuauagacacgccauggaggagcugcccgacaccauugaaacacugaugcuccuggcucuuaucgccgugcugaccggcggcgucacgcuguucuuucuguccgggcggggacugggcaagacaagcauugggcuccuuuguguuauggccucuuccgugcugcuguggauggcuagcguggagccucauuggaucgcggccucuauuauccucgaguucuuucugaugguccuucugauccccgagccggaucgccagagaaccccucaggacaaccagcucgcuuacgugguuauuggacugcuguucaugauccucaccguggccgccaaugagaugggccuucuggaaacaaccaaaaaggaucuggggauuggacacgucgcuguggagaaccaccaucacgccgcgaugcucgacgucgaucugcaucccgccuccgcuuggacacuuuacgccguggcuacgaccaucauuacaccuaugaugcggcacaccaucgaaaacacaaccgccaauauuagccugacggcgaucgccaaccaagcugccauccucaugggccuggacaaaggcuggcccauuucuaagauggauaucgggguuccucugcucgcucuuggaugcuauagccaggugaauccccugacccugacagccgcuguccucaugcugguggcccauuacgcgauuaucggcccggggcuucaggccaaggcuacccgcgaggcccagaagcggacagcugccggaauuaugaagaacccuaccguugacggcaucguggccaucgaucuggaccccgucguguaugaugcgaaauuugaaaagcagcucgggcagauuaugcugcugauccucuguacgucccagauucuucugaugcggacaaccugggcucugugcgagucuaucacacucgccaccggaccccugaccacacuuugggagggcagcccuggcaaauucuggaauacgaccauugcuguguccauggccaacaucuuccgcgggagcuaccuggccggagcuggccucgccuuuucccugaugaagucucucgggggcgggagacgggggacaggagcgcaaggcgaaacccucggcgagaaguggaaacgccagcuuaaucagcugagcaaguccgaguucaacacauauaaaagaucugggaucauggagguugaccggagcgaagccaaggagggacugaaaagaggcgagaccacgaagcacgcugucucccgcgggacagccaagcuccggugguuuguggaaagaaaucuggugaaaccggagggaaaggucauugaccuuggcugugggcgcggaggcuggucuuacuauugcgcuggccugaaaaagguuaccgaagugaaaggguacaccaagggaggccccgggcacgaggaaccuauccccauggccacauacggauggaaccucgugaaacugcauagcggcaaggaugucuucuuuauuccucccgagaagugugacacccugcucugcgauaucggggaguccagcccuaauccgacaauugaagagggacggacgcuuagagugcugaaaaugguugaacccuggcugcgcggcaaccaguucuguaucaagauucucaauccuuauaugcccucuguggucgagacccuggagcaaaugcagcggaaacacggcgggaugcuugugagaaacccucugucccgcaauagcacacaugaaauguacuggguuucuugcggaaccggcaacaucguguccgcggucaauaugacaagccggaugcuccugaacagauuuaccauggcccaccgcaagcccacguaugagcgggacguggaucugggggcuggaaccagacacguggccgucgaaccggagguugcuaaccucgacaucauuggccagcgcaucgaaaauauuaaacaugagcacaagucuacauggcauuacgaugaggacaacccuuauaagaccugggccuaccacggguccuaugaagugaaacccagcggauccgcuagcucuauggugaauggcgucgugaagcugcuuacaaaacccugggauguuaucccuauggugacccagauugccaugacagacaccacgcccuucggccaacagagagucuuuaaggagaaaguggauacacggaccccuaaggcgaagcgcgggaccgcccagaucauggaaguuacagcuaaauggcuguggggauuccucagcagaaacaagaaaccgcggaucuguacgagagaggaauuuacccggaaggugcgcuccaaugccgcuauuggcgccgucuucguggacgagaaccaauggaacucugccaaagaggcgguugaagacgagagauuuugggaucuggugcaucgggaacgcgagcuucacaagcaggggaagugcgcuacaugcgucuacaacaugaugggaaaaagagaaaagaaacugggcgaguucgggaaggccaaaggcagccgggccaucugguacauguggcucggagcucgcuuccuggaguuugaagcccugggcuucaugaaugaggaccacugguuuuccagagaaaacucucucagcgggguggagggagagggccugcauaaacuuggguauauucugcgggauaucuccaaaauucccggaggcaauauguacgcugacgauaccgccgggugggacacacgcaucaccgaagaugaccuccagaacgaggcgaagaucacagauauuauggaaccugagcacgcccugcuugcuaagucuaucuucaaacugaccuaucagaauaaggucgugagaguucaacggcccgccaaaaacggcacggugauggacgucauuagccgcagagaucagcggggauccggccagguggggaccuacggacucaauacauuuaccaacauggaagcucagcugauccgccaaauggagagcgagggcauuuucucuccuuccgaacuggagacacccaaccucgccgggagagugcuggacuggcuugaaaagcauggaguugagcggcugaaaagaauggcgaucagcggcgaugacuguguggucaagccgaucgacgaucgcuuugccaccgcucucacggcccugaaugacauggggaaggugcggaaagauauuccucagugggaacccucuaagggcuggaacgacuggcagcagguuccuuucugcucccaccacuuucaucaacuuaucaugaaagauggaagagagauugugguccccugucgcaaucaggacgagcuggugggccgggcuagagucagccagggggccggauggucccuccgcgaaacagcuugccugggcaagucuuaugcccagauguggcaacugauguacuuccaccggagagaucuccgccuggcggccaacgcuaucuguagcgccgugccuguugacugggugcccaccucccggacaaccuggagcauucaugcccaccaucaguggaugacgaccgaggauaugcuuucugucuggaauagaguguggaucgaagagaacccguggauggaagacaaaacacacauuuccagcuggggagauguuccuuaucugggaaagcgcgaggaccaguggugcggcucucucaucgggcugaccgcucgggccacaugggcgaccaauauccaaguggcuauuaaccaggucagacggcuuaucggcaaugagaacuaccuggacuacaugacaagcaugaagagauuuaaaaaugaauccgaucccgagggagcccucugguga

SEQ ID NO: 18964 - RNA, 9879 nt, Artificial Sequence
  derived and/or modified CDS sequence (opt5) from DENV-1__FJ410263__SS-prME
agcgugaccaugcugcucaugcugaugcccacagcccuugcuuuccaccugacgaccagaggaggggaaccucauaugaucgucuccaagcaggaacggggaaaaucucuccuguuuaagaccagcgccggcguuaacaugugcacccuuaucgcgauggaccugggggaacucugugaagauaucaugacauacaaaugccccagaauuaccgagacagaacccgacgauguggacuguuggugcaaugcuaccgauacgugggugaccuauggaacauguucccaaaccggcgagcacagacgggacaagcgcucugucgcccuggccccucauguggggcugggacucgagacaagaaccgaaacguggaugagcuccgagggcgcuuggaaacagauccagcggguugaaacaugggcccugcgccaccccggcuucaccgugauugcucuuuuucuggcccaugcgaucgggacaucuaucacccagaagggaauuaucuucauucuccugaugcuugucaccccuagcauggccaugagaugcgugggcaucgggucccgggauuuuguugagggacugagcggcgcuacauggguggacgucgugcucgagcacgggucuugugugacgaccauggccaaggauaaacccacacuggacauugaacugcucaagaccgaggucacaaacccugcuguucugcgcaaacuuugcaucgaagccaagauuuccaauaccacgacagauagcagauguccgacccaaggagaggcgacccugguggaagaacaggacgccaacuucgugugccggcgcacauuugucgauagaggcuggggcaauggguguggacucuucggcaaagggucucugauuaccugcgcuaaguuuaagugcgugacaaaacuugagggaaagaucguucaguacgaaaaccugaaauauuccgugauugucacggugcacaccggcgaccagcaucaaguugggaaugagagcacagaacacggaaccacagccaccaucacgccccaggcuccuaccacagagauucagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggccuccaccucucaagagacauggaaucgccaggaccugcucgugaccuucaaaaccgcucacgcgaagaagcaggaagucgugguucugggaagccaagagggcgccaugcacacagcucugacgggggccaccgaaauccagacauccggaaccacaaccauuuuugccggccaucucaaaugcagacugaagauggauaaacuuacgcugaaggggaugagcuaugugauguguacaggcucuuucaaacucgagaaggaagucgcugagacccagcacggaaccgugcugguucagaucaaguacgagggcacagacgccccgugcaaaaucccuuucuccacccaagaugaaaagggggugacacagaacggacggcugauuacggcgaaucccaucgucaccgacaaagagaagccugugaacauugaagcugagccgcccuuuggcgagagcuauaucgugauuggggccggagaaaaagcccuuaagcucucuugguucaagaaaggcagcuccaucgggaagauguuugaggcuacagccagaggcgcucgccggauggccauccugggagauaccgcgugggacuucggcucuauugggggaguuuuuacaagcgucggcaaacuggugcaucagaucuucgggaccgccuacggagugcucuuuuccggcgucagcuggacgaugaagauugggaucggcgugcugcuuaccuggcugggacucaauucuagauccacaagccugucuaugaccuguauugcuguuggccuggugacacuuuaccucggggucauggugcaggccgauuccggaugcguuaucaacuggaaaggccgcgaacugaagugugggagcggaauuuucgugaccaaugagguccacacauggaccgaacaauauaaguuucaggcugacuccccuaaacggcugucugccgcgaucggcaaggccugggaggagggggugugcggcaucagaagcgcuacgcgccucgaaaacauuauguggaaacagaucuccaacgagcugaaucauauucuucuggaaaacgacaugaaguucacaguuguggucggagauguggccggcauccucgcucaggggaaaaagaugauucggccgcaacccauggaguacaaauauucuuggaaaagcuggggaaaggccaagaucaucggcgccgacgugcagaauaccaccuuuauuaucgaugggccuaacacacccgaauguccugacgaucagagagcuuggaauauuugggaggucgaggacuacggauucggcaucuuuaccacgaacauuuggcugaagcugcgcgauuccuauacacagguuugcgaccaccggcuuaugagcgcggccaucaaagauucuaaggcugugcacgccgacaugggcuacuggaucgaauccgagaaaaaugaaaccuggaagcucgccagagcuagcuucauugaggugaagacauguaucuggcccaaaucucauacccugugguccaacgggguccuggaaagcgagaugauuaucccgaagauuuauggaggcccuaucucucaacacaauuaccgccccggguacuucacacaggccgcgggaccuuggcaucucggcaaacuggagcuugauuuugaccugugcgaagggaccacggugguuguggaugagcacugcggaaaccggggccccagccucagaaccacaaccgucacaggcaagaucauucacgaaugguguugccgguccuguacccugccuccccugcgcuucagaggggaggacggaugcugguauggcauggagauccggccggugaaagaaaaggaggaaaaucuuguuaagagcauggugucugcuggguccggagaggucgacagcuuuucccucggccugcuguguauuucuaucaugauugaagaggugaugagaagccgcuggucccggagaaugcucaugacggggacacuggccguuuucuuucuucugaucaugggacagcucaccuggaacgaucugauucgccugugcaucauggugggcgccaaugcuucugacagaaugggcauggggacaaccuaccuugcccugauggcgaccuucaaaaugcggccuauguuugcugucggacuccuguuccgcagacucacaagccgggaggugcugcuucugacgaucggccucucccugguggccucugucgaacugcccaacagccuugaggaacugggggauggacucgccaugggcauuaugauccugaagcuccugaccgacuuucaaucccaucagcuuugggcuacacugcucagccugaccuucauuaaaacaaccuuuucucugcacuaugccuggaagacgauggcuaugguucuuuccaucgugagccuguucccccucugucugucuacaaccucccagaaaaccacauggcucccugugcugcuugggagccugggaugcaagccgcugaccauguuucucauugccgagaauaagaucuggggccgcagaucuuggccccugaacgaaggcaucauggcggucgggauuguguccauccuucugagcucccuccugaaaaacgauguuccucucgccggaccccugauugcuggcgggaugcuuaucgccuguuacgugauuagcggaucuagcgcugaccugucccuggagaaggccgccgaggucucuugggaagaggaagcugagcauagcggcgcgucccacaauauccucguggaaguucaggaugacgggacaaugaaaaucaaggaugaggagcgggacgauacgcugaccauucuucugaaagccacacuccuggcugugucuggagucuauccucucagcauccccgccacccuguucgugugguacuucuggcaaaagaaaaagcagcgcuccggcguccuuugggacacaccuucucccccggaaguggagagagccguucuggaugacggcauuuaucggaucaugcagcgcgggcugcucggaagaagccaggugggcgucgggguguuucaagaaaacguuuuccauaccauguggcacgugacgcggggagcuguccugauguaccagggcaagagacuugagccuuccugggccagcgugaaaaaggaccugauuucuuacgggggaggcuggcgccuccagggcuccuggaauaccggggaggaagugcagguuaucgcggucgagcccggcaagaacccuaagaaugugcaaacagcucccggcaccuuuaaaacaccggaaggggaggugggagccauugcccuggauuucaagccuggcaccagcgggucucccaucgucaaccgggaaggaaagaucgugggccucuauggcaaugggguugugacaacguccggaaccuacgucagcgcuauugcccaggcgaaggcuucccaggagggcccucugcccgagaucgaagacgagguguuuagaaagcgcaaccuuacaauuauggaucugcaccccgggucuggaaaaacccggagauaucugccugccaucguucgcgaagccauuaagcggaaacucagaacccugauccuugcuccgacacgcguggucgccagcgagauggcugaagcccugaagggcaugcccauccgguaccaaacgaccgcggugaaguccgagcauacagggaaagagauuguugaccucaugugccacgccaccuucacaaugagacugcugagcccugugcggguccccaauuauaacaugaucauuauggaugaagcucauuuuaccgacccuucuuccaucgccgcucgcggcuacauuagcacgagagugggaaugggcgaggccgccgcuaucuucaugacagcgacacccccugggucuguggaagccuuuccgcagagcaaugcugucauccaggaugaggaacgggacauucccgagcgcuccuggaacucuggauaugaguggaucaccgauuucccuggcaagacaguuugguuugugcccagcauuaaauccgggaaugacaucgccaacugucucagaaagaauggaaaacgggugauucagcuuucuagaaagaccuucgauacagaauaccaaaagaccaaaaacaacgacugggacuacgucgugacgacagauaucagcgagaugggcgccaauuuccgcgcugaccggguuauugauccuagacgcugccugaagcccgugauccugaaagacgggccggaacgggucauccucgccggcccuaugcccgugaccguugcguccgcugcccagagacgcggacggauuggcagaaaccacaauaaggagggggaucaguauaucuacaugggacagccccugaacaaugacgaggaucaugcccacuggacagaagcuaaaaugcuucuggacaacauuaauaccccugagggcaucauucccgcccucuuugaaccugagcgcgaaaagagcgcggccaucgauggggaguauagacugcggggagaggcucgcaagacguucguggaacugaugagacggggcgaccucccggucuggcuuucuuacaaaguggccuccgagggguuucaauauagcgaucgcagauggugcuucgacggcgaacggaacaaucagguccuggaggaaaacauggauguggagaucuggaccaaggagggagaacgcaagaaacugcgcccccgguggcucgacgcuagaacauacuccgacccucuggcccuucgcgaguuuaaagaguucgcugccggccggagaucuguuagcggggaucugauucucgagaucggaaagcugccccagcaccugacccagcgggcgcaaaaugcccucgacaaccuugugaugcugcauaauuccgaacagggcgggcgcgcuuauagacacgccauggaggagcugccugauacaauugaaacccucaugcugcuugcucugaucgccgugcucacaggaggcgucacccuguuuuuccugucuggccgggggcucggaaaaacgagcauuggccuucuguguguuauggccuccagcgugcugcucuggauggcuucuguggagccccauuggaucgcggccuccaucauucuggaauuuuuccuuaugguccugcucaucccggagccugaccgccagagaacaccccaggauaaccaacuggcuuacgugguuauugggcugcucuuuaugauccuuaccguggccgccaaugagaugggacugcuggaaaccacaaagaaggaccucggcauugggcacgucgcuguggagaaccaccaucacgccgcgaugcuggaugucgaccuucauccugccagcgcuuggacccuguacgccguggcuacaacgaucauuacccccaugaugcggcacacaaucgaaaacaccacagccaauaucucucucaccgcgauugccaaccaggcugccauccugaugggacuggauaaaggcuggccuauuuccaagauggacaucggcguuccccuccuugcucuggggugcuauagccaggugaauccgcugacgcucaccgccgcuguccugaugcuuguggcccauuacgcgauuaucggaccuggccugcaagccaaagcuacacgcgaggcccagaagagaaccgcugccgggaucaugaaaaaccccacaguugauggaauuguggccaucgaccucgaucccgucguguaugacgcgaaguucgaaaagcagcugggccagauuaugcugcucauccuuuguaccucucaaauucugcugaugcggacgacaugggcucucugcgagagcaucacccuggccacagggccucuuaccacccugugggagggauccccgggcaaauuuuggaauacaacgaucgcugugucuauggccaacauuuuccgcggcagcuaccucgccggggcuggacuggccuucucccugaugaaaagccucggcgggggaagacggggcaccggggcgcagggagaaacacuuggcgagaaauggaagagacagcugaaucagcuguccaaaucugaauuuaacaccuauaagcgcagcggcaucauggagguugaccgguccgaagccaaggaggggcucaaaagaggagagacaaccaagcacgcugucucucgcggcacggccaaacugcggugguucguggaaagaaaucuugugaagcccgaggggaaagucauugaucugggauguggccgcgggggauggagcuacuauugcgcuggccucaagaagguuacagaagugaaaggcuacaccaaaggcgggccugggcacgaggaacccaucccuauggccaccuacggguggaaccuggugaaacugcauuccggaaaggacgucuuuuucauucccccugagaaaugugauacacuccuuugcgacaucggcgagucuagcccgaaucccaccauugaagaggggcggacacugagagugcugaagaugguugaaccuuggcuccgcggaaaccaauuuuguaucaaaauccugaaucccuauaugccuuccguggucgagacgcuugagcagaugcagcggaagcacggcggcaugcuggugagaaacccccucagccgcaauucuacccaugaaauguacuggguuuccugcgggacaggaaacauugugagcgcggucaauaugaccucucggaugcugcugaacagauucacaauggcccaccgcaagccgaccuaugagagagauguggaccucggcgcugggacgcggcacguggccgucgaaccugagguugcuaaccuggauaucauuggacagcgcaucgaaaauauuaaacaugagcacaaguccaccuggcauuacgacgaggauaaccccuauaaaacaugggccuaccacggcagcuaugaagugaagcccucuggguccgcuagcuccauggugaauggagucgugaaacuucugaccaagccuugggacguuauccccauggugacacaaaucgccaugaccgauacaaccccuuuuggccagcagagagucuucaaggagaaaguggacacgcggacaccgaaggcgaaaagaggcaccgcccaaauuauggaaguuaccgcuaaguggcucuggggguuucugagccggaacaaaaagccccgcaucuguacaagagaggaguucacgcggaaggugcgcucuaaugccgcuauuggagccgucuuuguggacgagaaccaguggaauagcgccaaagaggcgguugaagaugagagauucugggaccuugugcaucgggaacgcgagcugcacaagcagggcaaaugcgcuaccugcgucuacaacaugauggggaagagagagaaaaagcucggagaguuuggcaaggccaaagggucccgggccaucugguacauguggcugggcgcucgcuuccuggaguucgaagcccucggauuuaugaaugaggaucacugguucucuagagaaaacagccuguccggcguggagggggagggacuucauaagcugggcuauauucuccgggacaucucuaaaaucccugggggaaauauguacgcugaugacacagccggcugggauacccgcauuacagaagacgaucugcagaacgaggcgagaaucaccgacauuauggaacccgagcacgcccuucuggcuaagagcaucuuuaaacucacauaucaaaauaaggucgugcggguucagcgcccugccaaaaacgggaccgugauggaugucauuuccagacgggaccagagaggcucuggacaggugggcacguacgggcugaauaccuucacaaacauggaagcucaacugauccgccagauggagagcgagggaaucuuuucccccagcgaacucgagaccccgaaccuggccgaacgggugcuugauuggcuggagaaguauggcguugaaagacucaagcgcauggcgauuucuggggacgacuguguggucaaaccuaucgaugaccgguucgccacagcucugaccgcccuuaaugauaugggaaaggugagaaaagacauuccccagugggagccuuccaagggcuggaacgauuggcagcaaguucccuuuugcagccaucacuuccaccagcugaucaugaaagacgggcgcgagauuguggucccuugucggaaucaggaugaacucgugggcagagcucgcgucucucagggagccggcuggucccugcgggagacggcuugccugggaaagagcuacgcccaaauguggcagcucauguauuuucauagacgcgaccugcggcuugcggccaacgcuaucuguuccgccgugcccguugauuggauuccgacaucuagaaccacauggagcauccacgcccaucaccaguggaugaccacggaagacaugcuguccguguggaaucgggucuggaucgaggaaaacccuuggauggaggauaagacccauauuagcucuuggggagacgugcccuaccucggcaaaagagaggaccaauggugcgggucccugaucggacuuacagcucgcgccaccugggcgacaaauauucagguugcuaucaaccaggugcggagacugauuggcaaugaaaacuaccucgauuauaugaccagcaugaagcgcuucaaaaaugagucugaccccgaaggggcccugugguga

SEQ ID NO: 18965 - RNA, 9879 nt, Artificial Sequence
  derived and/or modified CDS sequence (opt5) from DENV-1__FJ410264__SS-prME
agcgugaccaugcugcucaugcugaugcccaccgcccuugcuuuccaccugacgacccggggcggggaaccucauaugaucgugaccaagcaggaacggggaaaaucccuccuguuuaagaccucugccggcguuaacaugugcacccuuauugccauggaccugggggaacucugugaagauaccaugacguacaaaugcccccgcaucaccgaagcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuuguuacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuauccagaacggacggcugauuacagcuaaucccaucgugacggacaaagagaagccugucaacauugaagccgagccgcccuuuggcgagagcuauaucgugauuggggccggagaaaaagcucuuaagcucucuugguucaagaaaggcagcuccaucgggaagauguuugaggccaccgcuagaggcgcccgccggauggcgauccugggagauacagccugggacuucggcucugucgggggaguuuuuaccagcgucggcaaacuggugcaucagauuuucgggacagcuuacggagugcucuuuuccggcgucagcuggaccaugaagaucgggauuggcgugcugcuuacguggcugggacucaauucuagauccaccagccugucuaugacauguaucgccguuggccuggugacccuuuaccucggggucauggugcaggcugauuccggaugcguuauuaacuggaaaggccgcgaacugaagugugggagcggaaucuucgugacaaaugagguccacaccuggacagaacaauauaaguuucaggccgacuccccuaaacggcugucugcggccauuggcaaggcuugggaggagggggugugcggcaucagaagcgccacccgccucgaaaacaucauguggaaacagauuuccaacgagcugaaucauauccuucuggaaaacgacaugaaguucacgguuguggucggagauguggugggcauucucgcucaggggaaaaagaugauccggccgcaacccauggagcacaaauacucuuggaaaagcuggggaaaggccaagauuaucggcgccgacguccagaauacaaccuuuaucauugaugggccuaacacccccgaauguccugacgaucagagagcuuggaauaucugggagguugaggacuauggauucggcauuuuuacaaccaacaucuggcugaagcugcgcgauuccuacacacaggugugcgaccaccggcuuaugagcgcggccauuaaagauucuaaggcugugcaugccgacaugggcuauuggaucgaauccgagaaaaaugaaacauggaagcucgccagagcuagcuucaucgaggucaagaccuguauuuggcccaaaucucacacacugugguccaacggggugcuggaaagcgagaugaucauuccgaagaucuacggaggcccuauuucucaacauaauuaucgccccggguacuucacccagacagccggaccuuggcaccucggcaaacuggagcuugauuuugaccugugcgaagggaccacgguuguggucgaugagcacugcggaaaccggggccccagccucagaaccacaaccgugacaggcaagaucauccaugaaugguguugccgguccuguacccugccuccccugcgcuucaaaggggaggacggaugcugguacggcauggagauuagaccgguuaaggaaaaggaggaaaaucuugugaaaagcauggucucugcgggguccggagagguggacagcuuuucccucggccugcuguguaucucuauuaugaucgaagagguuaugcggagcagauggucccgcaagaugcucaugacggggacacuggcuguguuccuucugcucauuaugggacagcugaccuggaacgaucugauccggcuuugcauuauggucggcgccaaugccucugacagaaugggcauggggacaaccuaucuggcucucauggccaccuuuaaaaugcgcccuauguucgcggugggacugcucuuuagacggcugacaagccgcgaggugcuucugcucacgaucggccugucccuggucgcuucuguugaacuucccaacagccuggaggaacucggggauggacuggccaugggcaucaugauucucaagcugcuuaccgacuuccaaucccaccagcugugggccacacuccugagccugaccuuuaucaaaacaacccuuucucugcauuacgcuuggaagacgauggccauggugcucuccauugugagccuguucccccucugucugucuacaaccucccagaagaccacauggcuuccuguccugcuggggagccucggaugcaaaccgcugaccauguuucuuaucacagagaauaagauuuggggcagaaaaucuuggccccugaacgaaggcaucauggcuguggggguuguguccauccuccugagcucccuccugaagaacgaugucccucuugccggaccccugauugcgggcgggaugcugaucgccuguuaugugauuagcggaucuagcgcugaccucucccuggagaaagccgcugagguuucuugggaagaggaagccgagcacagcggcgccucccauaauauccuuguggaaguccaggaugacgggacgaugaagauuaaagaugaggagcgggacgauacccugacaauccuccugaaggcuacccuccuggcggugucuggagucuacccucuuagcauccccgccacacuguucgugugguauuuuuggcaaaagaaaaagcagcgcuccggcguucugugggacaccccuucucccccggaaguggagagagcuguccucgaugacggcauuuaccggaucaugcagcgcgggcugcuuggaagaagccaggugggcguugggguguuccaagaaaacgucuuccacacgauguggcacgugacccggggagccgugcugauguaucagggcaaacgccucgagccuuccugggccagcguuaagaaagaccugauuucuuacgggggaggcuggagacuccagggcuccuggaauacaggggaggaaguccaggugaucgcuguggagcccggaaagaacccuaagaauguccaaaccgcccccggcacauuuaaaaccccggaaggggaggugggagcgauugcucuggauuucaagccuggcacaagcgggucucccaucguuaaccgggaaggaaaaauugugggccuuuacggcaauggggucgugacgaccuccggaacauauguuagcgccaucgcccaggcuaaggccucccaggagggcccucugcccgagaucgaagacgagguguuuagaaaacgcaaccugaccauuauggaucuccaucccgggucuggaaagacccggagauaccugccugcgaucguccgcgaagcuauuaagcggaaacuuagaacacugauccucgccccgacgcgcgugguugccagcgagauggcugaagcccugaagggcaugcccauucgguaucaaaccacagcugugaaauccgagcacaccgggaaggagaucgucgaccugaugugccaugccacauucaccaugagacuccuuagcccugugcgcgugcccaauuacaacaugaucauuauggaugaagcgcacuuuacggacccuucuuccaucgccgcucggggcuauauuagcacaagagucggaaugggcgaggccgcugccaucuucaugaccgccacacccccugggucuguugaggcuuuuccgcagagcaaugcggugauucaggaugaggaacgggacauccccgagcgcuccuggaacucuggauacgaguggaucacagauuucccuggcaaaaccgugugguuuguccccagcauuaaguccgggaaugacaucgccaacugucugagaaagaauggaaaacgggugauucagcugucucgcaagacauucgauaccgaauaucagaagacgaagaacaacgacugggacuacguugugacaaccgauaucagcgagaugggcgcuaauuuuagagccgaccgggucauugauccuagacgcugccucaaacccgugauccugaaggacgggccggaacggguuauucuugccggcccuaugcccgugacagucgcuuccgccgcgcagagacgcggacggaucggcagaaaccauaauaaggagggggaucaguacaucuauaugggacagccccugaacaaugacgaggaucacgcucacuggaccgaagccaaaaugcuccuggacaacauuaauacgccugagggcaucauucccgcccuguucgaaccugagcgcgaaaagagcgcugccaucgauggggaguaccggcucagaggagaggcgcgcaaaaccuucguggaacuuaugagacggggcgaccugccggucuggcugucuuauaagguggccuccgagggguuucaauacagcgaucgcagauggugcuucgacggcgaacggaacaaucagguucucgaggaaaacauggauguggagauuuggacaaaagagggagaacgcaagaaacugagaccccgguggcuugacgcuagaaccuauuccgacccucuggcccuccgcgaguuuaaggaguucgcugccggccggagaucugugagcggggaucugauccuggagaucggaaagcucccccagcaucuuacacagcgcgcucaaaaugcccuggacaaccuggucaugcuccacaauuccgaacagggcgggcgggcguacagacaugccauggaggagcugccugauaccauugaaacacuuaugcugcucgcucugaucgccguucugaccggaggcgugacgcucuuuuuccuuucuggccgggggcugggaaaaacaagcauuggccugcucugugugauggcuuccagcguccugcuuuggauggccucuguggagccccacuggaucgccgcuuccauuauccuggaauuuuuccucaugguucugcugaucccggagccugaccgccagagaacaccccaggauaaccaacucgcguauguggucauugggcuucuguuuaugauccugaccguggccgcuaaugagaugggacuccuggaaacaaccaagaaagaccuuggcauugggcacgucgccguggagaaccaucaccaugccacaaugcuggauguugaccuccacccugcuagcgccuggacgcuguacgcgguggccaccacaaucauuacccccaugaugcggcauacaaucgaaaacaccacggcuaauauuucucugaccgccaucgcuaaccaggccgcgauccucaugggacuugauaagggcuggccuauuuccaaaauggacaucggcgucccccugcuggcccucgggugcuacagccaggugaauccgcugacacuuaccgcugccguucugaugcucguggcucacuaugccauuaucggaccuggccugcaagcuaaggccacacgcgaggcgcagaagagaaccgccgcugggauuaugaaaaaccccacggucgauggaaucguggccaucgaccuggaucccgugguuuacgacgcuaaguucgaaaaacagcucggccagauuaugcuucugauccuguguacaucucaaauucuccugaugcggaccacaugggcccuuugcgagagcaucacccuggccaccgggccucucacaacgcugugggagggauccccgggcaaguuuuggaauaccacaauugcggucucuauggcuaacaucuuccgcggcagcuaucuggccggggcuggacucgccuuuucccuuaugaaaagccugggcgggggaagacggggcaccggggcccagggagaaacacugggcgagaaguggaagcgccagcucaaucagcuguccaaaucugaguucaacaucuacaagagaagcggcauuauggagguggaccgguccgaagcuaaagaggggcuuaagagaggagagaccacgcgccacgccgugucucggggcacagcgaaacugagaugguucgucgaacgcaaucucguuaagcccgaggggaaggugaucgaucugggauguggcagagggggauggagcuauuacugcgccggccugaaaaaggugaccgaagucaaaggcuauaccaaagggggaccuggccaugaggaacccauuccuauggcuacauacggguggaaccucgugaaacuucacuccggaaaggacgucuuuuucacacccccugagaaaugugauacacugcugugcgacaucggcgagucuagcccgaaucccacgauugaagaggggagaacccuccgcgugcugaagauggucgaaccuuggcuucggggaaaccaauuuuguaucaagauucugaaucccuacaugccuuccgugguugagacacucgagcagaugcagagaaaacauggcggcaugcuggugcgcaacccccugagcagaaauucuacccacgaaauguauugggucuccugcgggacaggaaacaucgugagcgccgugaauaugaccucuagaaugcuccugaaccgcuucacgauggcucaccggaagccgaccuacgagagagaugucgaccuuggcgccgggacacgccauguugcgguggaaccugagguggccaaccuggauaucauuggacagagaaucgaaaauauuaaacacgagcauaaguccaccuggcacuaugacgaggauaaccccuacaaaacaugggcuuaucauggcagcuacgaagucaagcccucuggguccgccagcuccauggugaauggaguugugaagcuccugaccaaaccuugggacgucauccccauggugacacaaauugcuaugaccgauacgacaccuuuuggccagcagcggguuuucaaggagaaaguggacacccgcaccccgaaggccaaaagaggcacagcucaaaucauggaagucacggcccgguggcuuuggggguuucugagcagaaacaagaagccccggaucuguacccgcgaggaguucacaagaaaagugcggucuaaugcggccauuggagcuguuuuuguggacgagaaccaguggaauagcgccaaggaggcugucgaagaugagcgcuucugggaccucgugcagaaagaaagagagcugcacaagcagggcaaaugcgcgaccugcgucuauaacaugauggggaagcgggaaaagaaacugggagaguuuggcaaggccaaagggucccgcgcgaucugguacauguggcucggcgcuagauuccuggaguuugaagcccuuggauucaugaaugaggaucacugguucucucgggaaaacagccuguccggcguggagggggagggacuccauaagcugggcuacauucuucgcgacaucucuaaaauuccugggggaaauauguaugccgaugacacagcuggcugggauaccagaaucacagaagacgaucugcaaaacgaggccaagaucaccgacauuauggaacccgagcacgcucuccuggccacgagcaucuuuaaacugaccuaccagaauaagguugugcggguccagcgcccugcgaagaacgggacagugauggaugugauuuccagacgggaccagcgcggcucuggacaaguuggcaccuaugggcucaauacauucaccaacauggaagcccagcugaucagacagauggagagcgagggaauuuuucuucccuccgaacuggagacgccgaaccucgcugaacgggugcuggauuggcuugagaaauacggcgucgaaagacugaagcgcauggccaucagcggggacgacugugugguuaaaccuaucgaugaccgguucgcuacagcccucaccgcgcugaaugauaugggaaaggugagaaaagacauuccccagugggagccuucuaagggcuggaacgauuggcaacagguccccuuuugcucccaucacuuccaccagcugaucaugaaggacgggcgcgagauuguggucccuugucggaaucaggaugaacucgugggcagagcccgcguuagccaaggagcuggcuggucucugcgggagacagccugccuugggaaauccuaugcucagauguggcagcugauguacuuucauagacgcgaccuccggcuggccgcuaacgccaucuguagcgcggugcccgucgauugggugccgaccuccagaacgaccuggucuauucacgcccaucaccaauggaugacaaccgaagacaugcuuagcguuuggaaucgcguguggaucgaggaaaacccuuggauggaggauaagacacaugucuccagcuggggagacgugcccuaucugggcaaacgggaggaccaguggugcgggucucucauuggacugaccgcuagagccacaugggccuccaauauccagguggcuaucaaccagguucggagacugauuggcaaugaaaacuaccucgauuacaugaccagcaugaagcgcuucaaaaaugagggggaccccgaaggcgcccugugguga

SEQ ID NO: 18966 - RNA, 9879 nt, Artificial Sequence
  derived and/or modified CDS sequence (opt5) from DENV-1__FJ410265__SS-prME
agcgugaccaugcugcucaugcugaugcccaccgcccuugcuuuccaccugacgaccagaggaggggaaccucauaugauugucuccaagcaggaacggggaaaaucucuccuguuuaagacaagcgccggcguuaacaugugcacccuuauugcgauggaccugggggaacucugugaagauacaaugaccuacaaaugccccagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaaaauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccaggccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucagaggggaggacggaugcugguauggcauggagauucggccggugaaagaaaaggaggaaaaucuuguuaagagcauggugucugcuggguccggagaggucgacagcuuuucccucggccugcuguguacaucuaucaugauugaagaggugaugagaagccgcuggucccggagaaugcucaugaccgggacacuggccguuuucuuucuucugaucaugggacagcucaccuggaacgaucugauucgccugugcaucauggugggcgccaaugcuucugacagaaugggcauggggaccacauaccuugcccugauggcgacguucaaaaugcggccuauguuugcugucggacuccuguuccgcagacucaccagccgggaggugcugcuucugacaauuggccucucccugguggccucugucgaacugcccaacagccuugaggaacugggggauggacucgccaugggcaucaugauccugaagcuccugaccgacuuucaaucccaucagcuuugggcuacacugcucagccugaccuucauuaaaacgacauuuucucugcacuaugccuggaagaccauggcuaugguucuuuccaucgugagccuguucccccucugucugucuaccacaucccagaaaaccacauggcucccugugcugcuugggagccugggaugcaagccgcugacgauguuucucauugccgagaauaagaucuggggccgcagaucuuggccccugaacgaaggcauuauggcggucgggaucguguccauccuucugagcucccuccugaaaaacgauguuccucucgccggaccccugauugcuggcgggaugcuuaucgccuguuacgugauuagcggaucuagcgcugaccugucccuggagaaggccgccgaggucucuugggaagaggaagcugagcauagcggcgcgucccacaauauccucguggaaguucaggaugacgggaccaugaaaauuaaggaugaggagcgggacgauacacugaccauccuucugaaagccacacuccuggcugugucuggagucuauccucucagcauccccgccacccuguucgugugguacuucuggcaaaagaaaaagcagcgcuccggcguccuuugggacacgccuucucccccggaaguggagagagccguucuggaugacggcauuuaucggaucaugcagcgcgggcugcucggaagaagccaggugggcgucgggguguuucaagaaaacguuuuccauaccauguggcacgugacacggggagcuguccugauguaccagggcaagagacuugagccuuccugggccagcgugaaaaaggaccugauuucuuacgggggaggcuggcgccuccagggcuccuggaauaccggggaggaagugcagguuaucgcggucgagcccggcaagaacccuaagaaugugcaaacagcucccggcaccuuuaaaacaccggaaggggaggugggagccauugcccuggauuucaagccuggcacgagcgggucucccaucgucaaccgggaaggaaagauugugggccucuauggcaaugggguugugaccacauccggaaccuacgucagcgcuaucgcccaggcgaaggcuucccaggagggcccucugcccgagaucgaagacgagguguuuagaaagcgcaaccuuaccauuauggaucugcaccccgggucuggaaaaacacggagauaucugccugccaucguucgcgaagccauuaagcggaaacucagaacgcugauccuugcuccgacccgcguggucgccagcgagauggcugaagcccugaagggcaugcccauucgguaccaaacaaccgcggugaaguccgagcauacagggaaagagaucguugaccucaugugccacgccaccuucacgaugagacugcugagcccugugcggguccccaauuauaacaugaucauuauggaugaagcucauuuuacagacccuucuuccaucgccgcucgcggcuacauuagcaccagagugggaaugggcgaggccgccgcuaucuucaugaccgcgacacccccugggucuguggaagccuuuccgcagagcaaugcugucauucaggaugaggaacgggacauccccgagcgcuccuggaacucuggauaugaguggaucaccgauuucccuggcaagacaguuugguuugugcccagcauuaaauccgggaaugacaucgccaacugucucagaaagaauggaaaacgggugauucagcuuucuagaaagaccuucgauacggaauaccaaaagaccaagaacaacgacugggacuacgucgugaccacagauaucagcgagaugggcgccaauuuccgcgcugaccggguuauugauccuagacgcugccugaagcccgugauccugaaagacgggccggaacgggucauucucgccggcccuaugcccgugaccguugcguccgcugcccagagacgcggacggaucggcagaaaccacaauaaggagggggaucaguauaucuacaugggacagccccugaacaaugacgaggaucaugcccacuggacggaagcuaaaaugcuucuggacaacauuaauaccccugagggcaucauucccgcccucuuugaaccugagcgcgaaaagagcgcggccaucgauggggaguauagacugcggggagaggcucgcaagacauucguggaacugaugagacggggcgaccucccggucuggcuuucuuacaaaguggccuccgagggguuucaauauagcgaucgcagauggugcuucgacggcgaacggaacaaucagguccuggaggaaaacauggauguggagauuuggaccaaggagggagaacgcaagaaacugcgcccccgguggcucgacgcuagaacauacuccgacccucuggcccuucgcgaguuuaaagaguucgcugccggccggagaucuguuagcggggaucugauccucgagaucggaaagcugccccagcaccugacccagcgggcgcaaaaugcccucgacaaccuugugaugcugcauaauuccgaacagggcgggcgcgcuuauagacacgccauggaggagcugccugauacaauugaaacccucaugcugcuugcucugaucgccgugcucacgggaggcgucacacuguuuuuccugucuggccgggggcucggaaaaaccagcauuggccuucuguguguuauggccuccagcgugcugcucuggauggcuucuguggagccccauuggaucgcggccuccauuauccuggaauuuuuccuuaugguccugcucaucccggagccugaccgccagagaacaccccaggauaaccaacuggcuuacgugguuauugggcugcucuuuaugauccuuacaguggccgccaaugagaugggacugcuggaaaccacaaagaaggaccucggcauugggcacgucgcuguggagaaccaccaucacgccgcgaugcuggaugucgaccuucauccugccagcgcuuggacgcuguacgccguggcuaccacaaucauuacccccaugaugcggcacacaaucgaaaacaccacggccaauauuucucucaccgcgaucgccaaccaggcugccauccugaugggacuggauaaaggcuggccuauuuccaagauggacaucggcguuccccuccuugcucuggggugcuauagccaggugaauccgcugacacucaccgccgcuguccugaugcuuguggcccauuacgcgauuaucggaccuggccugcaagccaaagcuacacgcgaggcccagaagagaaccgcugccgggauuaugaaaaaccccacgguugauggaaucguggccaucgaccucgaucccgucguguaugacgcgaaguucgaaaagcagcugggccagauuaugcugcucauccuuuguacaucucaaauucugcugaugcggaccacaugggcucucugcgagagcaucacccuggccaccgggccucuuacaacgcugugggagggauccccgggcaaauuuuggaauaccacaauugcugugucuauggccaacaucuuccgcggcagcuaccucgccggggcuggacuggccuucucccugaugaaaagccucggcgggggaagacggggcaccggggcgcagggagaaacacuuggcgagaaauggaagagacagcugaaucagcuguccaaaucugaauuuaacaccuauaagcgcagcggcaucauggagguugaccgguccgaagccaaggaggggcucaaaagaggagagacgacaaagcacgcugucucucgcggcaccgccaaacugcggugguucguggaaagaaaucuugugaagcccgaggggaaagucauugaucugggauguggccgcgggggauggagcuacuauugcgcuggccucaagaagguuaccgaagugaaaggcuacacaaaaggcgggccugggcacgaggaacccaucccuauggccaccuacggguggaaccuggugaaacugcauuccggaaaggacgucuuuuucauucccccugagaaaugugauacacuccuuugcgacaucggcgagucuagcccgaaucccacgauugaagaggggcggacccugagagugcugaagaugguugaaccuuggcuccgcggaaaccaauuuuguaucaaaauucugaaucccuauaugccuuccguggucgagacacuugagcagaugcagcggaagcacggcggcaugcuggugagaaacccccucagccgcaauucuacccaugaaauguacuggguuuccugcgggacaggaaacaucgugagcgcggucaauaugaccucucggaugcugcugaacagauucacgauggcccaccgcaagccgaccuaugagagagauguggaccucggcgcugggacacggcacguggccgucgaaccugagguugcuaaccuggauaucauuggacagcgcaucgaaaauauuaaacaugagcacaaguccaccuggcauuacgacgaggauaaccccuauaaaacaugggccuaccacggcagcuaugaagugaagcccucuggguccgcuagcuccauggugaauggagucgugaaacuucugaccaagccuugggacguuauccccauggugacacaaauugccaugaccgauacgacaccuuuuggccagcagagagucuucaaggagaaaguggacacccggaccccgaaggcgaaaagaggcacagcccaaaucauggaaguuacggcuaaguggcucuggggguuucugagccggaacaaaaagccccgcaucuguaccagagaggaguucacacggaaggugcgcucuaaugccgcuauuggagccgucuuuguggacgagaaccaguggaauagcgccaaagaggcgguugaagaugagagauucugggaccuugugcaucgggaacgcgagcugcacaagcagggcaaaugcgcuaccugcgucuacaacaugauggggaagagagagaaaaagcucggagaguuuggcaaggccaaagggucccgggccaucugguacauguggcugggcgcucgcuuccuggaguucgaagcccucggauuuaugaaugaggaucacugguucucuagagaaaacagccuguccggcguggagggggagggacuucauaagcugggcuauauucuccgggacaucucuaaaauuccugggggaaauauguacgcugaugacacagccggcugggauacccgcaucacagaagacgaucugcagaacgaggcgaagaucaccgacauuauggaacccgagcacgcccuucuggcuaaaagcaucuuuaagcucacguaucaaaauaaagucgugagaguucagcggccugccaagaacgggaccgugauggaugucauuucccgcagagaccagcggggcucuggacaggugggcacauacgggcugaauaccuucacaaacauggaagcucaacugaucagacagauggagagcgagggaaucuuuucccccagcgaacucgagaccccgaaccuggccgaacgcgcgcuugauuggcuggagaaguauggcguggaacggcucaaaagaauggccaucucuggggacgacuguguugugaagccuaucgaugaccgcuucgcuacggcccugacagcucuuaaugauaugggaaaaguccggaaggacauuccccagugggagccuuccaaaggcuggaacgauuggcagcaagugcccuuuugcagccaucacuuccaccagcugaucaugaaggacgggagagagauuguugugccuugucgcaaucaggaugaacucgucggccgggccagagugucucagggagcuggcuggucccugcgcgagaccgccugccugggaaagagcuacgcgcaaauguggcagcucauguauuuucaucggagagaccugcgccuugccgcuaacgccaucuguuccgccguccccguggauuggauuccgacaucucggaccacguggagcauccacgcucaucaccaguggaugaccacagaagacaugcuguccguuuggaauagaguguggauugaggaaaacccuuggauggaggauaaaacccauaucagcucuuggggagacguccccuaccucggcaagcgggaggaccaauggugcgggucccugaucggacuuacagccagagcgaccugggcuacaaauauucagguggccaucaaccagguucgccggcugauuggcaaugaaaacuaccucgauuauaugaccagcaugaaaagauucaagaaugagucugaccccgaaggggcccugugguga

SEQ ID NO: 18967 - RNA, 9879 nt, Artificial Sequence
  derived and/or modified CDS sequence (opt5) from DENV-1__FJ461336__SS-prME
uccgugaccaugcugcucaugcugaugcccacagcccuugcuuuccaccugacgaccagaggcggggagccucauaugaucgucuccaagcaggaacggggaaaaucucuccuguuuaagacaagcgccggcguuaauaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccagacaggcgagcacagacgggacaagcgcucuguugcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggaaccgggauuuuguugagggacuguccggcgcuacguggguggacgucgugcucgagcacgggagcugugugaccacaauggccaaggauaaacccacccuggacaucgaacugcucaagacagaggucaccaauccugcuguucugcgcaaacuuugcauugaagccaagaucucuaacacgacaaccgauuccagauguccgacccaaggagaggcgacacugguggaggaacaagacgccaauuucgugugccggcgcaccuuugucgauagaggcuggggcaacggguguggacucuucggcaaagggagccugauuacaugcgcuaaguuuaagugcgugacgaaacuugagggaaagaucguucaguacgaaaaucugaaauauucugugaucgucaccgugcacacaggcgaccagcaucaaguugggaacgaguccaccgaacacggaacaaccgccacgauuacaccccaagcuccuaccaccgagauccagcucacagacuacggcgcccugacccuggauuguagcccccggacgggccucgacuucaaugaaauggugcugcuuacaaugaaggagaaaucuuggcugguccauaagcagugguuucucgaucugccucuucccuggaccuccggggccagcacaucccaagagaccuggaaccgccaggaccugcucgugaccuucaaaacagcucacgcgaagaagcaggaagucgugguucugggaucucaagagggcgccaugcacacggcucugaccggggccacagaaauucagaccagcggaacaaccacgaucuuugccggccaucucaaaugcagacugaagauggauaaacuuacacugaaggggauguccuaugugauguguaccggcagcuucaaacucgagaaggaagucgcugagacccagcacggaacagugcugguucagauuaaguacgagggcaccgacgccccgugcaaaaucccuuucucuacacaagaugaaaagggggugacgcagaauggacggcugaucaccgcgaaccccauugucacagacaaagagaagccugugaauaucgaagcugagccgcccuuuggcgaguccuauauugugaucggggccggagaaaaagcccuuaagcucagcugguucaagaaaggcucuagcauugggaagauguuugaggcuaccgccagaggcgcucgccggauggccauccugggagauacagcgugggacuucggcuccaucgggggaguucugaccucugucggcaaacucgugcaucagauuuuugggacggccuacggagugcuguucagcggcgucuccuggaccaugaagaucgggauuggcgugcuucugacauggcucggacugaacagcagaucuaccucccugagcaugacauguaucgcuguuggccuugugacccucuaccugggggucauggugcaggccgauucuggaugcguuauuaauuggaaaggccgcgaacugaaguguggguccggaaucuuugugacaaacgagguccacaccuggacggaacaauauaaguuccaggcugacagcccuaaacggcucuccgccgcgauuggcaaggccugggaggagggggugugcggcaucagaucugcuacacgccuggaaaacaucauguggaaacagauuagcaaugagcuuaaccauauccugcucgaaaaugacaugaaguuuaccguuguggucggagauguggccggcauucuggcucaggggaaaaagaugauccggccgcaacccauggaguacaaauauuccuggaagucuuggggaaaggccaaaauuaucggcgccgacgugcagaacaccacauucaucauugaugggccuaauacccccgaauguccugacgaucagagagcuuggaacaucugggaggucgaggacuacggauuuggcauuuucacgacaaauaucuggcugaaacuucgcgauagcuauacccagguuugcgaccaccggcucauguccgcggccauuaaagauagcaaggcugugcacgccgacaugggcuacuggaucgaaucugagaaaaacgaaacauggaagcuggccagagcuuccuuuaucgaggugaagaccuguauuuggcccaaaagccauacacuguggucuaaugggguccucgaauccgagaugaucauuccgaagaucuauggaggcccuauuagccaacacaacuaccgccccggguacuucacccagacggccggaccuuggcaucugggcaaacuugagcuggauuucgaccucugcgaagggaccacagugguuguggaugagcacugcggaaaucggggccccucucugagaaccacaaccgucacgggcaagaucauccacgaaugguguugccggagcuguacacugccuccccuucgcuuuagaggggaggacggaugcugguauggcauggagauucggccggugaaagaaaaggaggaaaaccucguuaaguccauggugagcgcggggucuggagaggucgacuccuucagccugggccugcucuguaucuccauuaugaucgaagaggugaugagaucucgcuggagccggaaaaugcugaugaccgggacacuugcugucuuuuuccugcucauuaugggacagcugaccuggaaugaucugaucagacuuugcauuauggugggcgccaacgccuccgaccgcaugggcauggggaccacauaccuggcucucauggccacguuuaagaugagaccuauguucgcggucggacugcucuuucggcgccugaccucuagagaggugcuucugcucacaaucggccugagccugguggcuuccgucgaacuucccaauucucuggaggaacucggggauggacuggccaugggcaucaugauucucaaacugcuuaccgacuuccaaagccaucagcugugggccacacuccugucccugaccuuuaucaagacgacauucagccuucacuaugcuuggaaaaccauggccaugguucugucuauugugucccucuuuccccugugucucagcaccacaucucagaagaccacauggcugccugugcuucuggggucccugggaugcaagccgcucacgauguuccugaucgcugagaacaaaauuuggggccggcgcagcuggccccuuaacgaaggcaucauggccgucgggaucgugucuauucugcucuccagccugcucaagaaugauguuccucuggcgggaccccuuaucgccggcgggaugcugauugcuuguuacgugaucuccggaagcucugccgaccugagccucgagaaagcugccgaggucuccugggaagaggaagccgagcauucuggcgcuagccacaacauucugguggaaguucaggaugacgggaccaugaagaucaaagaugaggagagagacgauacacuuaccauccugcucaaggcgacacugcucgccguguccggagucuauccucugucuauucccgcuacccuuuuugugugguacuucuggcagaagaagaagcagcggagcggcguccugugggacacgccuagcccucccgaagugggccgcgccguucuggaugacgggaucuauagaauuaugcagcggggacuccugggccgcucucaggugggggucggaguguuccaagagaauguuuuucauaccauguggcacgugacaagaggcgccguccuuauguaccaggggaaacggcuggaacccagcugggcuuccgugaagaaagaccucaucagcuacggaggcggcuggagacugcaggggucuuggaacaccggagaggaggugcagguuauugccgucgaacccggcaagaauccuaaaaacgugcaaacagcgcccgggaccuucaagacaccggagggagaagugggcgcuaucgcccucgauuuuaagccugggacguccggaagccccauugucaaucgcgagggcaaaaucgugggccuguaugggaacggaguugugaccacaucuggcaccuacgucuccgccaucgcucaggccaaggcgagccaggaagggccucuucccgagauugaggacgaaguguuccggaaaagaaaucugaccaucauggaucugcaccccggauccggcaagacacgccgguaucucccugcuauuguuagagaggccaucaaacgcaagcugcggacgcuuauucuggccccgaccagaguggucgcuucugaaauggccgaggcucucaaggggaugcccauccgcuaccaaacaaccgccgugaaaagcgaacauacaggcaaggagaucguugaccugaugugccacgcgaccuuuacgaugcggcugcucuccccugugagaguccccaacuauaauaugauuaucauggaugaggcccauuucacagacccuagcucuauugcugcccggggauacaucuccacccgcgugggcaugggggaagcugccgccauuuuuaugaccgcuacacccccuggaagcguggaggcguucccgcagucuaacgccgucauccaggaugaagagagagacauccccgaacggagcuggaacuccggcuaugaguggauuaccgauuuuccugggaaaacaguuugguucgugcccucuaucaagagcggaaacgacauugcuaauugucuucgcaaaaacggcaagagagugauccagcugucccggaagaccuuugauacggaguaccagaagaccaagaacaaugacugggacuacgucgugaccacagauauuucugaaaugggggccaacuucagagccgaccgcguuaucgauccucggagaugccugaaacccgugauucucaaggacggcccggagcgcgucauccuggcuggaccuaugcccgugaccguugccagcgcggcucagcggagaggccgcaucgggcggaaucacaacaaagaaggagaucaguauauuuacaugggccagccccuuaauaacgacgaggaucaugcccacuggacggaggccaagaugcugcucgacaauaucaacaccccugaagggauuauccccgcucuguucgagccugaaagagagaaguccgccgcgauugauggagaauaucgccugagaggcgaggcccggaaaacauuuguggagcucaugcgcagaggggaccuuccggucuggcugagcuacaagguggcuucugaaggcuuccaauauuccgaucggcgcuggugcuuugacggagagagaaauaaccagguccuggaagagaauauggauguggaaaucuggaccaaagagggcgagcggaagaaacucagaccccgcuggcuggacgcccggacauacagcgacccucuugcucugagagaguucaaggaguuugccgcugggcgccgguccguuucuggagaucucauccuggaaauuggcaaacugccccagcaccucacccagagagcccaaaacgcgcuugacaaucuggugaugcugcauaacagcgagcaagggggacgggccuaucgccacgcuauggaagaacucccugauacaaucgagacccugaugcuucuggcccucauugcugugcugacgggcggcgucacacuguucuuucucuccgggagaggacuuggcaagaccucuaucgggcugcuguguguuauggccagcuccgugcuccuguggauggccagcguggaaccccauuggauugcugcgucuaucauccuugaguucuuucugaugguccuccugauuccggaaccugaccggcagcgcacaccccaggauaaucaacuggccuacgugguuaucggacuccuuuucaugauucugacaguggcugccaacgagaugggccugcucgagaccacaaagaaagaccuggggaucggacacgucgccguggaaaaccaccaucacgcugccaugcuugaugucgaccugcauccugcguccgccuggacgcucuacgcuguggccaccacaauuaucacccccaugaugagacacacaauugagaauaccacggcuaacaucagccugaccgccaucgcgaaucaggccgcuauucugaugggccucgauaagggcuggccuaucucuaaaauggacauugggguuccccuucuggcccugggaugcuauucccaggugaacccgcucacacugaccgcugccguccuuaugcugguggcucauuacgccaucauuggcccugggcuccaagcgaaggccacacgggaagcucagaaacgcaccgccgcuggaaucaugaagaaucccacgguugauggcaucguggccauugaccuggaucccgucguguaugacgccaaguuugagaaacagcuggggcagaucaugcuccuuauucuguguacaagccaaauccugcucaugagaaccacaugggcgcugugcgaaucuauuacccuugcuaccggaccucugacaacgcucugggagggcagcccgggcaaguucuggaacaccacaaucgccguguccauggcuaauaucuuucgggggucuuaccuggccggagccggccuggcuuucagccucaugaaaucccuugggggaggccgcagagggaccggagcccagggcgagacacugggcgaaaaguggaaacggcagcugaaccagcucagcaaguccgaguucaauaccuauaagagaucugggauuauggaaguugaccgcagcgaggcgaaagaaggacugaagcggggcgagacgacaaaacacgccgucuccagagggaccgcuaaacuucgcugguuuguggagcggaaccuggugaaacccgaaggaaaggucaucgaucucggcugugggagaggaggcuggucuuacuauugcgccggccugaagaaaguuaccgaggugaagggguacacaaaaggaggcccugggcacgaggaacccauuccuauggcuaccuacggauggaaucuggugaagcuccauagcggcaaagacgucuucuuuauucccccugaaaagugugauacacuucugugcgacaucggggaguccucuccgaaccccacgaucgaggaaggacgcacccugcgggugcucaaaaugguugagccuuggcugagaggcaaucaauucuguauuaagauccuuaaccccuauaugccuagcguggucgaaacacuggagcagaugcagcgcaagcacggcgggaugcucgugcggaauccccuguccagaaacagcacccaugagauguacuggguuucuugcggaacaggcaauaucguguccgccgucaacaugaccagccgcaugcugcucaaccgguuuacgauggcgcacagaaaaccgaccuaugaacgcgauguggaccugggggccggaacaagacacguggcugucgagccugaaguugccaaucuugauauuaucggccagcggauugagaacaucaagcaugaacacaaaucuaccuggcauuacgacgaggauaaucccuauaagacaugggcuuaccacggguccuaugaggugaaacccagcggaucugccuccagcauggugaacggcgucgugaagcugcucaccaagccuugggacguuauucccauggugacacaaaucgcuaugaccgauacgacaccuuucggccagcagcgcgucuuuaaagaaaagguggacaccagaaccccgaaagccaagcgggggacagcgcaaaucauggagguuacggccaaauggcuguggggauuccuuuccagaaauaagaagccccggauuuguacccgcgaagaguuuacaagaaaagugcggagcaacgcugccaucggcgcugucuucguggacgaaaaucaguggaacucugccaaggaggccguugaggaugaacgcuuuugggaccuggugcauagagagcgggaacuccacaaacaggggaagugcgcgaccugcgucuacaauaugaugggaaaacgcgagaagaagcugggcgaguucgggaaagcuaagggcagcagagccauuugguacauguggcugggagcccgguuucucgaguucgaggcucugggcuucaugaacgaagaucacugguuuucccgcgaaaauucucuuagcgggguggaaggagagggccugcauaaacucggguauauccugagagacauuuccaacaucccuggaggcaauauguacgccgaugacacagcugggugggauacccggaucacagaggacgaucuucagaacgaagcccgcauuaccgacaucauggagcccgaacacgcgcugcucgccaagucuauuuucaaacugacguaucaaaauaaggucgugagaguucagcggccugcuaaaaacggcaccgugauggaugucaucagccgcagagaccagcggggauccggccagguggggacauacggacugaacaccuuuacaaauauggaggcccaacucauuagacagauggaaucugagggcaucuucagccccuccgagcuggaaaccccgaaccuugcugagcgcgugcuggauuggcucgaaaaguaugggguugagcggcugaagagaauggccaucagcggagacgacuguguggucaaaccuauugaugaccgcuuugcgacggcccuuacagcucugaaugauaugggcaaggugcggaaagacaucccccagugggaaccuucuaagggguggaacgauuggcagcaaguucccuucugcucccaucacuuucaccagcucauuaugaaagacggcagagagaucguggucccuugucgcaaucaggaugagcuggugggacgggccagagucagccagggcgcuggguggucucugcgcgaaaccgccugccucggaaaguccuacgcucaaauguggcagcugauguauuuccaucggagagaccuucgccuggccgcgaacgccauuuguagcgcugugcccguugauuggaucccgacaucccggaccacguggucuauucacgcccaucaccaguggaugaccacagaggacaugcucagcguguggaauagagucuggaucgaagagaacccuuggauggaagauaagacccauaucuccagcuggggcgacgugcccuaccuggggaaacgggaggaccaauggugcggaucucuuauuggccugacagccagagcuaccugggccacaaauauccagguugcgauuaaccaggugcgccggcucaucgggaaugagaacuaccuggauuauaugaccuccaugaagagauuuaaaaaugaaagcgaccccgagggcgcucugugguga

SEQ ID NO: 18968 - RNA, 9879 nt, Artificial Sequence
  derived and/or modified CDS sequence (opt5) from DENV-1__FJ410266__SS-prME
agcgugaccaugcugcucaugcugaugcccaccgcccuugcuuuccaccugacgaccagaggcggggaaccucauaugaucgucaccaagcaggaacggggaaaaucccuccuguuuaagaccucugccggcguuaacaugugcacacuuauugcgauggaccugggggaacucugugaagauaccaugacauacaaaugcccccgcaucaccgaggcugaacccgacgauguggacuguuggugcaaugccacggauaccugggugacauauggaaccuguagccaaacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaggacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaagccccuaccagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguucacagugguugugggagaugucgugggcauucucgcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaagcugcgcgauuccuacacacagguuugcgaccaccggcuuaugagcgcggccauuaaagauucuaaggcugugcaugccgacaugggcuauuggaucgaauccgagaaaaaugaaaccuggaagcucgccagagcuagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgccggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuucaaaggggaggacggaugcugguacggcauggagauuagaccggugaaggaaaaggaggaaaaucuuguuaaaagcauggugucugcgggguccggagaggucgacagcuuuucccucggccugcuguguaucucuauuaugaucgaagaggugaugcggagcagaugguccaagaaaaugcucaugacagggacccuggcuguuuuccuucugcucauuaugggacagcugacauggaacgaucugauccgccuuugcauuauggugggcgccaaugccucugaccggaugggcauggggaccaccuaucuggcucucaucgccacauuuaagaugagaccuauguucgcggucggacugcucuuucgcagacugacgagccgggaggugcuucugcucaccaucggccugucccugguggcuucugucgaacuucccaacagccuggaggaacucggggauggacuggccaugggcauuaugauccucaaacugcuuacagacuuccaaucccaccagcugugggccacccuccugagcuuuacauucauuaagaccacgcugucucuucauuacgcuuggaagacaauggccaugguucuguccaucgugagccucuuuccccugugucucucuaccaccucccagaaaacaaccuggcugccugugcuucuggggagccugggaugcaagccgcucacaauguuccugauugcugagaauaaaaucuggggccgcaagucuuggccccuuaacgaaggcaucauggccgucggggugguuuccauucugcucagcucccugcucaaaaacgaugugccucuggcgggaccccuuaucgccggcgggaugcugauugcuuguuaugucaucagcggaucuagcgccgaccugucccucgagaaggcugccgaggugucuugggaagaggaagccgagcacagcggcgcuucccauaauauucugguugaagugcaggaugacgggacgaugaaaaucaaggaugaggagagagacgauacccuuacaauccugcucaaggcgacccugcucgccgucucuggaguguacccucugagcauucccgcuacacuuuuugucuggcacuucuggcagaagaagaaacagcgguccggcgugcugugggacaccccuucucccccggaaguugagcgcgccgugcuggaugacggcaucuauagaauuaugcagcgggggcuccugggacgcagccaggucggcguggggguuuuccaagaaaacguguuucacacgauguggcaugucaccagaggagccgugcuuauguaccagggcaagcggcuggagccuuccugggcuagcgugaaaaaggaccucaucucuuaugggggaggcuggcgccugcagggcuccuggaauacaggggaggaaguucaggucauugccguggagcccggaaagaacccuaaaaaugugcaaaccgcgcccggcacauucaagaccccggaaggggaggucggagcuaucgcccucgauuuuaaaccuggcacaagcgggucucccauugugaacagagaaggaaagaucguuggccuguacggcaaugggguggucacgaccuccggaacauacgugagcgccaucgcucaggccaaagcgucccaggagggcccucuucccgagauugaagacgagguuuuccggaagagaaaccugaccaucauggaucugcaccccgggucuggaaagacccgccgguaucucccugcuauugugagagaagccaucaaacgcaagcugcggacacuuauucuggccccgacgagagucguggcuagcgagauggccgaagcucucaaaggcaugcccauccgcuaccaaaccacagccguuaaguccgagcauaccgggaaagagaucguggaccugaugugccacgcgacauuuaccaugcggcugcucagcccugucagagugcccaauuauaacaugauuaucauggaugaagcccauuucacggacccuucuuccauugcugcccgcggcuacaucagcacacgggugggaaugggcgaggcugccgccauuuuuaugaccgcuacacccccugggucugucgaagcguucccgcagagcaaugccguuauccaggaugaggaaagagacauccccgagcgguccuggaacucuggauaugaguggauuacagauuuuccuggcaagaccgugugguucgugcccagcaucaaguccgggaaugacauugcuaacugucuucgcaaaaauggaaagagagucauccagcugucucggaaaacauuugauaccgaauaccaaaagacgaaaaacaacgacugggacuaugugguuacaaccgauauuagcgagaugggcgccaauuuccgcgccgacagagugaucgauccucggagaugccugaagcccgucauucucaaggacgggccggaacgcgugauccuggcuggcccuaugcccguuacaguggccuccgcggcucagcggagaggacgcaucggccggaaccacaauaaagagggggaucaguacauuuacaugggacagccccuuaacaaugacgaggaucacgcccauuggaccgaagccaagaugcugcucgacaacaucaauacgccugagggcauuauccccgcucuguucgaaccugagagagaaaagagcgccgcgauugauggggaguaucgccugcggggagaggccagaaagaccuuugucgagcucaugcgcagaggcgaccuuccgguguggcugucuuacaaagucgcuuccgagggguuccaauauagcgaucggcgcuggugcuuugacggcgaaagaaacaaucaggugcuggaggaaaacauggauguugagaucuggacaaaggagggagaacggaaaaagcuccgccccagauggcuggacgcccggaccuacuccgacccucuugcucugagagaguucaaggaauuugccgcuggccgccggucugugagcggggaucucauccuggagauuggaaaacugccccagcaccucacacagagagcccaaaaugcgcuugacaaccuggugaugcugcauaauuccgaacagggcgggcgcgccuaucggcacgcuauggaggagcucccugauaccaucgaaacacugaugcuucuggcccucauugcuguccugaccggaggcguuacgcuguucuuucucucuggcagagggcuuggaaagacaagcaucggccugcugugugugauggccuccagcgugcuccuguggauggccucugucgagccccacuggauugcugcguccaucauccuugaguucuuucugauggugcuccugauuccggagccugaccggcagcgcacaccccaggauaaccaacuggccuacguugugaucgggcuccuuuucaugauucugaccgucgcugccaaugagaugggacugcucgaaacaaccaaaaaggaccugggcaucgggcauguggccgucgagaaccaccaucacgcuacaaugcuugauguggaccugcauccugccagcgcguggacgcucuaugccguugcuaccacaauuaucacccccaugaugagacacacaauugaaaacaccacggccaauaucucucugaccgcuaucgccaaccaggcggccauucugaugggacucgauaaaggcuggccuaucuccaagauggacauuggcgugccccuucuggcucuggggugcuacagccaggucaauccgcucacacugaccgccgcugugcuuaugcugguugcccacuacgcuaucauuggaccuggccuccaagccaaggcgacacgggaggcccagaaacgcaccgcugccgggaucaugaagaaccccacgguggauggaaucgucgcuauugaccuggaucccgugguguaugacgccaaauuugaaaagcagcugggccagaucaugcuccuuauucuguguacaucucaaauccugcucaugagaaccacaugggcccugugcgagagcauuacccuugcgaccgggccucugacaacgcucugggagggauccccgggcaaauucuggaauaccacaaucgcuguuucuauggccaacaucuuucggggcagcuaccuggcuggggccggacuggccuucucccucaugaaaagccuuggcgggggacgcagaggcaccggggcucagggagaaacacugggcgagaaguggaaacggcagcugaaucagcucuccaagucugaguucaacaccuauaaacgcagcggcauuauggaggucgacagauccgaagccaaggaggggcugaaacggggagagacgacaagacaugcggugucucgcggcaccgccaaacuucggugguuuguggaaagaaaucuggucaagcccgaggggaaaguuaucgaucucggauguggccgcgggggauggagcuacuauugcgcuggccugaagaaagugaccgaagugaagggcuacacaaaagggggaccuggccacgaggaacccauuccuauggccaccuauggguggaaccuggucaagcuccauuccggaaaagacguguucuuuacacccccugagaagugugauacgcuucugugcgacaucggcgagucuagcccgaaucccaccauugaagaggggcggacacugagaguucucaagaugguggaaccuuggcugcgcggaaaccaauucuguaucaaaauucuuaaucccuacaugccuuccgucguggagacccuggagcagaugcagcggaagcacggcggcaugcucguuagaaacccccugagccgcaauucuacacacgaaauguacuggguguccugcgggaccggaaacaucgucagcgcugugaauaugacgucucggaugcugcucaacagauuuaccauggcccaucgcaaaccgacauaugagcgggauguggaccugggcgcggggaccagacacgucgccguugaaccugagguggcuaaccuugauaucauuggacagcgcaucgaaaauauuaagcaugagcacaaauccacauggcauuacgacgaggauaaccccuauaagaccugggccuaccacggcagcuaugaagugaagcccucuggguccgcuagcuccauggucaauggagugguuaaacugcucacaaagccuugggacgugauccccauggucacccaaauugccaugacggauacaaccccuuucggccagcagagaguguuuaaagagaagguugacacccggacaccgaaagcuaagcgcggcacggcccaaaucauggaagugaccgcgaaguggcuguggggguuccuuagcagaaacaaaaagccccggaucuguacaagagaggaauuuacccggaaaguccgcucuaaugccgcuauuggagccguguucguugacgagaaccaguggaauagcgcuaaggaggccguggaagaugagagauuuugggaccugguccagaaagaacgggagcuccacaagcagggcaagugcgccacaugcguguacaacaugauggggaaacgcgaaaagaaacugggagaguucggcaaggcgaaaggguccagagcuaucugguauauguggcugggcgcccgguuucucgaguucgaagcccugggauucaugaaugaggaucauugguuuucucgcgaaaacagccuuuccggcgucgagggggagggacugcacaagcucggcuacauucugagagacaucucuaaaauuccugggggaaauauguacgcugaugacaccgccggcugggauacacggaucaccgaagacgaucuucaaaacgaggcuaagaucacggacauuauggaacccgagcaugcccugcucgcgaccagcaucuucaagcugacauaucagaauaaagugguucgcgugcagagaccugccaagaacgggaccgucauggaugugauuucccggcgcgaccagagaggcucuggacaagugggcacauacgggcugaauaccuuuacgaacauggaagcucagcucauccggcagauggagagcgagggaauuuuccugcccggcgaacuugagacaccgaaccuggccgaacgcguucucgauuggcuggagaaauaugggguggaaagacuuaagcggauggcuaucuccggagacgacugugucgugaaaccuaucgaugacagauuugccaccgcgcugacagcccucaaugauaugggcaagguucgcaaggacauuccccagugggagccuagcaaaggguggaacgauuggcaacaggugcccuucugcucucaccacuuucaucagcugaucaugaaggacggccgggagauugucgugccuuguagaaaucaggaugaacuggucggacgcgcucgggugucccaaggcgccggguggagccucagagagaccgcuugccugggaaaaucuuacgcccagauguggcagcuuauguauuuccaccgccgggaccugagacucgcugccaacgcgaucuguuccgccguucccguggauugggucccgacgagccgcaccacaugguccauucaugcucaccaucaauggaugaccacagaagacaugcugucuguguggaaucggguuuggaucgaggaaaacccuuggauggaggauaagacccacgugagcuccuggggcgacguccccuaccuugggaaaagagaggaccaguggugcggaagccugauuggccucacagcccgcgccaccugggcuucuaauauccagguggccaucaaccaggugcggagacugauugggaaugaaaacuaucuggauuacaugacguccaugaagcgguuuaagaaugagggcgaccccgaaggagcgcucugguga

SEQ ID NO: 18969 - RNA, 9879 nt, Artificial Sequence
  derived and/or modified CDS sequence (opt5) from DENV-1__FJ410269__SS-prME
agcgugaccaugcugcucaugcugaugcccaccgcccuugcuuuccaccugacgacccggggcggggaaccucauaugaucgugacaaagcaggaacggggaaaaucccuccuguuuaagaccucugccggcguuaacaugugcacccuuauugcgauggaccugggggaacucugugaagauaccaugacauacaaaugcccccgcaucaccgaagcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuauccagaacggacggcugauuacagcuaaucccaucgugacggacaaagagaagccugucaacauugaagccgagccgcccuuuggcgagagcuauaucgugauuggggugggagaaaaagcccuuaagcucucuugguucaagaaaggcagcuccaucgggaagauguuugaggcuaccgccagaggcgcucgccggauggccauccugggagauacagcgugggacuucggcucuauugggggaguuuuuaccagcgucggcaaacuggugcaucagaucuucgggacagccuacggagugcucuuuuccggcgucagcuggaccaugaagauugggaucggcgugcugcuuacguggcugggacucaauucuagauccaccagccugucuaugacauguauugcuguuggccuggugacccuuuaccucggggucauggugcaggccgauuccggaugcguuaucaacuggaaaggccgcgaacugaagugugggagcggaauuuucgugacaaaugagguccacaccuggacagaacaauauaaguuucaggcugacuccccuaaacggcugucugccgcgaucggcaaggccugggaggagggggugugcggcaucagaagcguuacccgccucgaaaacauuauguggaaacagaucuccaacgagcugaaucauauucuucuggaaaacgacaugaaguucacgguggucgugggagauguggucggcauccucgcucaggggaaaaagaugauucggccgcaacccauggagcacaaauacucuuggaaaagcuggggaaaggccaagaucaucggcgcugacguucagaauacaaccuuuauuaucgaugggccuaacacccccgaauguccugacgaucagagagccuggaauauuugggagguggaggacuauggauucggcaucuuuacaaccaacauuuggcugaagcugcgcgauuccuacacgcaggccugcgaccaccggcuuaugagcgcugcgaucaaagauucuaaggccgugcaugcugacaugggcuauuggaucgaauccgagaaaaaugaaacauggaagcucgccagagccagcuucauugaggucaagaccuguaucuggcccaaaucucacacacugugguccaacggggugcuggaaagcgagaugguuauuccgaagaucuacggaggcccuauuucucaacauaauuaucgccccggguacuucacccagacagcuggaccuuggcaccucggcaaacuggagcuugauuuugaccugugcgaagggaccacgguggucguggaugagcacugcggaaaccggggccccagccucagaaccacaaccguuacaggcaagaucauccaugaaugguguugccgguccuguacccugccuccccugcgcuucaaaggggaggacggaugcugguacggcauggagauuagaccggugaaggaaaaggaggaaaaucuugucaaaagcauggugucugccggguccggagagguugacagcuuuucccucggccugcuguguaucucuauuaugaucgaagaggugaugcggagcagauggucccgcaagaugcucaugacggggacacuggcggucuuccuucugcucauuaugggacagcugaccuggaacgaucugauccggcuuugcauuauggugggcgcuaaugccucugacagaaugggcauggggacaaccuaucuggcccucauggcuaccuuuaaaaugcgcccuauguucgccgugggacugcucuuuagacggcugacaagccgcgagguccuucugcucacgaucggccugucccugguugcgucuguggaaauccccaacagccuugaggaacugggggauggacucgcuaugggcauuaugauccugaagcuccugaccgacuuccaaucccaccagcuuugggccacacugcucagccugaccuuuauuaaaacaacccugucucuucauuacgccuggaagacgauggcuauggugcuguccaucgucagccucuucccccugugucucucuacaaccucccagaagaccacauggcugccugugcuucuggggagccugggaugcaaaccgcucaccauguuucugauugccgagaauaagaucuggggcagaaaaucuuggccccuuaacgaaggcaucauggcuguugggguggucuccauucugcucagcucccugcucaagaacgaugugccucuggccggaccccuuaucgcgggcgggaugcugauugccuguuauguuaucagcggaucuagcgcugaccugucccucgagaaagccgcugaggugucuugggaagaggaagccgagcacagcggcgccucccauaauauucuggucgaagugcaggaugacgggacaaugaagaucaaagaugaggagcgggacgauacgcuuaccauccugcucaaggcuacacugcucgcggucucuggaguguacccucugagcauucccgccacccuuuucguuugguauuuuuggcaaaagaaaaagcagcgcuccggcgugcugugggacacaccuucucccccggaagucgagagagcugugcuggaugacggcaucuaccggauuaugcagcgcgggcuccugggaagaagccagguuggcgugggggucuuccaagaaaacguguuccacaccauguggcacgugacgcggggagccguucuuauguaucagggcaaacgccuggagccuuccugggccagcgucaagaaagaccucaucucuuacgggggaggcuggagacugcagggcuccuggaauaccggggaggaaguccaggugauugcugucgagcccggaaagaacccuaagaaugugcaaacagcccccggcaccuuuaaaacaccggaaggggagguuggagcgaucgcucucgauuucaagccuggcaccagcgggucucccauugugaaccgggaaggaaaaaucgucggccuguacggcaauggggugguuacaacguccggaaccuaugugagcgccaucgcccaggcuaaggccucccaggagggcccucuucccgagauugaagacgaggucuuuagaaaacgcaaccugacaaucauggaucugcaucccgggucuggaaagacccggagauaccucccugcgauugugcgcgaagcuaucaagcggaaacugagaacccuuauucuggccccgacacgcguuguggccagcgagauggcugaagcccucaagggcaugcccauccgguaucaaacgaccgcugucaaauccgagcacacagggaaggagaucguggaccugaugugccaugccaccuucacaaugagacugcucagcccugugcgcguccccaauuacaacaugauuaucauggaugaagcgcacuuuaccgacccuucuuccauugccgcucggggcuauaucagcacgagaguuggaaugggcgaggccgcugccauuuucaugacagccacacccccugggucuguggaggcuuuuccgcagagcaaugcggugauccaggaugaggaacgggacauccccgagcgcuccuggaacucuggauacgaguggauuaccgauuucccuggcaaaacagucugguuugugcccagcaucaaguccgggaaugacauugccaacugucuuagaaagaauggaaaacggguuauccagcugucucgcaagaccuucgauacagaauaucagaagaccaagaacaacgacugggacuacguggucacgacagauauuagcgagaugggcgcuaauuuuagagccgaccgggugaucgauccuagacgcugccugaaacccguuauucucaaggacgggccggaacgggugauccuggccggcccuaugcccgucaccguggcuuccgccgcgcagagacgcggacggaucggcagaaaccauaauaaggagggggaucaguacauuuauaugggacagccccuuaacaaugacgaggaucacgcucacuggacagaagccaaaaugcugcucgacaacaucaauaccccugagggcauuauccccgcccuguucgaaccugagcgcgaaaagagcgcugccauugauggggaguaccggcugagaggagaggcgcgcaaaacguucgucgaacucaugagacggggcgaccuuccgguguggcugucuuauaagguugccuccgagggguuucaauacagcgaucgcagauggugcuucgacggcgaacggaacaaucaggugcuggaggaaaacauggauguggagaucuggaccaaagagggagaacgcaagaaacucagaccccgguggcuggacgcuagaacauauuccgacccucuugcccugcgcgaguuuaaggaguucgcugccggccggagaucugucagcggggaucucauccuggagauuggaaagcugccccagcaucucacccagcgcgcucaaaaugcccuugacaaccugguuaugcugcacaauuccgaacagggcgggcgggcguacagacaugccauggaggagcucccugauacaaucgaaacccugaugcuucuggcucucauugccgugcugacaggaggcgugacccuguuuuuccucucuggccgggggcuuggaaaaacgagcaucggccugcugugugucauggcuuccagcgugcuccuguggauggccucuguugagccccacuggauugccgcuuccaucauccuugaauuuuuccugauggugcuccugauuccggagccugaccgccagagaacaccccaggauaaccaacuggcguaugucgugaucgggcuccuuuuuaugauucugaccgucgccgcuaaugagaugggacugcucgaaaccacaaagaaagaccugggcaucgggcacguggccguugagaaccaucaccaugccaccaugcuugauguggaccugcacccugcuagcgccuggacacucuacgcggucgccacgaccauuaucacacccaugaugcggcauaccauugaaaacacaaccgcuaauaucucucugacggccaucgcuaaccaggccgcgauucugaugggacucgauaagggcuggccuaucuccaaaauggacauuggcgugccccuucuggcccuggggugcuacagccagguuaauccgcucacccugacagcugccgugcuuaugcuggucgcucacuaugccaucauuggaccuggccuccaagcuaaggccacccgcgaggcgcagaagagaacagccgcugggaucaugaaaaaccccaccguggauggaaucguggccauugaccuggaucccguugucuacgacgcuaaguucgaaaaacagcugggccagaucaugcuccuuauucuguguacgucucaaauccugcucaugcggacaaccugggcccugugcgagagcauuacacuugccaccgggccucugaccacacucugggagggauccccgggcaaguuuuggaauacgaccaucgcggugucuauggcuaacaucuuccgcggcagcuaucuggccggggcuggacuggccuuuucccucaugaaaagccuuggcgggggaagacggggcacaggggcccagggagaaacccugggcgagaaguggaagcgccagcugaaucagcucuccaaaucugaguucaacauuuacaagagaagcggcaucauggagguggaccgguccgaagcuaaagaggggcugaagagaggagagacaacccgccacgccgucucucggggcacggcgaaacuuagaugguucguugaacgcaaucuggugaagcccgaggggaaggugauugaucucggauguggcagagggggauggagcuauuacugcgccggccugaaaaaggucacagaagugaaaggcuauaccaaagggggaccuggccaugaggaacccaucccuauggcuaccuacggguggaaccugguuaaacuccacuccggaaaggacguguuuuucacacccccugagaaaugugauacccuucugugcgacauuggcgagucuagcccgaaucccacaaucgaagaggggagaacgcugcgcguccucaagaugguggaaccuuggcugcggggaaaccaauuuuguauuaagauccuuaaucccuacaugccuuccguuguggagacccuggagcagaugcagagaaaacauggcggcaugcucguccgcaacccccugagcagaaauucuacacacgaaauguauuggguguccugcgggaccggaaacaucgugagcgccgucaauaugacaucuagaaugcugcucaaccgcuucaccauggcucaccggaagccgacguacgagagagauguugaccugggcgccgggacccgccauguggcgguggaaccugaggucgccaaccuugauauuaucggacagagaauugaaaauaucaaacacgagcauaaguccacauggcacuaugacgaggauaaccccuacaaaaccugggcuuaucauggcagcuacgaagugaagcccucuggguccgccagcuccaugguuaauggaguggucaagcugcucacaaaaccuugggacgugauucccaugguuacccaaaucgcuaugacagauaccacgccuuuuggccagcagcggguguucaaggagaaagucgacacacgcaccccgaaggccaaaagaggcaccgcucaaaucauggaagugacagcccgguggcuguggggguuucuuagcagaaacaagaagccccggauuuguacgcgcgaggaguucaccagaaaaguucggucuaaugcggccaucggagcuguguuugucgacgagaaccaguggaauagcgccaaggaggcuguggaagaugagcgcuucugggaccugguccagaaagaaagagagcuccacaagcagggcaaaugcgccacaugcguguauaacaugauggggaagcgggaaaagaaacugggagaguuuggcaaggccaaagggucccgcgcgauuugguacauguggcugggcgcuagauuccucgaguuugaagcccugggauucaugaaugaggaucacugguucucucgggaaaacagccuuuccggcguugagggggagggacugcauaagcucggcuacauccugcgcgacauuucuaaaaucccugggggaaauauguaugccgaugacaccgcuggcugggauacaagaaucaccgaagacgaucuucaaaacgaggccaagauuacagacaucauggaacccgagcacgcucugcucgccaccagcauuuuuaaacugacguaccagaauaaggugguccgggugcagcgcccugcgaagaacgggaccgugauggauguuaucuccagacgggaccagcgcggcucuggacaagugggcacauaugggcugaauaccuucacaaacauggaagcccagcucauuagacagauggagagcgagggaaucuuucugcccuccgaacuugagaccccgaaccuggcugaacggguccucgauuggcuggagaaacauggcguggaaagacuuaagcgcauggccaucagcggggacgacuguguugugaaaccuauugaugaccgguucgcuacggcccugacagcgcucaaugauaugggaaaggucagaaaagacaucccccagugggagccuucuaagggcuggaacgauuggcaacaggugcccuuuugcucccaccacuuccaucagcugauuaugaaggacgggcgcgagaucgucgugccuugucggaaucaggaugaacugguuggcagagcccgcgugagccaaggagcuggcuggucucuccgggagaccgccugccuggggaaauccuacgcucagauguggcagcuuauguauuuucacagacgcgaccugcggcucgccgcuaacgccauuuguagcgcgguccccguggauuggguuccgacauccagaaccacguggucuauccaugcccaccaucaauggaugaccacagaagacaugcugagcguguggaaucgcgucuggauugaggaaaacccuuggauggaggauaagacccacguguccagcuggggagacgugcccuaccuuggcaaacgggaggaccaguggugcgggucucugaucggacucacagcuagagccaccugggccuccaauauccagguugcuauuaaccagguccggagacugaucggcaaugaaaacuaucuggauuacaugacaagcaugaagcgcuucaaaaaugagggggaccccgaaggcgcccucugguga

SEQ ID NO: 18970 - RNA, 9879 nt, Artificial Sequence
  derived and/or modified CDS sequence (opt5) from DENV-1__FJ410273__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaauaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuucuaccgagauccagcucacagacuacggcgcccugacccuggauuguagcccccggacaggccucgacuucaacgaaauggugcugcuuaccaugaaggagaaaagcuggcugguccauaagcagugguuucucgaucugccucuucccuggacguccggggcuucuacaagccaagagaccuggaaucgccaggaccugcucgugacauucaaaaccgcgcacgccaagaagcaggaagucgugguucugggaucccaagagggcgcuaugcacaccgcccugacaggggccacggaaauucagaccagcggaacaaccacaaucuuugcuggccaucucaaaugcagacugaagauggauaaacuuacccugaaggggaugucuuaugugauguguacgggcuccuucaaacucgagaaggaagucgccgagacacagcacggaaccgugcugguucagauuaaguacgagggcaccgacgcgccgugcaaaaucccuuucagcacacaagaugaaaagggggugacccagaacggacggcugaucacagcuaaucccauugucacggacaaagagaagccugugaacaucgaagccgagccgcccuuuggcgagucuuauauugugaucggggccggagaaaaagcucuuaagcucagcugguucaagaaaggcuccucuauugggaagauguuuguugccaccgcuagaggcgcccgccggauggcgauccugggagauacagccugggacuucggcagcaucgggggagucuuuaccuccgugggcaaacuggugcaucagauuuucgggacagcuuacggaguccucuuuagcggcgugucuuggaccaugaagaucgggauuggcguucugcuuacguggcugggacucaauuccagaagcaccucucuguccaugacauguaucgccgugggccuggucacccuuuaccucggggugaugguucaggcugauagcggaugcgugauuaacuggaaaggccgcgagcugaaguguggguccggaaucuucgucacaaaugaagugcacaccuggacagagcaauauaaguuucaggccgacucuccuaaacggcugagcgcggccauuggcaaggcuugggaagaggggguuugcggcaucagauccgccacccgccucgagaacaucauguggaaacagauuucuaacgaacugaaucauauccuucuggagaacgacaugaaguucacgguggucgugggagauguggcuggcauucucacacaggggaaaaagaugauccggccgcaacccauggaauacaaauauagcuggaaguccuggggaaaggccaaaauuaucggcgccgacguccagaauaccaccuuuaucauugaugggccuaacacacccgaguguccugacgaucagagagcuuggaauaucugggaaguugaggacuacggauucggcauuuuuaccacgaacaucuggcugaagcugcgcgauagcuauacacaggugugcgaccaccggcuuaugucugcggccauuaaagauuccaaggcugugcacgccgacaugggcuacuggaucgagagcgagaagaaugagaccuggaagcucgccagagcuucuuucaucgaagucaagacauguauuuggcccaaaucccauacccuguggagcaacggggugcuggagucugaaaugaucauuccgaagaucuauggaggcccuauuagccaacacaauuaccgccccggguacuucacacagaccgccggaccuuggcaucucggcaaacuggagcuugauuuuaaccugugcgaggggacgaccguuguggucgacgaacacugcggaaaucggggccccucccucagaacaaccacagugaccggcaagaucauccacgagugguguugccggagcuguacgcugccuccccugcgcuucaaaggggaagauggaugcugguauggcauggagauuagaccgguuaaggagaaggaagagaaccuugugaaaucuauggucuccgcggggagcggagaaguggacuccuuuucucucggccugcuguguaucagcauuaugaucgaggaaguuaugcgguccagauggucucgcaagaugcucaugacagggacccuggcuguguucuuucuucugauuaugggacagcucacauggaaugaccugauccggcugugcauuauggucggcgccaacgccagcgauagaaugggcauggggaccaccuaccuugcucugauggccacauucaaaaugcgcccuaugcucgcggugggacugcucuuuagacggcugacgucccgcgaggugcuucugcucaccaucggccugucucuggucgcuagcguugagcuucccaauucccuggaagaacucggggacggacuggccaugggcaucaugauucucaagcugcuuacagauuuccaaagccaucagcugugggccacccuccugucucugacauuuaucaaaaccacguauucccuucacuacgcuuggaagacaauggccauggugcugagcauugugucucucuucccccugugucucuccaccaccagccagaagacaaccuggcugccuguccuucuggggucucugggaugcaaaccgcucacaauguuucugaucgcugaaaacaagauuuggggcagaaaauccuggccccuuaacgagggcaucauggccguggggaucguuagcauucugcucuccagccugcucaagaaugacgugccucuggcgggaccccuuaucgccggcgggaugcugauugcuuguuaugucaucucuggaagcuccgccgaucugucucucgaaaaagcugccgaggugagcugggaggaagaggccgaacauuccggcgcuucucacaacauucugguugaggugcaggacgaugggacgaugaagaucaaagacgaggaacgggaugacacccuuacaauccugcucaaggcgacccugcucgccgucagcggaguguacccucuguccauucccgcuacacuuuucgucugguauuuuuggcaaaagaaaaagcagcgcucuggcgugcugugggauaccccuuccccucccgagguugaaagagccgugcuggacgauggcaucuaccggauuaugcagcgcgggcuccugggaagaucccaggucggcguggggguuuuccaagagaauguguuccauacgauguggcacgucacccggggagccgugcuuauguaccagggcaaacgccuggaacccagcugggcuucugugaagaaagaccucaucuccuaugggggaggcuggagacugcagggcagcuggaacacaggggaggagguucaggucauugccguggaacccggaaagaauccuaagaacgugcaaaccgcgcccggcacauuuaaaaccucugagggggaagucggagcuaucgcccucgacuucaagccgggcacauccgggagcccuauugugaaucgggagggaaaaaucguuggccuguacggcaacgggguggucacgaccuccggaacauaugugucugccaucgcucaggccaaggcgagccaggaaggcccccuuccugagauugagaaugaaguuuuuagaaaacgcaaccugaccaucauggaucugcaccccggguccggaaagacccggagauaccuccccgcuauugugcgcgaggccaucaagcggaaacugagaacacuuauucuggccccuacgcgcgucguggcuagcgaaauggccgaggcucucaagggcaugccgauccgguaucaaaccacagccguuaaaucugaacauaccgggaaggagaucguggaccugaugugccacgcgacauucaccaugagacugcucucccccguccgcgugccuaauuacaacaugauuaucauggaugaggcccauuuuacggaccccagcucuauugcugcccggggcuauaucagcacaagagugggaaugggcgaagcugccgccauuuucaugaccgcuaccccucccggguccgucgaggcguuuccucagucuaaugccguuauccaggaugaggaacgggacaucccggaacgcagcuggaacuccggauacgaguggauuacagauuuccccggcaaaaccgugugguuugugccuucuaucaagagcgggaaugacauugcuaacugucuuagaaagaacggaaaacgggucauccagcugucccgcaagacauucgauaccgaguaccagaaaacgaagaauaacgacugggauuaugugguuacaaccgacauuagcgaaaugggcgccaauuuuagagccgaccgggugaucgaucccagacgcugccugaaaccugucauucucaaggacgggcccgagcgggugauccuggcuggcccgaugccuguuacaguggccucugcggcucagagacgcggacggaucggcagaaaccacaauaaggaaggggaucaguacauuuauaugggacagccccuuaacaaugacgaggaucaugcccacuggaccgaggccaaaaugcugcucgacaacaucaauacgcccgaaggcauuaucccugcucuguucgagcccgaacgcgagaaguccgccgcgauugauggggaauaccggcugagaggagaggcccgcaaaaccuucgucgagcucaugagacggggcgaccuuccuguguggcugagcuauaaggucgcuuccgaaggguuucaauacucugaucgcagauggugcuucgacggcgagcggaacaaucaggugcuggaagagaacauggauguugaaaucuggacaaaagagggagagcgcaagaaacucagaccgcgguggcuggacgccagaaccuauagcgauccccuugcucugcgcgaauuuaaggaguucgccgcuggccggagauccgugucuggggaccucauccuggaaauuggaaagcugccucagcaccucacacagcgcgcccaaaaugcgcuugacaaccuggugaugcugcauaauagcgagcagggcgggcgggccuacagacacgcuauggaggaacuccccgauaccaucgagacacugaugcuucuggcccucauugcuguccugaccggaggcguuacgcuguuuuuccucuccggccgggggcuuggaaaaacaagcaucggccugcugugugugauggccucuuccgugcuccuguggauggccagcgucgaaccucauuggauugcugcgucuaucauccuugaguuuuuccugauggugcuccugauucccgaaccggaccgccagagaaccccucaggauaaccaacuggccuacguugugaucgggcuccuuuuuaugauucugaccgucgcugccaacgagaugggacugcucgagacaaccaagaaagaccugggcaucgggcacguggccgucgaaaaucaccaucacgcugccaugcuugauguggaccugcaucccgcguccgccuggacacucuaugcuguugccacgaccauuaucacaccuaugaugcggcacaccauugagaacacaaccgcuaauaucagccugacggccaucgcgaaccaggccgcuauucugaugggacucgauaagggcuggcccaucucuaaaauggacauuggcgugccucuucuggcccuggggugcuacagccaggucaauccccucacccugacagcugccgugcuuaugcugguugcucauuaugccaucauuggaccgggccuccaagcgaaggccacccgcgaagcucagaagagaacagccgcugggaucaugaaaaacccuaccguggauggaaucgucgccauugaccuggaucccgugguguacgacgccaaguucgagaaacagcugggccagaucaugcuccuuauucuguguacgucccaaauccugcucaugcggacaaccugggcgcugugcgaaucuauuacacuugcuaccgggccccugaccacacucugggagggaagcccuggcaaguuuuggaauacgaccaucgccguuuccauggcuaacaucuuccgcggcagcuaucuggccggggccggacuggcuuuuucccucaugaaaucucuuggcgggggaagacggggcacaggggcccagggagagacccugggcgaaaaguggaagcgccagcugaaucagcucagcaaauccgaguucaacacauacaagagaucuggcauuauggaagucgaucggagcgaggcgaaagaagggcugaagagaggagagaccacgaaacacgccgugucccgcggcacagcuaaacuucggugguucguggagagaaaucuggucaagccggaagggaaaguuaucgaccucggauguggccgcgggggauggucuuauuacugcgccggccugaagaaagugaccgaggugaagggcuacaccaaagggggacccggccacgaggagccuauucccauggcuacauauggguggaaccuggucaagcuccauagcggaaaagacguguuuuucaucccucccgaaaagugugauacccuucugugcgacauuggcgaguccagcccuaauccgacaaucgaggaagggcggacgcugagaguucucaagaugguggagcccuggcugcgcggaaaccaauuuuguauuaaaauccuuaauccuuacaugcccucugucguggaaacccuggagcagaugcagcggaagcacggcggcaugcucguuagaaacccucugucccgcaauagcacacaugagauguauugggugucuugcgggaccggaaacaucgucuccgccgugaacaugacaagccggaugcugcucaauagauucaccauggcgcaccgcaaacccacguacgaacgggauguggaccugggcgccgggaccagacacgucgcuguugagccggaaguggccaaccuugauauuaucggacagcgcauugagaauaucaagcaugaacacaaaucuacauggcauuaugacgaggauaacccuuacaagaccugggcuuaucacggcuccuacgaggugaagcccagcggguccgccagcucuauggucaauggagugguuaaacugcucacaaagcccugggacgugauuccuauggucacccaaaucgcuaugacagauaccacgcccuuuggccagcagagaguguucaaagaaaagguugacacacggaccccuaaagccaagcgcggcaccgcgcaaaucauggaggugacagccaaguggcuguggggguuucuuagcagaaacaaaaagccgcggauuuguacgagagaagaguucacccggaaaguccgcuccaaugcugccaucggagcuguguuuguugaugaaaaccaguggaacucugccaaggaggccguggaggacgaaagauucugggaccugguccaucgggagcgcgaacuccacaaacagggcaagugcgcgacaugcguguacaacaugauggggaagagagagaaaaagcugggagaauuuggcaaagcuaaggggagccgggccauuugguauauguggcugggcgcccgcuuccucgaguuugaggcucugggauucaugaaugaagaucacugguucuccagagagaacucucuuagcggcgucgaaggggagggacugcauaaacucggcuacauccugcgggacauuuccaagauccccgggggaaauauguaugccgaugacaccgcuggcugggauacacgcaucaccgaggacgaucuucagaacgaagccaaaauuacagacaucauggagccugaacacgcgcugcucgccaagucuauuuuuaagcugaccuaccaaaauaaagugguuagagugcagcggcccgcuaagaacgggacggucauggaugugaucagccgcagagaccagcggggcuccggacaggugggcaccuaugggcugaacacauucaccaauauggaggcccaacucauucgccagauggaaagcgagggaaucuuuucuccuuccgagcuggaaacacccaaccuugcuggcagaguucuggauuggcucgagaaacaugggguggaacggcugaagagaauggccaucagcggagacgauugugucgugaaaccgauugacgaccgcuucgcgaccgcccuuacggcucugaaugauaugggcaagguucggaaggacaucccucagugggagcccucuaaaggguggaacgauuggcagcaagugccuuuuugcucccaccacuuccaucagcucauuaugaaggacggcagagaaaucgucgugcccugucgcaaucaggaugagcuggucggacgggccagagugagccagggcgcuggguggucccugcgcgagacagccugccucggaaaaucuuacgcucaaauguggcagcugauguauuuucaccggagagaccuucgccuggccgcgaacgccauuuguagcgcuguuccuguggauuggguccccaccucccggacaaccuggagcauccaugcccaccaucaguggaugacgaccgaagacaugcucucuguguggaauagaguuuggauugaggaaaacccguggauggaggauaagacacacaucuccagcuggggcgacgugccuuaccuggggaaacgcgaagaucaauggugcggaucucuuaucggccugaccgcccgggcuacaugggccaccaauauucaggucgcgaucaaccaggugagacggcucauugggaaugagaacuaccuggacuauaugacaagcaugaagagauucaagaaugaguccgaccccgaaggcgcucugugguga

SEQ ID NO: 18971 - RNA, 9879 nt, Artificial Sequence
  derived and/or modified CDS sequence (opt5) from DENV-1__FJ410276__SS-prME
uccgugaccauguuccugaugcucaugcccaccgcccuggcuuuucaccuuacgaccagaggcggggaaccucauaugaucguguccaagcaggaacggggaaaaucucuccuguucaagacaagcgccggcguuaacaugugcacccugauugcgauggaccuuggggaacugugugaagauacaaugaccuacaaaugcccgagaaucacagagaccgaacccgacgauguggacuguuggugcaaugcuacggauaccugggugacauauggaaccuguucccaaacaggcgagcacagacgggacaagcgcucugucgcccucgccccucauguggggcugggacuggagaccagaacggaaacauggaugagcuccgagggcgcuuggaaacagauucagcggguugaaaccugggcccuccgccaccccggcuuuacagugaucgcucuguuccuugcccaugcgauugggaccucuaucacccagaagggaaucauuuuuauccugcucaugcuggucacaccuagcauggccaugagaugcgugggcauugggucccgggauuucguugagggacuuagcggcgcuacguggguggacgucgugcuggagcacgggucuugugugaccacaauggccaaggauaaacccacccucgacaucgaacugcugaagacagaggucaccaacccugcuguucuccgcaaacugugcauugaagccaagaucuccaauacgacaaccgauagcagauguccgacccaaggagaggcgacacuuguggaagaacaggacgccaacuuugugugccggcgcaccuucgucgauagaggcuggggcaauggguguggacuguuuggcaaagggucucucauuacaugcgcuaaguucaagugcgugacgaaacuggagggaaagaucguucaguacgaaaaccuuaaauauuccgugaucgucaccgugcacacaggcgaccagcaucaaguugggaaugagagcaccgaacacggaacaaccgccacgauuacaccccaagcuccuacaaccgagauccagcugacagacuacggcgcccucacccuggauuguucuccccggacgggccuggacuuuaacgaaauggugcuccugacaaugaaggagaaauccuggcuuguccauaagcagugguuccuggaucucccucugcccuggaccagcggggccuccacaucucaagagaccuggaaucgccaggaccuucuggugaccuuuaaaacagcucacgcgaagaagcaggaagucgugguucucggaagccaagagggcgccaugcacacggcucugaccggggccacagaaauucagaccuccggaacaaccacgaucuucgccggccaucugaaaugcagacucaagauggauaaacugacacuuaaggggaugagcuaugugauguguaccggcucuuucaaacuggagaaggaacucgcugagacccagcacggaacaguccuggugcagauuaaguacgagggcaccgacgccccgugcaaaaucccuuuucugacacaagaugaaaaggggguuacgcagaacggacggcuuaucaccgcgaaucccauugugacagacaaagagaagccugucaacaucgaagcugagccgcccuucggcgaguccuauauugugaucggggccggagaaaaagcccucaagcugagcugguuuaagaaaggcucuagcauugggaagauguucgaggcuaccgccagaggcgcucgccggauggccauccugggagauacagcgugggacuuuggcuccaucgggggaguguucaccucuguuggcaaacucguccaucagauuuuugggacggccuacggagugcuguucagcggcguguccuggaccaugaagaucgggauuggcguccuucugacauggcucggacugaauagcagaucuaccucccugagcaugacauguaucgcugugggccuuguuacccucuaccugggggugaugguccaggccgauucuggaugcgugauuaacuggaaaggccgcgaacugaaguguggguccggaaucuuuguuacaaaugaggugcacaccuggacggaacaauauaaguuccaggcugacagcccuaaacggcucuccgccgcgauuggcaaggccugggaggagggggucugcggcaucagaucugcuacacgccuggaaaacaucauguggaaacagauuagcaacgagcuuaaucauauccugcucgaaaacgacaugaaguuuaccgugguugugggagaugucgccggcauucuggcucaggggaaaaagaugauccggccgcaacccauggaguacaaauauuccuggaagucuuggggaaaggccaaaauuaucggcgccgacgugcagaauaccacauucaucauugaugggccuaacacccccgaauguccugacgaucagagagcuuggaauaucugggagguggaggacuacggauuuggcauuuucacgacaaacaucuggcugaaacuucgcgauagcuauacccaggucugcgaccaccggcucauguccgcggccauuaaagauagcaaggcuguucacgccgacaugggcuacuggaucgaaucugagaaaaaugaaacauggaagcuggccagagcuuccuucaucgaggugaagaccuguauuuggcccaaaagccauacacuguggucuaacggggugcucgaauccgagaugaucauuccgaagaucuauggaggcccuauuagccaacacaauuaccgccccggguacuuuacccagacggccggaccuuggcaucugggcaaacuugagcuggauuucgaccucugcgaagggaccacagucgugguugaugagcacugcggaaaccggggccccucucugagaaccacaaccgugacgggcaagaucauccacgaaugguguugccggagcuguacacugccuccccuucgcuuuagaggggaggacggaugcugguauggcauggagauucggccggucaaagaaaaggaggaaaaucucgugaaguccaugguuagcgcggggucuggagagguggacuccuucagccugggccugcucuguaucuccauuaugaucgaagaggucaugagaucucgcuggagccggaaaaugcugaugaccgggacacuugcuguguuuuuccugcucauuaugggacagcugaccuggaacgaucugaucagacuuugcauuaugguuggcgccaaugccuccgaccgcaugggcauggggaccacauaccuggcucucauggccacguuuaagaugagaccuauguucgcggugggacugcucuuucggcgccugaccucuagagagguccuucugcucacaaucggccugagccugguggcuuccguggaacuucccaacucucuggaggaacucggggauggacuggccaugggcaucaugauucucaaacugcuuaccgacuuccaaagccaucagcugugggccacacuccugucccugaccuuuaucaagacgacauucagccuucacuaugcuuggaaaaccauggccaugguccugucuauuguuucccucuuuccccugugucucagcaccacaucucagaagaccacauggcugccugugcuucuggggucccugggaugcaagccgcucacgauguuccugaucgcugagaauaaaauuuggggccggcgcagcuggccccuuaacgaaggcaucauggccguggggaucgucucuauucugcucuccagccugcucaagaacgaugugccucuggcgggaccccuuaucgccggcgggaugcugauugcuuguuacguuaucuccggaagcucugccgaccugagccucgagaaagcugccgagguguccugggaagaggaagccgagcauucuggcgcuagccacaauauucuggucgaagugcaggaugacgggaccaugaagaucaaagaugaggagagagacgauacacuuaccauccugcucaaggcgacacugcucgccguuuccggaguguauccucugucuauucccgcuacccuuuucgucugguacuuuuggcagaagaagaagcagcggagcggcgugcugugggacacgccuagcccucccgaagucgagcgcgccgugcuggaugacggcaucuauagaauuaugcagcgggggcuccugggacgcucucagguuggcgugggggucuuccaagaaaacguguuucauaccauguggcacguuacaagaggagccgugcuuauguaccagggcaaacggcuggagcccagcugggcuuccgucaagaaagaccucaucagcuacgggggaggcuggagacugcagggcucuuggaauaccggggaggaaguccaggugauugccguugagcccggaaagaacccuaaaaauguccaaacagcgcccggcaccuucaagacaccggaaggggaggugggagcuaucgcccucgauuuuaagccuggcacguccgggagccccauugugaaccgcgaaggaaaaaucgucggccuguauggcaauggggugguuaccacaucuggaaccuacguguccgccaucgcucaggcccgggcgagccaggagggcccucuucccgagauugaagacgaggucuucagaaagcgcaaccugaccaucauggaucugcaccccggguccggaaaaacacggagauaucucccugcuauugugcgcgaagccaucaagcggaaacugagaacgcuuauucuggccccgacccgcguuguggcuucugagauggccgaagcucucaagggcaugcccauccgguaccaaacaaccgccgucaagagcgagcauacagggaaagagaucguggaccugaugugccacgcgaccuuuacgaugagacugcucuccccuguucgggugcccaauuauaacaugauuaucauggaugaagcccauuucacagacccuagcucuauugcugcccgcggcuacaucuccaccagagucggaaugggcgaggcugccgccauuuuuaugaccgcuacacccccugggagcguggaagcguucccgcagucuaaugccgugauccaggaugaggaacgggacauccccgagcgcagcuggaacuccggauaugaguggauuaccgauuuuccuggcaagacagucugguucguucccucuaucaaaagcgggaaugacauugcuaacugucuuagaaagaauggaaaacgggugauccagcuguccagaaagaccuucgauacggaauaccaaaagaccaagaauaacgacugggacuacguggucaccacagauauuucugagaugggcgccaauuuucgcgccgaccgggugaucgauccuagacgcugccugaagcccguuauucucaaagacgggccggaacgggugauccuggcuggcccuaugcccgucaccguggccagcgcggcucagagacgcggacggaucggcagaaaccacaauaaggagggggaucaguauauuuacaugggacagccccuuaacaaugacgaggaucaugcccacuggacggaagccaaaaugcugcucgacaacaucaauaccccugagggcauuauccccgcucuguucgaaccugagcgcgaaaaguccgccgcgauugauggggaguauagacugcggggagaggcccgcaagacauuuguugaacucaugagacggggcgaccuuccgguguggcugagcuacaaagucgcuucugagggguuccaauauuccgaucgcagauggugcuuugacggcgaacggaacaaucaggugcuggaggaaaacauggaugucgagaucuggaccaaggagggagaacgcaaaaagcuccgcccccgguggcuggacgccagaacauacagcgacccucuugcucugcgcgaguucaaagaauuugccgcuggccggagauccgugucuggggaucucauccuggagauuggaaagcugccccagcaccucacccagcgggcccaaaaugcgcuugacaaccugguuaugcugcauaauagcgaacagggcgggcgcgccuauagacacgcuauggaggagcucccugauacaaucgaaacccugaugcuucuggcccucauugcugugcugacgggaggcgugacacuguucuuucucuccggccgggggcuuggaaaaaccucuaucggccugcugugugucauggccagcuccguucuccuguggauggccagcguggagccccauuggauugcugcgucuaucauccuugaguucuuucugauggugcuccugauuccggagccugaccgccagagaacaccccaggauaaccaacuggccuacgucgugaucgggcuccuuuucaugauucugacaguugcugccaaugagaugggacugcucgaaaccacaaagaaggaccugggcaucgggcacguggccgucgagaaccaccaucacgcugccaugcuugauguggaccugcauccugcguccgccuggacgcucuacgcugucgccaccacaauuaucacccccaugaugcggcacacaauugaaaacaccacggcuaauaucagccugaccgccaucgcgaaccaggccgcuauucugaugggacucgauaaaggcuggccuaucucuaagauggacauuggcgugccccuucuggcccuggggugcuauucccagguuaauccgcucacacugaccgcugccgugcuuaugcuggucgcucauuacgccaucauuggaccuggccuccaagcgaaagccacacgcgaggcucagaagagaaccgccgcugggaucaugaaaaaccccacgguggauggaaucguugccauugaccuggaucccguggucuaugacgccaaguuugaaaagcagcugggccagaucaugcuccuuauucuguguacaagccaaauccugcucaugcggaccacaugggcgcugugcgagucuauuacccuugcuaccgggccucugacaacgcucugggagggaagcccgggcaaauucuggaauaccacaaucgccguguccauggcuaacaucuuccgcggcucuuaccuggccggggccggacuggcuuuuagccucaugaagucccuuggcgggggaagacggggcaccggggcccagggagaaacacugggcgagaaauggaagagacagcugaaucagcucagcaaauccgaguucaacaccuauaagcgcucuggcauuauggagguggaccggagcgaagcgaaggaggggcugaaaagaggagagacgacaaagcacgccguuucccgcggcaccgcuaaacuucggugguuugucgaaagaaaucuggugaagcccgaggggaaagugaucgaucucggauguggccgcgggggauggucuuacuauugcgccggccugaagaaggucaccgaaguuaaaggcuacacaaaagggggaccuggccacgaggaacccauuccuauggcuaccuacggguggaaccuggugaaacuccauagcggaaaggacguguucuuuauucccccugagaaaugugauacacuucugugcgacaucggcgaguccucuccgaaucccacgaucgaagaggggcggacccugagaguccucaagaugguggaaccuuggcugcgcggaaaccaauucuguauuaaaauccuuaaucccuauaugccuagcguuguggagacacuggagcagaugcagcggaagcacggcggcaugcucgucagaaacccccugucccgcaauagcacccaugaaauguacugggugucuugcgggacaggaaacaucguuuccgccgugaauaugaccagccggaugcugcucaacagauuuacgauggcgcaccgcaagccgaccuaugagagagaugucgaccugggcgccgggacacggcacguggcuguggaaccugaggucgccaaccuugauauuaucggacagcgcauugaaaauaucaaacaugagcacaagucuaccuggcauuacgacgaggauaaccccuauaaaacaugggcuuaccacggcuccuaugaaguuaagcccagcgggucugccuccagcauggugaauggaguggucaaacugcucaccaagccuugggacgugauucccaugguuacacaaaucgcuaugaccgauacgacaccuuucggccagcagagaguguuuaaggagaaagucgacacccggaccccgaaggccaaaagaggcacagcgcaaaucauggaagugacggccaaguggcuguggggguuccuuucccggaacaaaaagccccgcauuuguaccagagaggaauuuacacggaagguucgcagcaaugcugccaucggagcuguguucgucgacgagaaccaguggaacucugccaaagaggccguggaagaugagagauuuugggaccugguucaucgggaacgcgagcuccacaagcagggcaaaugcgcgaccugcguguacaacaugauggggaagagagagaaaaagcugggagaguucggcaaggcuaaagggagccgggccauuugguacauguggcugggcgcccgcuuccucgaguuugaagcucugggauucaugaaugaggaucacugguuuuccagagaaaacucucuuagcggcgucgagggggagggacugcauaagcucggcuauauccugcgggacauuuccaaaaucccugggggaaauauguacgccgaugacacagcuggcugggauacccgcaucacagaagacgaucuucagaacgaggccagaauuaccgacaucauggaacccgagcacgcgcugcucgccaagucuauuuucaaacugacguaucaaaauaaggugguccgggugcagcgcccugcuaaaaacgggaccguuauggaugugaucagcagacgggaccagagaggcuccggacaggucggcacauacgggcugaauaccuuuacaaacauggaagcccaacucauucgccagauggagucugagggaaucuucagccccuccgaacuggagaccccgaaccuugcugaacgggugcuggauuggcucgagaaguauggcguggaaagacugaagcgcauggccaucagcggggacgacuguguugugaaaccuauugaugaccgguuugcgacggcccuuacagcucugaaugauaugggaaaggucagaaaagacaucccccagugggagccuucuaagggcuggaacgauuggcagcaagugcccuucugcucccaucacuuucaccagcucauuaugaaagacgggcgcgagaucguugugccuugucggaaucaggaugaacuggucggcagagcccgcgugagccagggagcuggcuggucucugcgggagaccgccugccucgggaaguccuacgcucaaauguggcagcugauguauuuccauagacgcgaccuucggcuggccgcgaacgccauuuguagcgcuguccccguggauuggaucccgacauccagaaccacguggucuauucacgcccaucaccaguggaugaccacagaagacaugcucagcguuuggaaucggguguggaucgaggaaaacccuuggauggaggauaagacccauaucuccagcuggggagacguccccuaccugggcaaaagagaggaccaauggugcgggucucuuauuggacugacagcccgcgcuaccugggccacaaauauccagguggcgauuaaccagguucggagacucaucggcaaugaaaacuaccuggauuauaugaccuccaugaagcgcuuuaaaaaugagagcgaccccgaaggggcucugugguga

SEQ ID NO: 18972 - RNA, 9879 nt, Artificial Sequence
  derived and/or modified CDS sequence (opt5) from DENV-1__FJ410278__SS-prME
agcgugaccaugcugcucaugcugaugcccaccgcccuugcuuuccaccugacgacccggggcggggaaccucauaugaucguguccaagcaggaacggggaaaaucucuccuguuuaagaccagcgccggcguuaacaugugcacccuuauugcgauggaccugggggaacucugugaagauaccaugaccuacaaaugcccccgcaucacagagaccgaacccgacgauguggacuguuggugcaaugcuacggauaccugggugacauauggaaccuguucccaaacaggcgagcaccggcgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccugauuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauuccuauacccaggucugcgaccaccggcuuaugagcgcggccaucaaagauucuaaggcuguucacgccgacaugggcuacuggaucgaauccgagaaaaaugaaacauggaagcucgccagagcuagcuucauugaggugaagaccuguaucuggcccaaaucucauacacugugguccaacggggugcuggaaagcgagaugauuaucccgaagauuuauggaggcccuaucucucaacacaauuaccgccccggguacuucacccaggccgcgggaccuuggcaucucggcaaacuggagcuugauuuugaccugugcgaagggacgaccgucgugguugaugagcacugcggaaaccggggccccagccucagaacaaccacagugaccggcaagaucauucacgaaugguguugccgguccuguacgcugccuccccugcgcuucagaggggaggacggaugcugguauggcauggagauccggccggucaaagaaaaggaggaaaaucuugucaagagcaugguuucugcuggguccggagagguggacagcuuuucccucggccugcuguguauuucuaucaugauugaagaggucaugagaagccgcuggucccggagaaugcucaugacagggacccuggccguguucuuucuucugaucaugggacagcucacauggaacgaucugauucgccugugcaucaugguuggcgccaaugcuucugacagaaugggcauggggaccaccuaccuugcccugauggcgacauucaaaaugcggccuauguuugcugugggacuccuguuccgcagacucacgagccgggagguccugcuucugaccaucggccucucccugguggccucuguggaacugcccaacagccuugaggaacugggggauggacucgccaugggcauuaugauccugaagcuccugacagacuuucaaucccaucagcuuugggcuacccugcucagccugacauucauuaaaaccacguuuucucugcacuaugccuggaagacaauggcuaugguccuuuccaucguuagccuguucccccucugucugucuaccaccucccagaaaacaaccuggcucccugugcugcuugggagccugggaugcaagccgcugacaauguuucucauugccgagaauaagaucuggggccgcagaucuuggccccugaacgaaggcaucauggcgguggggauugucuccauccuucugagcucccuccugaaaaacgaugugccucucgccggaccccugauugcuggcgggaugcuuaucgccuguuacguuauuagcggaucuagcgcugaccugucccuggagaaggccgccgaggugucuugggaagaggaagcugagcauagcggcgcgucccacaauauccucgucgaagugcaggaugacgggacgaugaaaaucaaggaugaggagcgggacgauacccugacaauucuucugaaagccacccuccuggcuguuucuggaguguauccucucagcauccccgccacacuguucgucugguacuucuggcaacgcaagaaacagagauccggcgugcuuugggacaccccuucucccccggaagucgagcgggccgugcuggaugacggcauuuaucgcaucaugcagagagggcugcucggacggagccagguuggcgugggggucuuucaagaaaacguguuccauacgauguggcacguuaccagaggagcugugcugauguaccagggcaagcgccuugagccuuccugggccagcgucaagaaagaccugauuucuuacgggggaggcuggcggcuccagggcuccuggaauacaggggaggaaguccaggugaucgcgguugagcccggaaagaacccuaaaaauguccaaaccgcucccggcacauuuaagaccccggaaggggaggugggagccauugcccuggauuucaaaccuggcacaagcgggucucccaucgugaacagagaaggaaagaucgucggccucuauggcaauggggugguuacgaccuccggaacauacgugagcgcuauugcccaggcgaaggcuucccaggagggcccucugcccgagaucgaagacgaggucuuucgcaaacggaaccuuaccauuauggaucugcaccccgggucuggaaagaccagacgcuaucugccugccaucgugcgggaagccauuaaaagaaagcuccgcacacugauccuugcuccgacgcggguuguggccagcgagauggcugaagcccugaaaggcaugcccaucagauaccaaaccacagcggucaaguccgagcauaccgggaaggagauuguggaccucaugugccacgccacauucaccaugcggcugcugagcccuguucgcgugcccaauuauaacaugaucauuauggaugaagcucauuuuacggacccuucuuccaucgccgcuagaggcuacauuagcacacgggucggaaugggcgaggccgccgcuaucuucaugaccgcgacacccccugggucuguggaagccuuuccgcagagcaaugcugugauccaggaugaggaacgcgacauucccgagagauccuggaacucuggauaugaguggaucacagauuucccuggcaaaaccgucugguuuguucccagcauuaaguccgggaaugacaucgccaacugucuccggaaaaauggaaagagagugauucagcuuucucgcaaaacauucgauaccgaauaccaaaagacgaagaacaacgacugggacuacguggucacaaccgauaucagcgagaugggcgccaauuuccgggcugacagagugauugauccucgccggugccugaaacccguuauccugaaggacgggccggaaagagugauccucgccggcccuaugcccgucacaguggcguccgcugcccagcgccggggaagaauuggccgcaaccacaauaaagagggggaucaguauaucuacaugggacagccccugaacaaugacgaggaucaugcccacuggaccgaagcuaagaugcuucuggacaacauuaauacgccugagggcaucauucccgcccucuuugaaccugagagagaaaagagcgcggccaucgauggggaguaucggcugcgcggagaggcuagaaagaccuucguugagcugaugcggcgcggcgaccucccgguguggcuuucuuacaaggucgccuccgagggguuucaauauagcgauagacgguggugcuucgacggcgaaagaaacaaucaggugcuggaggaaaacauggaugucgagaucuggacaaaagagggagaacgcaagaaacugcggcccagauggcucgacgcucgcaccuacuccgacccucuggcccuucgggaguuuaaggaguucgcugccggcagacggucugugagcggggaucugauucucgagaucggaaaacugccccagcaccugacacagcgcgcgcaaaaugcccucgacaaccuuguuaugcugcauaauuccgaacagggcgggagagcuuaucggcacgccauggaggagcugccugauaccauugaaacacucaugcugcuugcucugaucgccgugcucaccggaggcgugacgcuguuuuuccugucuggccgcgggcucggaaagacaagcauuggccuucugugugucauggccuccagcguucugcucuggauggcuucuguggagccccauuggaucgcggccuccaucauucuggaauuuuuccuuauggugcugcucaucccggagccugacagacagcggacaccccaggauaaccaacuggcuuacgucgugauugggcugcucuuuaugauccuuaccguugccgccaaugagaugggacugcuggaaacaaccaaaaaggaccucggcauugggcacguggcugucgagaaccaccaucacgccgcgaugcuggauguggaccuucauccugccagcgcuuggacacuguacgccgucgcuacgaccaucauuacacccaugaugcgccacaccaucgaaaacacaaccgccaauaucucucucacggcgauugccaaccaggcugccauccugaugggacuggauaagggcuggccuauuuccaaaauggacaucggcgugccccuccuugcucuggggugcuauagccagguuaauccgcugacccucacagccgcugugcugaugcuugucgcccauuacgcgauuaucggaccuggccugcaagccaaggcuaccagagaggcccagaaacggacagcugccgggaucaugaagaaccccaccguggauggaauuguugccaucgaccucgaucccguggucuaugacgcgaaauucgaaaagcagcugggccagauuaugcugcucauccuuuguacgucucaaauucugcugaugcgcacaaccugggcucucugcgagagcaucacacuggccaccgggccucuuaccacacugugggagggauccccgggcaaguuuuggaauacgaccaucgcugugucuauggccaacauuuucagaggcagcuaccucgccggggcuggacuggccuucucccugaugaaaagccucggcgggggacggagaggcacaggggcgcagggagaaacccuuggcgagaaguggaaacgccagcugaaucagcuguccaagucugaauuuaacacauauaaacggagcggcaucauggagguggacagauccgaagccaaggaggggcucaagcgcggagagaccacgaaacacgcuguuucucggggcacagccaagcugagaugguucgucgaacgcaaucuugugaaacccgaggggaaggugauugaucugggauguggcagagggggauggagcuacuauugcgcuggccucaaaaaggucaccgaaguuaagggcuacaccaaagggggaccuggccacgaggaacccaucccuauggccacauacggguggaaccuggugaagcugcauuccggaaaagacguguuuuucauucccccugagaagugugauacccuccuuugcgacaucggcgagucuagcccgaaucccacaauugaagaggggagaacgcugcgcguccugaaaaugguggaaccuuggcuccggggaaaccaauuuuguaucaagauccugaaucccuauaugccuuccguuguggagacccuugagcagaugcagagaaaacacggcggcaugcugguccgcaacccccucagcagaaauucuacacaugaaauguacuggguguccugcgggaccggaaacauuguuagcgcggugaauaugacaucuagaaugcugcugaaccgcuucaccauggcccacagaaagccgacguaugagcgggaugucgaccucggcgcugggacccgccacguggccguggaaccugaggucgcuaaccuggauaucauuggacagagaaucgaaaauauuaagcaugagcacaaauccacauggcauuacgacgaggauaaccccuauaagaccugggccuaccacggcagcuaugaaguuaaacccucuggguccgcuagcuccauggugaauggaguggucaaacuucugacaaaaccuugggacgugauccccaugguuacccaaaucgccaugacagauaccacgccuuuuggccagcagcggguguucaaggagaaggucgacacaagaaccccgaaagcgaagcggggcaccgcccaaauuauggaagugacagcuaaauggcucuggggguuucugagccgcaacaagaaacccagaaucuguacgcgggaggaguucacccgcaagguuagaucuaaugccgcuauuggagccguguuugucgacgagaaccaguggaauagcgccaaggaggcgguggaagaugagcgguucugggaccuuguucaucgcgaaagagagcugcacaaacagggcaagugcgcuacaugcguguacaacaugauggggaaacgggaaaagaaacucggagaguuuggcaaggccaaggggucccgcgccaucugguacauguggcugggcgcuagauuccuggaguucgaagcccucggauuuaugaaugaggaucacugguucucucgggaaaacagccuguccggcgucgagggggagggacuucauaaacugggcuauauucuccgcgacaucucuaagaucccugggggaaauauguacgcugaugacaccgccggcugggauacaagaauuaccgaagacgaucugcagaacgaggcgcggaucacagacauuauggaacccgagcacgcccuucuggcuaaaagcaucuuuaagcucaccuaucaaaauaaagugguccgcgugcagagaccugccaagaacgggacgguuauggaugugauuucccggagagaccagcgcggcucuggacaggucggcaccuacgggcugaauacauucaccaacauggaagcucaacugauccggcagauggagagcgagggaaucuuuucccccagcgaacucgagacaccgaaccuggccgaaagagugcuugauuggcuggagaaauauggcguggaacgccucaagcggauggcgauuucuggggacgacuguguugugaagccuaucgaugacagauucgccaccgcucugacggcccuuaaugauaugggaaaaguccgcaaggacauuccccagugggagccuuccaaaggcuggaacgauuggcagcaagugcccuuuugcagccaucacuuccaccagcugaucaugaaggacgggcgggagauuguugugccuuguagaaaucaggaugaacucgucggccgcgcucgggugucucagggagccggcuggucccugagagagacagcuugccuggggaaaagcuacgcccaaauguggcagcucauguauuuucaucgccgggaccugagacuugcggccaacgcuaucuguuccgccguccccguggauuggauuccgaccucucggacaaccuggagcauccacgcccaucaccaguggaugacgaccgaagacaugcuguccguuuggaauagaguguggaucgaggaaaacccuuggauggaggauaagacacauauuagcucuuggggagacguccccuaccucggcaagcgcgaggaccaauggugcgggucccugaucggacuuaccgcucgggccacaugggcgaccaauauucagguggcuaucaaccagguuagacgccugauuggcaaugaaaacuaccucgauuauaugacaagcaugaaaagauucaagaaugagucugaccccgaaggggcccugugguga

SEQ ID NO: 18973 - RNA, 9879 nt, Artificial Sequence
  derived and/or modified CDS sequence (opt5) from DENV-1__FJ410279__SS-prME
agcgugaccaugcugcucaugcugaugcccacagcccuugcuuuccaccugacgaccagaggcggggaaccucauaugaucguguccaagcaggaacggggaaaaucucuccuguuuaagacaagcgccggcguuaauaugugcacccuuauugcgauggaccugggggaguucugugaagauacaaugaccuacaaaugcccgcgcaucacagaagcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaaguuuacgguuguggucggagauguggcuggcauucuggcccaggggaaaaagaugauccggccgcaacccauggaguacaaauauagcuggaaguccuggggaaaggccaaaauuaucggcgcugacgugcagaauacaaccuucaucauugaugggccuaacacccccgaauguccugacgaucagagagcguggaauaucugggaggucgaggacuacggauuuggcauuuucacaaccaacaucuggcucaagcugcgcgauagcuauacgcagguuugcgaccaccggcugaugucugccgcuauuaaagauuccaaggccgugcacgccgacaugggcuacuggaucgaaagcgagaaaaaugaaacauggaaacuugcuagagccucuuucaucgaggugaagaccuguauuuggcccaaaucccauacacucuggagcaacgggguccuggaaucugagaugaucauuccgaagaucuauggaggcccuauuagccaacacaauuaccgccccggguacuuuacccagacagcgggaccuuggcaucugggcaaacucgagcuggauuucgaccuuugcgaagggaccacggugguuguggaugagcacugcggaaaccggggccccucccugagaaccacaaccgucacaggcaagaucauccacgaaugguguugccggagcuguacccucccuccccugcgcuuuaaaggggaggacggaugcugguauggcauggagauuagaccggugaaggaaaaggaggaaaaucugguuaaaucuaugguguccgcugggagcggagaggucgacuccuucucucuuggccuccuguguaucagcauuaugaucgaagaggugaugcgguccagauggucucgcaagaugcugaugacggggacacucgccgucuuuuuccugcuuauuaugggacagcugaccuggaacgaucucauccggcugugcauuauggugggcgccaaugcuagcgacagaaugggcauggggacaaccuaccuggcccuuauggcgaccuuuaaaaugcgcccuauguucgcugucggacugcucuuuagacggcugacaucccgcgaggugcuccugcuuacgaucggccugucucucguggccagcgucgaacugcccaacucccuggaggaacuuggggauggacuggccaugggcaucaugauucucaagcugcucaccgacuuccaaagccaucagcugugggcuacacuucugucucucaccuuuaucaaaacaaccuucucccugcacuaugccuggaagacgauggcuaugguucugagcauugugucucuuuuuccccugugucucuccacaaccagccagaagaccacauggcugccugugcuccuggggucucuuggaugcaaaccgcugaccauguuccugaucgccgagaauaagauuuggggcagaaaauccuggccccucaacgaaggcaucauggcggucgggaucgugagcauucugcuuuccagccugcucaagaacgauguuccucuggccggaccccucaucgcuggcgggaugcugauugccuguuacgugaucucuggaagcuccgcugaccuuucucuggagaaagccgccgaggucagcugggaagaggaagcugagcauuccggcgcgucucacaauauucugguggaaguucaggaugacgggacaaugaagaucaaagaugaggagcgggacgauacgcucaccauccugcuuaaggccacacugcucgcugugagcggagucuauccucuguccauucccgccacccucuuccugugguacuuuuggcaaaagaaaaagcagcgcucuggcgugcuuugggacacaccuuccccucccgaagucgagagagccgugcuggaugacggcaucuaucggauuaugcagcgcgggcugcucggaagaucccagguuggcgugggggucuuccaagaaaacguguuucauaccauguggcacguuacgcggggagcugugcugauguaccagggcaaacgccuugagcccagcugggccucugucaagaaagaccugaucuccuacgggggaggcuggagacuccagggcagcuggaauaccggggaggaaguccaggugauugcgguugagcccggaaagaacccuaagaauguccaaacagcucccggcaccuucaaaacaucugaaggggaggugggagccaucgcccuggauuuuaagccgggcaccuccgggagcccuauugugaaccgggaaggaaaaaucgucggccucuauggcaauggggugguuacaacguccggaaccuacgugucugcuaucgcccaggcgaaggcuagccaggagggcccccugccugagauugaagacgaggucuucagaaaacgcaaccuuacaaucauggaucugcaccccggguccggaaagacccggagauaucugcccgccauugugcgcgaagccaucaagcggaaacucagaacccugauucuugcuccuacacgcguuguggccagcgagauggcugaagcccugaagggcaugccgauccgguaccaaacgaccgcggucaaaucugagcauacagggaaggagaucguggaccucaugugccacgccaccuuuacaaugagacugcugucccccguucgcgugccuaauuauaacaugauuaucauggaugaagcucauuucaccgaccccagcucuauugccgcucggggcuacaucagcacgagagucggaaugggcgaggccgccgcuauuuuuaugacagcgaccccucccggguccguggaagccuucccucagucuaaugcugugauccaggaugaggaacgggacaucccggagcgcagcuggaacuccggauaugaguggauuaccgauuuucccggcaaaacagucugguucguuccuucuaucaagagcgggaaugacauugccaacugucucagaaagaauggaaaacgggugauccagcuuucccgcaagaccuucgauacagaauaccagaagaccaagaacaacgacugggacuacguggucacgacagauauuagcgagaugggcgccaauuuuagagcugaccgggugaucgaucccagacgcugccugaaaccuguuauucugaaggacgggcccgaacgggugauccucgccggcccgaugccugucaccguggcgucugcugcccagagacgcggacggaucggcagaaaccacaauaaggagggggaucaguauauuuacaugggacagccccugaacaaugacgaggaucaugcccacuggacagaagcuaaaaugcuucuggacaacaucaauacccccgagggcauuaucccugcccucuucgaacccgagcgcgaaaaguccgcggccauugauggggaguaucggcugagaggagaggcucgcaaaacguuuguugaacugaugagacggggcgaccucccuguguggcuuagcuacaaggucgccuccgagggguuccaauauucugaucgcagauggugcuuugacggcgaacggaacaaucaggugcuggaggaaaacauggaugucgagaucuggaccaaagagggagaacgcaagaaacugagaccgcgguggcucgacgcuagaguguacagcgacccccuggcccuucgcgaguucaaggaauuugcugccggccggagauccguuucuggggaucugauccucgagauuggaaagcugccucagcaccugacacagcgcgcgcaaaaugcccucgacaaccuugugaugcugcauaauagcgaacagggcgggcgggcuuauagacacgccauggaggagcugcccgauaccaucgaaacacucaugcugcuugcucugauugccgugcucaccggaggcgucacacuguucuuucuguccggccgggggcucggaaaaaccagcaucggccuucuguguguuauggccucuuccgugcugcucuggauggcuagcguggagccucauuggauugcggccucuaucauccuggaguucuuucuuaugguccugcucauucccgagccggaccgccagagaacgccucaggauaaccaacuggcuuacgugguuaucgggcugcuguucaugauucuuacaguggccgccaaugagaugggacugcuggaaaccaccaagaaagaccucggcaucgggcacgucgcuguggagaaccaccaucacgccgcgaugcuggaugucgaccuucaucccgccuccgcuuggacacuguacgccguggcuaccacaauuaucacgccuaugaugcggcacaccauugaaaacacaaccgccaauaucagccucacagcgaucgccaaccaggcugccauucugaugggacuggauaagggcuggcccaucucuaaaauggacauuggcguuccucuccuugcucuggggugcuauagccaggugaauccccugacccucacggccgcuguccugaugcuuguggcccauuacgcgaucauuggaccgggccugcaagccaaggcuacccgcgaggcccagaagagaacagcugccgggaucaugaaaaacccuaccguugauggaaucguggccauugaccucgaucccgucguguaugacgcgaaguuugaaaaacagcugggccagaucaugcugcucauucuuuguacaucccaaauccugcugaugcggaccacgugggcucucugcgagucuauuacacuggccaccgggccccuuacaacccugugggagggaagcccuggcaaguucuggaauaccacaaucgcuguguccauggccaacaucuuccgcggcagcuaccucgccggggcuggacuggccuuuucccugaugaaaucucucggcgggggaagacggggcacgggggcgcagggagaaacccuuggcgagaaguggaagcgccagcugaaucagcugagcaaauccgaguucaacacauauaagagaucuggcauuauggagguugaccggagcgaagccaaagaggggcucaagagaggagagaccacaaaacacgcugucucccgcggcaccgccaagcugcggugguuuguggaaagaaaucuugugaagccggaggggaaagucaucgaucugggauguggccgcgggggauggucuuacuauugcgcuggccucaagaaaguuacggaagugaagggcuacacaaaagggggacccggccacgaggaaccuauucccauggccaccuacggguggaaccuggugaagcugcauagcggaaaagacgucuucuuuaucccucccgagaagugugauacccuccuuugcgacauuggcgaguccagcccuaauccgacaaucgaagaggggcggacccugagagugcugaagaugguugaacccuggcuccgcggaaaccaauucuguauuaaaauccugaauccuuauaugcccucuguggucgagacacuugagcagaugcagcggaagcacggcggcaugcuggugagaaacccucucucccgcaauagcacgcaugaaauguacuggguuucuugcgggaccggaaacaucguguccgcggucaauaugacaagccggaugcugcugaacagauuuaccauggcccaccgcaaacccacauaugagcgggauguggaccucggcgcugggaccagacacguggccgucgaaccggagguugcuaaccuggauauuaucggacagcgcauugaaaauaucaagcaugagcacaaaucuacguggcauuacgacgaggauaacccuuauaagaccugggccuaccacggcuccuaugaagugaagcccagcggguccgcuagcucuauggugaauggagucgugaaacuucugacaaagcccugggacguuauuccuauggugacccaaaucgccaugacagauaccacacccuucggccagcagagagucuuuaaagagaagguggacacccggacgccuaaagcgaagcgcggcacagcccaaaucauggaaguuaccgcuaaguggcucuggggguuccugagcagaaacaaaaagccgcggauuuguaccagagaggaauuuacacggaaagugcgcuccaaugccgcuaucggagccgucuucguggacgagaaccaguggaacucugccaaggaggcgguugaagaugagagauuuugggaccuugugcaucgggaacgcgagcugcacaaacagggcaagugcgcuacgugcgucuacaacaugauggggaagagagagaagaagcucggagaguucggcaaagccaaggggagccgggccauuugguacauguggcugggcgcucgcuuccuggaguuugaagcccucggauucaugaaugaggaucacugguuuuccagagaaaacucucugagcggcguggagggggagggacuucauaaacugggcuauauccuccgggacauuuccaagauccccgggggaaauauguacgcugaugacaccgccggcugggauacacgcaucaccgaagacgaucugcagaacgaggcgaaaauuacagacaucauggaaccugagcacgcccuucuggcuaagucuauuuucaagcucaccuaucaaaauaaagucgugagaguucagcggcccgccaagaacgggacagugauggaugucaucagccgcagagaccagcggggcuccggacaggugggcaccuacgggcugaauacguuuaccaacauggaagcucaacugauucgccagauggagagcgagggaaucuucucuccuuccgaacucgagacacccaaccuggccggcagagugcuugauuggcuggaaaaacaugggguugagcggcucaagagaauggcgaucagcggagacgacuguguggucaaaccgauugaugaccgcuuugccaccgcucugacagcccuuaaugauaugggcaaggugcggaaggacaucccucagugggaacccucuaaaggguggaacgauuggcagcaaguuccuuucugcucccaccacuuucaucagcugauuaugaaggacggcagagagaucgugguccccugucgcaaucaggaugagcucgugggacgggcuagagucagccagggcgccggguggucccugcgcgaaaccgcuugccugggaaaaucuuaugcccaaauguggcagcucauguacuuccaccggagagaccugcgccuugcggccaacgcuauuuguagcgccgugccuguugauugggugcccacgucccggacaaccuggagcauccaugcccaccaucaguggaugacaaccgaggacaugcugucugucuggaauagaguguggauugaagagaacccguggauggaagauaagacgcacaucuccagcuggggcgacguuccuuaucucgggaaacgcgaggaccaauggugcggaucucugaucggccuuaccgcucgggccacaugggcgaccaauauucagguggcuaucaaccaggucagacggcugauugggaaugagaacuaccucgauuacaugacaagcaugaagagauuuaagaaugaauccgaccccgagggcgcccugugguga

SEQ ID NO: 18974 - RNA, 9879 nt, Artificial Sequence
  derived and/or modified CDS sequence (opt5) from DENV-1__FJ410283__SS-prME
agcgugaccaugcugcucaugcugaugcccacagcccuugcuuuccaccugacgaccagaggcggggaaccucauaugaucgucuccaagcaggaacggggaaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcgccggcaaacucguucaucagauuuucgggacggcuuacggaguccuguuuuccggcgugagcuggaccaugaagaucgggauuggcgugcuucugacauggcucggacucaauucuagauccaccagccugucuaugacauguaucgccgucggccuugugacccucuaccuggggguuauggugcaggcugauuccggaugcgucauuaacuggaaaggccgcgaacugaagugugggagcggaaucuucgugacaaaugagguucacaccuggacggaacaauauaaguuucaggccgacuccccuaaacggcucucugcggccauuggcaaggcuugggaggagggggugugcggcaucagaagcgccacacgccuggaaaacaucauguggaaacagauuuccaacgagcuuaaucauauccugcucgaaaacgacaugaaguucaccgucgugguuggagauguggcuggcauucuggcccaggggaaaaagaugauccggccgcaacccauggaguacaaauauucuuggaaaagcuggggaaaggccaagauuaucggcgcugacguccagaauaccacauuuaucauugaugggccuaacacccccgaauguccugacgaucagagagcguggaauaucugggagguggaggacuacggauucggcauuuuuacgacaaacaucuggcugaaacuucgcgauuccuauacccaggugugcgaccaccggcucaugagcgccgcuauuaaagauucuaaggccguccacgccgacaugggcuacuggaucgaauccgagaaaaaugaaacauggaagcuggcuagagccagcuucaucgagguuaagaccuguauuuggcccaaaucucauacacugugguccaacggggugcucgaaagcgagaugaucauuccgaagaucuauggaggcccuauuucucaacacaauuaccgccccggguacuucacccagacggcgggaccuuggcaucugggcaaacuugagcuggauuuugaccucugcgaagggaccacaguggucguggaugagcacugcggaaaccggggccccagccugagaaccacaaccguuacgggcaagaucauccacgaaugguguugccgguccuguacacugccuccccuucgcuucagaggggaggacggaugcugguauggcauggagauucggccggugaaagaaaaggaggaaaaucucgucaagagcauggugucugcuggguccggagagguugacagcuuuucccugggccugcucuguaucucuauuaugaucgaagaggugaugagaagccgcuggucccggaaaaugcugaugaccgggacacuugccgucuucuuucugcucauuaugggacagcugaccuggaacgaucugaucagacuuugcauuauggugggcgccaaugcuucugaccgcaugggcauggggaccacauaccuggcccucauggcgacguucaagaugagaccuauguuugcuguuggacugcuguuccggcgccugaccagcagagaggugcuucugcucacaaucggccugucccuggucgccucuguggaacuucccaacagccuggaggaacucggggauggacuggccaugggcaucaugauucucaaacugcuuaccgacuuucaaucccaucagcugugggcuacacuccugagccugaccuucaucaagacgacauuuucucuucacuaugccuggaaaaccauggcuauggugcuguccauugucagccucuucccccugugucucucuaccacaucccagaagaccacauggcugccuguucuucuggggagccugggaugcaagccgcucacgauguuucugaucgccgagaauaaaauuuggggccggcgcucuuggccccuuaacgaaggcaucauggcgguggggaucguguccauucugcucagcucccugcucaagaacgaugucccucuggccggaccccuuaucgcuggcgggaugcugauugccuguuacgugaucagcggaucuagcgcugaccugucccucgagaaagccgccgagguuucuugggaagaggaagcugagcauagcggcgcgucccacaauauucugguggaaguccaggaugacgggaccaugaagaucaaagaugaggagagagacgauacacuuaccauccugcucaaggccacacugcucgcugugucuggaguuuauccucugagcauucccgccacccuuuucgugugguacuucuggcagaagaagaagcagcgguccggcguccugugggacacgccuucucccccggaaguggagcgcgccguccuggaugacggcaucuauagaauuaugcagcgggggcuccugggacgcagccaggugggcguugggguguuucaagaaaacgucuuccauaccauguggcacgugacaagaggagcuguucuuauguaccagggcaaacggcuggagccuuccugggccagcgugaagaaagaccucaucucuuacgggggaggcuggagacugcagggcuccuggaauaccggggaggaaguccaggugauugcgguggagcccggaaagaacccuaaaaauguucaaacagcucccggcaccuuuaagacaccggaaggggaggucggagccaucgcccucgauuucaagccuggcacgagcgggucucccauugugaaccgcgaaggaaaaaucgugggccuguauggcaauggggucgugaccacauccggaaccuacguuagcgcuaucgcccaggcgaaggcuucccaggagggcccucuucccgagauugaagacgagguguuucggaaaagaaaccugaccaucauggaucugcaccccgggucuggaaagacacgccgguaucucccugccauugucagagaagccaucaaacgcaagcugcggacgcuuauucuggcuccgaccagagugguugccagcgagauggcugaagcccucaagggcaugcccauccgcuaccaaacaaccgcggugaaauccgagcauacagggaaggagaucgucgaccugaugugccacgccaccuucacgaugcggcugcucagcccugugagaguucccaauuauaacaugauuaucauggaugaagcucauuuuacagacccuucuuccauugccgcucggggcuacaucagcacccgcgugggaaugggcgaggccgccgcuauuuucaugaccgcgacacccccugggucugucgaagccuuuccgcagagcaaugcugugauccaggaugaggaaagagacauccccgagcgguccuggaacucuggauaugaguggauuaccgauuucccuggcaaaacagugugguuuguccccagcaucaaguccgggaaugacauugccaacugucuucgcaaaaauggaaagagaguuauccagcugucucggaagaccuucgauacggaauaccagaagaccaagaacaacgacugggacuacguggugaccacagauauuagcgagaugggcgccaauuucagagcugaccgcgucaucgauccucggagaugccugaaacccgugauucucaaggacgggccggaacgcguuauccuggccggcccuaugcccgugaccgucgcguccgcugcccagcggagaggacgcaucggccggaaccacaauaaagagggggaucaguauauuuacaugggacagccccuuaacaaugacgaggaucaugcccacuggacggaagcuaagaugcugcucgacaacaucaauaccccugagggcauuauccccgcccuguuugaaccugagagagaaaagagcgcggccauugauggggaguaucgccugagaggagaggcucggaaaacauucguggaacucaugcgcagaggcgaccuuccgguuuggcugucuuacaagguggccuccgagggguuucaauauagcgaucggcgcuggugcuucgacggcgaaagaaacaaucagguccuggaggaaaacauggauguggagaucuggaccaaagagggagaacggaagaaacucagaccccgcuggcuggacgcucggacauacuccgacccucuugcccugagagaguuuaaggaguucgcugccggccgccggucugucagcggggaucucauccuggagauuggaaaacugccccagcaccucacccagagagcgcaaaaugcccuugacaaccuggugaugcugcauaauuccgaacagggcgggcgggcuuaucgccacgccauggaggagcucccugauacaaucgaaacccugaugcuucuggcucucauugccguucugacgggaggcgugacacuguuuuuccucucuggcagagggcuuggaaagaccagcaucggccugcugugugugauggccuccagcguccuccuguggauggcuucuguugagccccauuggauugcggccuccaucauccuugaauuuuuccugauggugcuccugauuccggagccugaccggcagcgcacaccccaggauaaccaacuggcuuacguggucaucgggcuccuuuuuaugauucugacaguggccgccaaugagaugggacugcucgaaaccacaaagaaagaccugggcaucgggcacguugcuguggagaaccaccaucacgccgcgaugcuugaugucgaccugcauccugccagcgcuuggacgcucuacgccguggcuaccacaauuaucacccccaugaugagacacacaauugaaaacaccacggccaauaucucucugaccgcgaucgccaaccaggcugccauucugaugggacucgauaagggcuggccuaucuccaaaauggacauuggcgucccccuucuggcucuggggugcuauagccaggugaauccgcucacacugaccgccgcuguucuuaugcugguggcccauuacgcgaucauuggaccuggccuccaagccaaggcuacacgggaggcccagaaacgcaccgcugccgggaucaugaagaaccccacggucgauggaaucguggccauugaccuggaucccguuguguaugacgcgaaguucgaaaaacagcugggccagaucaugcuccuuauucuguguacaucucaaauccugcucaugagaaccacaugggcucugugcgagagcauuacccuugccaccgggccucugacaacgcucugggagggauccccgggcaaguuuuggaauaccacaaucgcugucucuauggccaacaucuuccggggcagcuaccuggccggggcuggacuggccuucucccucaugaaaagccuuggcgggggacgcagaggcaccggggcgcagggagaaacacugggcgagaaguggaaacggcagcugaaucagcucuccaagucugaauuuaacaccuauaagagaagcggcauuauggagguggaccgcuccgaagccaaagaggggcugaagcggggagagacgacaaaacacgcugugucuagaggcaccgccaaacuucgcugguucguugaacggaaucuggucaaacccgaggggaaggugaucgaucucggauguggcagagggggauggagcuacuauugcgcuggccugaagaaagugaccgaagucaagggcuacacaaaagggggaccuggccacgaggaacccauuccuauggccaccuacggguggaaccugguuaagcuccauuccggaaaagacguguuuuucauucccccugagaagugugauacacuucugugcgacaucggcgagucuagcccgaaucccacgaucgaagaggggcgcacccugcgggugcucaaaauggucgaaccuuggcugagaggaaaccaauuuuguauuaagauccuuaaucccuauaugccuuccgugguugagacacuggagcagaugcagcgcaagcacggcggcaugcucgugcggaacccccugagcagaaauucuacccaugaaauguacugggucuccugcgggacaggaaacaucgugagcgcgguuaauaugaccucucgcaugcugcucaaccgguucacgauggcccacagaaaaccgaccuaugagcgcgauguggaccugggcgcugggacaagacacgucgccguggaaccugagguggcuaaccuugauauuaucggacagcggauugaaaauaucaagcaugagcacaaauccaccuggcauuacgacgaggauaaccccuauaagacaugggccuaccacggcagcuaugaagucaaacccucuggguccgcuagcuccaugguuaauggaguggugaagcugcucaccaagccuugggacgucauucccauggugacacaaaucgccaugaccgauacgacaccuuuuggccagcagcgcguuuucaaagagaagguggacaccagaaccccgaaagcgaagcggggcacagcccaaaucauggaagucacggcuaaauggcuguggggguuucuuagcagaaacaagaagccccggauuuguacccgcgaggaguucacaagaaaagugcggucuaaugccgcuaucggagccguuuuuguggacgagaaccaguggaauagcgccaaggaggcggucgaagaugagcgcuucugggaccuggugcauagagaacgggagcuccacaaacagggcaagugcgcuaccugcguuuacaacaugauggggaaacgcgaaaagaagcugggagaguuuggcaaagccaagggguccagagccauuugguacauguggcugggcgcucgguuccucgaguucgaagcccugggauuuaugaaugaggaucacugguucucucgcgaaaacagccuuuccggcguggagggggagggacugcauaaacucggcuauauccugagagacauuucuaagaucccugggggaaauauguacgcugaugacacagccggcugggauacccggaucacagaagacgaucuucagaacgaggcgcgcauuaccgacaucauggaacccgagcacgcccugcucgcuaaaagcauuuuuaagcugacguaucaaaauaaagucgugagaguccagcggccugccaagaacgggaccgugauggauguuaucucccgcagagaccagcggggcucuggacaggugggcacauacgggcugaauaccuucacaaacauggaagcucaacucauuagacagauggagagcgagggaaucuuuucccccagcgaacuggagaccccgaaccuugccgaacgcguccuggauuggcucggcaaguaugggguggagcggcugaaaagaauggcgaucucuggagacgacugugugguuaagccuauugaugaccgcuucgccacggcucuuacagcccugaaugauaugggcaaagugcggaaggacaucccccagugggaaccuuccaaaggguggaacgauuggcagcaaguccccuuuugcagccaucacuuccaccagcucauuaugaaggacggcagagagaucgugguuccuugucgcaaucaggaugagcuggugggacgggcuagagucucucagggcgccggguggucccugcgcgaaaccgcuugccucggaaagagcuacgcccaaauguggcagcugauguauuuucaucggagagaccuucgccuggcggccaacgcuauuuguuccgccgugcccgucgauuggaucccgacaucucggaccacguggagcauucacgcccaucaccaguggaugaccacagaggacaugcucuccguguggaauagaguuuggaucgaagagaacccuuggauggaagauaaaacccauaucagcucuuggggcgacgugcccuaccuggggaagcgggaggaccaauggugcggaucccuuauuggccugacagcuagagccaccugggcgacaaauauccaggucgcuauuaaccaggugcgccggcucaucgggaaugagaacuaccuggauuauaugaccagcaugaaaagauucaagaaugaaucugaccccgagggcgcccugugguga

SEQ ID NO: 18975 - RNA, 9879 nt, Artificial Sequence
  derived and/or modified CDS sequence (opt5) from DENV-1__FJ410284__SS-prME
agcgugaccaugcugcucaugcugaugcccaccgcccuugcuuuccaccugacgaccagaggcggggaaccucauaugaucgucaccaagcaggaacggggaaaaucccuccuguuuaagaccucugccggcguuaacaugugcacacuuauugccauggaccugggggaacucugugaagauaccaugaccuacaaaugcccccgcaucaccgaagcugaacccgacgauguggacuguuggugcaaugccacggauaccugggugacauauggaaccuguagccaaacaggcgaacacagacgggacaagcgcuccguugcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaggacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaagccccuaccagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuauccagaacggacggcugauuacagcuaaucccaucgugacggacaaagagaagccugucaacauugaagccgagccgcccuuuggcgagagcuauaucgugauuggggugggagaaaaagcccuuaagcucucuugguucaagaaaggcagcuccaucgggaagauguuugaggcuaccgccagaggcgcucgccggauggccauccugggagauacagcgugggacuucggcucuauugggggaguuuuuaccagcgucggcaaacuggugcaucagaucuucgggacagccuacggagugcucuuuuccggcgucagcuggaccaugaagauugggaucggcgugcugcuuacguggcugggacucaauucuagauccaccagccugucuaugacauguauugcuguuggccuggugacccuuuaccucggggucauggugcaggccgauuccggaugcguuaucaacuggaaaggccgcgaacugaagugugggagcggaauuuucgugacaaaugagguccacaccuggacagaacaauauaaguuucaggcugacuccccuaaacggcugucugccgcgaucggcaaggccugggaggagggggugugcggcaucagaagcgcuacccgccucgaaaacauuauguggaaacagaucuccaacgagcugaaucauauucuucuggaaaacgacaugaaguucacgguuguggucggagauguggugggcauccucgcccaggggaaaaagaugauucggccgcaacccauggagcacaaauacucuuggaaaagcuggggaaaggcuaagaucaucggcgccgacguccagaauacaaccuuuauuaucgaugggccuaacacccccgaauguccugacgaucagagagccuggaauauuugggagguugaggacuauggauucggcaucuuuacaaccaacauuuggcugaagcugcgcgauuccuacacgcaggcuugcgaccaccggcuuaugagcgcggccaucaaagauucuaaggcugugcaugccgacaugggcuauuggaucgaauccgagaaaaaugaaacauggaagcucgccagagcuagcuucauugaggugaagaccuguaucuggcccaaaucucacacacugugguccaacgggguccuggaaagcgagauggugauuccgaagaucuacggaggcccuauuucucaacauaauuaucgccccggguacuucacccagacagccggaccuuggcaccucggcaaacuggagcuugauuuugaccugugcgaagggaccacgguuguggucgaugagcacugcggaaaccggggccccagccucagaaccacaaccgugacaggcaagaucauccaugaaugguguugccgguccuguacccugccuccccugcgcuucaaaggggaggacggaugcugguacggcauggagauuagaccgguuaaggaaaaggaggaaaaucuugugaaaagcauggucucugcgggguccggagagguggacagcuuuucccucggccugcuguguaucucuauuaugaucgaagagguuaugcggagcagauggucccgcaagaugcucaugacggggacacuggcuguguuccuucugcucauuaugggacagcugaccuggaacgaucugauccggcuuugcauuauggucggcgccaaugccucugacagaaugggcauggggacaaccuaucuggcucucauggccaccuuuaaaaugcgcccuauguucgcggugggacugcucuuuagacggcugacaagccgcgaggugcuucugcucacgaucggccugucccuggucgcuucuguugaacuucccaacagccuggaggaacucggggauggacuggccaugggcaucaugauucucaagcugcuuaccgacuuccaaucccaccagcugugggccacacuccugagccugaccuuuaucaaaacaacccuuucucugcauuacgcuuggaagacgauggccauggugcucuccauugugagccuguucccccucugucugucuacaaccucccagaagaccacauggcuuccuguccugcuggggagccucggaugcaaaccgcugaccauguuucuuaucgcugagaauaagauuuggggcagaaaaucuuggccccugaacgaaggcaucauggccguggggguuguguccauccuccugagcucccuccugaagaacgaugucccucuugcgggaccccugauugccggcgggaugcugaucgcuuguuaugugauuagcggaucuagcgccgaccucucccuggagaaagcugccgagguuucuugggaagaggaagccgagcacagcggcgcuucccauaauauccuuguggaaguccaggaugacgggacaaugaagauuaaagaugaggagaaggacgauacgcugaccauccuccugaaggcgacacuccuggccgugucuggagucuacccucuuagcauccccgcuacccuguucgugugguauuuuuggcagaagaagaaacagcgguccggcguucugugggacacaccuucucccccggaaguggagcgcgccguccucgaugacggcauuuacagaaucaugcagcgggggcugcuuggacgcagccaggugggcguugggguguuccaagaaaacgucuuccacaccauguggcacgugacgagaggagccgugcugauguaucagggcaagcggcucgagccuuccugggcuagcguuaaaaaggaccugauuucuuacgggggaggcuggcgccuccagggcuccuggaauaccggggaggaaguccaggugaucgccguggagcccggaaagaacccuaaaaauguccaaacagcgcccggcaccuuuaagacaccggaaggggaggugggagcuauugcccuggauuucaaaccuggcaccagcgggucucccaucguuaacagagaaggaaagauugugggccuuuacggcaauggggucgugacaacguccggaaccuauguuagcgccaucgcucaggccaaagcgucccaggagggcccucugcccgagaucgaagacgagguguuucggaagagaaaccugacaauuauggaucuccaucccgggucuggaaagacccgccgguaccugccugcuaucgucagagaagccaccaaacgcaaacuucggacacugauucucgccccgacgagagugguugcuagcgagauggccgaagcucugaaaggcaugcccauccgcuaucaaaccacagccgugaaguccgagcacaccgggaaagagauugucgaccugaugugccaugcgacauucaccaugcggcuccuuagcccugugagagugcccaauuacaacaugaucaucauggaugaagcccacuuuacggacccuucuuccauugcugcccgcggcuauaucagcacacgggucggaaugggcgaggcugccgccauuuucaugaccgcuacacccccugggucuguugaagcguuuccgcagagcaaugccgugauccaggaugaggaaagagacauucccgagcgguccuggaacucuggauacgaguggaucacagauuucccuggcaagaccgugugguuuguccccagcaucaaguccgggaaugacauugcuaacugucugcgcaaaaauggaaagagagugauccagcugucucggaaaacauucgauaccgaauaucaaaagacgaaaaacaacgacugggacuacguugugacaaccgauauuagcgagaugggcgccaauuuucgcgccgacagagucaucgauccucggagaugccucaagcccgugauucugaaggacgggccggaacgcguuauccuugcuggcccuaugcccgugacagucgccuccgcggcucagcggagaggacgcauuggccggaaccauaauaaagagggggaucaguacaucuauaugggacagccccugaacaaugacgaggaucacgcccacuggaccgaagccaagaugcuccuggacaacaucaauacgccugagggcauuauccccgcucuguucgaaccugagagagaaaagagcgccgcgauugauggggaguaccgccuccggggagaggccagaaagaccuucguggagcuuaugcgcagaggcgaccugccggucuggcugucuuauaaaguggcuuccgagggguuucaauacagcgaucggcgcuggugcuucgacggcgaaagaaacaaucagguucucgaggaaaacauggauguggagaucuggacaaaggagggagaacggaaaaagcugcgccccagauggcuugacgcccggaccuauuccgacccucuggcucucagagaguuuaaggaguucgccgcuggccgccggucugugagcggggaucugauucuggagaucggaaaacucccccagcaucuuacacagagagcccaaaaugcgcuggacaaccuggucaugcuccacaauuccgaacagggcgggcgcgccuaccggcaugcuauggaggagcugccugauaccaucgaaacacuuaugcugcucgcccugauugcuguucugaccggaggcgugacgcucuuuuuccuuucuggcagagggcugggaaagacaagcaucggccugcucugugugauggccuccagcguccugcuuuggauggccucuguggagccccacuggauugcugcguccaucauucuggaauuuuuccucaugguucugcugaucccggagccugaccggcagcgcacaccccaggauaaccaacucgccuauguggucaucgggcuucuguuuaugauucugaccguggcugccaaugagaugggacuccuggaaacaaccaaaaaggaccuuggcaucgggcacgucgccguggagaaccaucaccaugcuacaaugcuggauguugaccuccacccugccagcgcguggacgcuguacgccguggcuaccacaauuaucacccccaugaugagacauacaauugaaaacaccacggccaauaucucucugaccgcuauugccaaccaggcggccauccucaugggacuugauaaaggcuggccuaucuccaagauggacauuggcgucccccugcuggcucucgggugcuacagccaggugaauccgcugacacuuaccgccgcuguucugaugcucguggcccacuaugcuaucauuggaccuggccugcaagccaaggcgacacgggaggcccagaaacgcaccgcugccgggaucaugaagaaccccacggucgauggaauuguggcuaucgaccuggaucccgugguuuacgacgccaaauucgaaaagcagcucggccagaucaugcuucugauucuguguacaucucaaauccuccugaugagaaccacaugggcccuuugcgagagcauuacccuggcgaccgggccucucacaacgcugugggagggauccccgggcaaauuuuggaauaccacaaucgcugucucuauggccaacauuuuccggggcagcuaucuggcuggggccggacucgccuuuucccuuaugaaaagccugggcgggggacgcagaggcaccggggcucagggagaaacacugggcgagaaguggaaacggcagcucaaucagcuguccaagucugaguucaacaucuacaaacgcagcggcaucauggagguggacagauccgaagccaaggaggggcuuaaacggggagagaccacgagacacgcggugucucgcggcacagccaagcugcggugguucgucgaaagaaaucucguuaagcccgaggggaaagugauugaucugggauguggccgcgggggauggagcuauuacugcgcuggccugaagaaagugaccgaagucaagggcuauaccaaagggggaccuggccaugaggaacccaucccuauggccacauacggguggaaccucgugaaacuucacuccggaaaagacgucuuuuucacacccccugagaagugugauacacugcugugcgacauuggcgagucuagcccgaaucccacgaucgaagaggggcggacccucagagugcugaagauggucgaaccuuggcuucgcggaaaccaauuuuguauuaaaauccugaaucccuacaugccuuccgugguugagacacucgagcagaugcagcggaagcauggcggcaugcuggugagaaacccccugagccgcaauucuacccacgaaauguauugggucuccugcgggacaggaaacauugugagcgcugugaauaugaccucucggaugcuccugaacagauucacgauggcccaccgcaaaccgaccuacgagcgggaugucgaccuuggcgcggggacaagacauguugccguggaaccugagguggcuaaccuggauaucaucggacagcgcauugaaaauaucaagcacgagcauaaauccaccuggcacuaugacgaggauaaccccuacaagacaugggccuaucauggcagcuacgaagucaagcccucuggguccgcuagcuccauggugaauggaguugugaaacuccugaccaagccuugggacgucauucccauggugacacaaaucgccaugaccgauacgacaccuuuuggccagcagagaguuuucaaagagaagguggacacccggaccccgaaagcuaagcgcggcacagcccaaauuauggaagucacggcgagauggcuuuggggguuucugagccggaacaagaaacccagaaucuguacccgggaggaguucacacgcaaggugagaucuaaugccgcuaucggagccguuuuuguggacgagaaccaguggaauagcgcuaaagaggccgucgaagaugagcgguucugggaccucgugcagaaggaacgcgagcugcacaaacagggcaagugcgcgaccugcgucuauaacaugauggggaagagagagaagaagcugggagaguuuggcaaagcgaaggggucccgggcuauuugguacauguggcucggcgcccgcuuccuggaguuugaagcccuuggauucaugaaugaggaucacugguucucuagagaaaacagccuguccggcguggagggggagggacuccauaaacugggcuacauccuucgggacauuucuaagaucccugggggaaauauguaugcugaugacacagccggcugggauacccgcauuacagaagacgaucugcaaaacgaggcuaaaaucaccgacaucauggaacccgagcacgcccuccuggcgacgagcauuuuuaagcugaccuaccagaauaagguugugagaguccagcggccugccaaaaacgggacagugauggaugugaucucccgcagagaccagcggggcucuggacaaguuggcaccuaugggcucaauacauucaccaacauggaagcucagcugauucgccagauggagagcgagggaaucuuucuucccuccgaacuggagacgccgaaccucgccgaaagagugcuggauuggcuugagaagcauggcgucgaacggcugaaaagaauggcuauuagcggggacgacugugugguuaagccuaucgaugaccgcuucgccacagcgcucaccgcccugaaugauaugggaaaagugcggaaggacaucccccagugggagccuucuaagggcuggaacgauuggcaacagguccccuuuugcucccaccacuuccaucagcugauuaugaaagacgggagagagaucguggucccuugucgcaaucaggaugaacucgugggccgggcuagaguuagccaaggagccggcuggucucugcgcgagacagcuugccuugggaaguccuacgcccagauguggcagcugauguauuuucaccggagagaccuccgccuggcugccaacgcgauuuguagcgccgugcccgucgauugggugccgaccucccggacgaccuggucuauccaugcucaccaucaauggaugacaaccgaagacaugcuuagcguuuggaauagaguguggauugaggaaaacccuuggauggaggauaaaacacacgucuccagcuggggagacgugcccuaccugggcaagcgcgaggaccaguggugcgggucucucaucggacugaccgcccgggccacaugggcuuccaauauucagguggccaucaaccagguuagacggcugaucggcaaugaaaacuaucucgauuacaugaccagcaugaaaagauucaagaaugagggggaccccgaaggcgcgcugugguga

SEQ ID NO: 18976 - RNA, 9879 nt, Artificial Sequence
  derived and/or modified CDS sequence (opt5) from DENV-1__FJ410285__SS-prME
agcgugaccaugcugcucaugcugaugcccacagcccuugcuuuccaccugacgaccagaggcggggaaccucauaugaucgucuccaagcaggaacggggaaaaucucuccuguuuaagacaagcgccggcguuaacaugugcacccuuauugcgauggaccugggggaacucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugucauugggaccucuaucacccagaagggaaucauuuucauccuccugaugcuugugacaccuagcauggcgaugagaugcguuggcauugggucccgggauuuuguggagggacugagcggcgccacgugggucgacguggugcucgagcacgggucuugugucaccacaauggcuaaggauaaacccacccuggacaucgaacugcucaagacagagguuaccaacccugccgugcugcgcaaacuuugcauugaagcuaagaucuccaauacgacaaccgauagcagauguccgacccaaggagaggccacacugguggaagaacaggacgcgaacuucgucugccggcgcaccuuuguggauagaggcuggggcaauggguguggacucuucggcaaagggucucugauuacaugcgccaaguuuaagugcguuacgaaacuugagggaaagaucgugcagcacgaaaaccugaaauacuccgucaucgugaccguucauacaggcgaccagcaccaaguggggaaugagagcaccgaacauggaacaaccgcuacgauuacaccccaagccccuaccaccgagauccagcucacagacuauggcgcucugucucuggauuguagcccccggaccggccucgacuucaacgaaaugguccugcuuacgaugaaggagaaaagcuggcuggugcacaagcagugguuucucgaucugccucuucccuggacauccggggccucuaccagccaagagacauggaaucgccaggaccugcucgucaccuucaaaaccgcccacgcuaagaagcaggaagugguugugcugggaucccaagagggcgcgaugcauacagcccugacgggggcuaccgaaauucagacaagcggaaccacaaccaucuuugccggccaccucaaaugcagacugaagauggauaaacuuacgcugaaggggaugucuuacgucauguguacaggcuccuucaaacucgagaaggaaguggccgagacccagcauggaaccguucuggugcagauuaaguaugagggcacagacgcuccgugcaaaaucccuuucagcacccaagaugaaaagggggucacacagaacggacggcugaucacggccaaucccauugugaccgacaaagagaagccugugaacaucgaagcggagccgcccuuuggcgagucuuacauuaucauuggggcuggagaaaaagcccuuaagcucagcugguucaagaaaggcuccucuaucgggaagauguuugaggccacagcuagaggcgcccgccggauggcuauccugggagauaccgccugggacuucggcagcauugggggaguuuuuacauccgucggcaaacuggugcaccagaucuucgggaccgcguauggagugcucuuuagcggcgucucuuggacgaugaagauugggaucggcgugcugcuuaccuggcugggacucaauuccagaagcacaucucuguccaugaccuguauugccguuggccuggugacacuuuaccucggggucauggugcaggcugauagcggaugcguuaucaacuggaaaggccgcgaacugaaguguggguccggaauuuucgugaccaaugagguccauacauggaccgaacaauacaaguuucaggccgacucuccuaaacggcugagcgcugccaucggcaaggcgugggaggagggggugugcggcaucagauccgccacgcgccucgaaaacauuauguggaaacagaucucuaacgagcugaaucacauucuucuggaaaacgacaugaaguucacaguuguggucggagauguggcuggcauccucgcccaggggaaaaagaugauucggccgcaacccauggaguauaaauacagcuggaaguccuggggaaaggcuaaaaucaucggcgccgacgugcagaauaccaccuuuauuaucgaugggccuaacacacccgaauguccugacgaucagagagccuggaauauuugggaggucgaggacuauggauucggcaucuuuaccacgaacauuuggcugaagcugcgcgauagcuacacacagguuugcgaccaccggcuuaugucugcugcgaucaaagauuccaaggccgugcaugcugacaugggcuauuggaucgaaagcgagaaaaaugaaaccuggaagcucgccagagccucuuucauugaggugaagacauguaucuggcccaaaucccacacccuguggagcaacgggguccuggaaucugagaugauuaucccgaagauuuacggaggcccuaucagccaacauaauuaucgccccggguacuucacacagaccgcuggaccuuggcaccucggcaaacuggagcuugauuuugaccugugcgaagggacgaccgugguuguggaugagcacugcggaaaccggggccccucccucagaacaaccacagucaccggcaagaucauucaugaaugguguugccggagcuguacgcugccuccccugcgcuucagaggggaggacggaugcugguacggcauggagauccggccggugaaagaaaaggaggaaaaucuuguuaagucuaugguguccgccgggccuggagaggucgacagcuuuucccucggccugcuguguauuucuaucaugauugaagaggugaugagaagccgcuggucccggaaaaugcucaugacagggacccuggcgguuuucuuucuucugaucaugggacagcucacauggaacgaucugauuagacugugcaucauggugggcgcuaaugccucugaccgcaugggcauggggaccaccuaucuugcccugauggcuacauucaagaugagacccauguuugccgucggacuccuguuccggcgccucacgagcagagaggugcugcuucugaccaucggccucucccugguggcgucugucgaacugcccaacagccuugaggaacugggggauggacucgcuaugggcauuaugauccugaaacuccuggccgacuuucaaucccaccagcuuugggccacacugcucagccugaccuucauuaagacaaccuuuucucugcauuacgcuuggaaaacgauggccaugguucuuuccaucgugagccuguucccucucugucugucuacaaccucccagaagaccacauggcucccggugcugcuugggagccugggaugcaagccccugaccauguuucucauugcugagaauaaaaucuggggccggcgcucuuggccucugaacgaaggcaucauggccgucgggauuguguccauccuucugagcucccuccugaagaacgauguuccccucgcgggaccucugauugccggcgggaugcuuaucgcuuguuaugugauuagcggaucuagcgccgaccugucccuggagaaagcugccgaggucucuugggaagaggaagccgagcacagcggcgcuucccauaauauccucguggaaguucaggaugacgggacaaugaagaucaaagaugaggagagagacgauacgcugaccauucuucugaaggcgacacuccuggccgugucuggagucuacccccucagcaucccugcuacccuguucgugugguauuucuggcagaagaagaagcagcgguccggcguccuuugggacacacccucuccgccugaaguggagcgcgccguucuggaugacggcauuuacagaaucaugcagcgggggcugcucggacgcagccaggugggcgucgggguguuucaagaaaacguuuuccacaccauguggcacgugacgagaggagccguccugauguaucagggcaaacggcuugagcccuccugggcuagcgugaagaaagaccugauuucuuacgggggaggcuggagacuccagggcuccuggaauaccggggaggaagugcagguuaucgccgucgagccuggaaagaaccccaaaaaugugcaaacagcgccgggcaccuuuaagacaccugaaggggaggugggagcuauugcccuggauuucaagcccggcaccagcgggucuccuaucgucaaccgcgaaggaaaaaucgugggccucuacggcaaugggguugugacaacguccggaaccuaugucagcgccauugcucaggccaaggcgucccaggagggcccccugcccgagaucgaagacgagguguuucggaaaagaaaccuuacaauuauggaucugcauccugggucuggaaagacccgccgguaccugccggcuaucguuagagaagccauuaaacgccggcucagaacccugauccuugcccccacacgcguggucgcuagcgagauggccgaagcucugaagggcaugccuauccgguaucaaacgaccgccgugaaguccgagcacacagggaaagagauuguugaccucaugugccaugcgaccuucacaaugagacugcugagccccgugcgggucccuaauuacaacaugaucauuauggaugaagcccacuuuaccgaccccucuuccaucgcugcccgcggcuauauuagcacgagagugggaaugggcgaggcugccgccaucuucaugacagcuaccccuccggggucuguggaagcguuuccccagagcaaugccgucauccaggaugaggaacgggacauuccugagcgcuccuggaacucuggauacgaguggaucaccgauuuccccggcaagacaguuugguuugugccuagcauuaaauccgggaaugacaucgcuaacugucucagaaagaauggaaaacgggugauucagcuuucuagaaagaccuucgauacagaauaucaaaagaccaaaaacaacgacugggacuacgucgugacgacagauaucagcgagaugggcgccaauuuccgcgccgaccggguuauugaucccagacgcugccugaagccggugauccugaaagacgggccugaacgggucauccucgcuggccccaugcccgugaccguugccuccgcggcucagagacgcggacggauuggcagaaaccauaauaaggagggggaucaguacaucuauaugggacagccucugaacaaugacgaggaucacgcccacuggacagaagccaaaaugcuucuggacaacauuaauacccccgagggcaucauuccugcucucuuugaaccggagcgcgaaaagagcgccgcgaucgauggggaguacagacugcggggagaggcccgcaagacguucguggaacugaugagacggggcgaccuccccgucuggcuuucuuauaaaguggcuuccgagggguuucaauacagcgaucgcagauggugcuucgacggcgaacggaacaaucagguccuggaggaaaacauggauguggagaucuggaccaaggagggagaacgcaaaaagcugcgcccucgguggcucgacgccagaacauauuccgacccccuggcucuuagagaguuuaaagaguucgccgcuggccggagaucuguuagcggggaucugauucucgagaucggaaagcugccucagcaucugacccagcgggcccaaaaugcgcucgacaaccuugugaugcugcacaauuccgaacagggcgggcgcgccuacagacaugcuauggaggagcugcccgauacaauugaaacccucaugcugcuugcccugaucgcugugcucacaggaggcgucacccuguuuuuccugucuggccgggggcucggaaaaacgagcauuggccuucuguguguuauggccuccagcgugcugcucuggauggccucuguggagccgcacuggaucgcugcguccaucauucuggaauuuuuccuuaugguccugcucaucccugagcccgaccgccagagaacaccucaggauaaccaacuggccuaugugguuauugggcugcucuuuaugauccuuaccguggcugccaaugagaugggacugcuggaaaccacaaagaaggaccucggcauugggcacgucgccguggagaaccaucaccaugcugccaugcuggaugucgaccuucaccccgcgagcgccuggacccuguacgcuguggccacaacgaucauuaccccuaugaugcggcauacaaucgaaaacaccacagcuaauaucucucucaccgccauugcgaaccaggccgcuauccugaugggacuggauaaaggcuggcccauuuccaagauggacaucggcguuccgcuccuugcccuggggugcuacagccaggugaauccucugacgcucaccgcugccguccugaugcuuguggcucacuaugccauuaucggacccggccugcaagcgaaagccacacgcgaggcucagaagagaaccgccgcugggaucaugaaaaaccccacaguugauggaauuguggccaucgaccucgauccugucguguacgacgccaaguucgaaaagcagcugggccagauuaugcugcucauccuuuguaccucucaaauucugcugaugcggacgacaugggcgcucugcgagagcaucacccuggcuacagggccgcuuaccacccugugggagggaucccccggcaaauuuuggaauacaacgaucgccgugucuauggcuaacauuuuccgcggcagcuaucucgccggggccggacuggcuuucucccugaugaagucccucggcgggggaagacggggcaccggggcccagggagaaacacuuggcgagaaauggaagagacagcugaaucagcuguccaaaucugaauuuaacaccuacaagcgcagcggcaucauggagguugaccgguccgaagcgaaggaggggcucaaaagaggagagacaaccaagcacgccgucucucgcggcacggcuaaacugcggugguucguggaaagaaaucuugugaagccugaggggaaagucauugaucugggauguggccgcgggggauggagcuauuacugcgccggccucaagaagguuacagaagugaaaggcuauaccaaaggcgggcccgggcaugaggaaccuauccccauggcuaccuacggguggaaccuggugaaacugcacuccggaaaggacgucuuuuucauuccuccggagaaaugugauacacuccuuugcgacaucggcgagucuagccccaauccuaccauugaagaggggcggacacugagagugcugaagaugguugaacccuggcuccgcggaaaccaauuuuguaucaaaauccugaauccuuacaugcccuccguggucgagacgcuugagcagaugcagcggaagcauggcggcaugcuggugagaaacccgcucagccgcaauucuacccacgaaauguauuggguuuccugcgggacaggaaacauugugagcgccgucaauaugaccucucggaugcugcugaacagauucacaauggcgcaccgcaagccuaccuacgagagagauguggaccucggcgccgggacgcggcauguggcugucgaacccgagguugccaaccuggauaucauuggacagcgcaucgaaaauauuaaacacgagcauaaguccaccuggcacuaugacgaggauaaccccuacaaaacaugggcuuaucauggcagcuacgaagugaagccuucuggguccgccagcuccauggugaauggagucgugaaacuucugaccaagcccugggacguuaucccuauggugacacaaaucgcuaugaccgauacaaccccguuuggccagcagagagucuucaaggagaaaguggacacgcggacacccaaggccaaaagaggcaccgcgcaaauuauggaaguuaccgccaaguggcucuggggguuucugagccggaacaaaaagccucgcaucuguacaagagaggaguucacgcggaaggugcgcucuaaugcugccauuggagcugucuuuguggacgagaaccaguggaauagcgccaaagaggccguugaagaugagagauucugggaccuugugcaccgggaacgcgagcugcacaagcagggcaaaugcgcgaccugcgucuauaacaugauggggaagagagagaaaaagcucggagaguuuggcaaggcuaaagggucccgggccaucugguacauguggcugggcgcccgcuuccuggaguucgaagcucucggauuuaugaaugaggaucauugguucucuagagaaaacagccuguccggcguggagggggagggacuucacaagcugggcuacauucuccgggacaucucuaaaauccccgggggaaauauguaugccgaugacacagcuggcugggauacccgcauuacagaagacgaucugcagaacgaggccagaaucaccgacauuauggaaccugagcaugcgcuucuggccaagagcaucuuuaaacucacauaccaaaauaaggucgugcggguucagcgccccgcuaaaaacgggaccgugauggaugucauuuccagacgggaccagagaggcucuggacaggugggcacguaugggcugaauaccuucacaaacauggaagcccaacugauccgccagauggagagcgagggaaucuuuuccccgagcgaacucgagaccccuaaccuggcugaacgggugcuugauuggcuggagaaguacggcguugaaagacucaagcgcauggccauuucuggggacgacuguguggucaaacccaucgaugaccgguucgcgacagcccugaccgcucuuaaugauaugggaaaggugagaaaagacauuccucagugggagcccuccaagggcuggaacgauuggcagcaaguuccuuuuugcagccaccacuuccaucagcugaucaugaaagacgggcgcgagauugugguccccugucggaaucaggaugaacucgugggcagagcccgcgucucucagggagcuggcuggucccugcgggagacggccugccugggaaagagcuaugcucaaauguggcagcucauguacuuucacagacgcgaccugcggcuugccgcgaacgccaucuguuccgcugugccgguugauuggauuccuacaucuagaaccacauggagcauccaugcccaccaucaguggaugaccacggaagacaugcuguccguguggaaucgggucuggaucgaggaaaaccccuggauggaggauaagacccacauuagcucuuggggagacgugcccuaucucggcaaaagagaggaccaauggugcgggucccugaucggacuuacagcccgcgcuaccugggccacaaauauucagguugcgaucaaccaggugcggagacugauuggcaaugaaaacuaccucgauuacaugaccagcaugaagcgcuucaaaaaugagucugacccugaaggggcucugugguga

SEQ ID NO: 18977 - RNA, 9879 nt, Artificial Sequence
  derived and/or modified CDS sequence (opt5) from DENV-1__FJ410286__SS-prME
agcgugaccaugcugcucaugcugaugcccacggcccuugcuuuccaccugacgaccagaggaggggaaccucauaugaucgucuccaagcaggaacggggaaaaucucuccuguuuaagaccagcgccggaguuaacaugugcacccuuauugcgauggaccugggggaacucugugaagauacaaugaccuacaaaugcccgagaaucacagaagcugaacccgacgauguggacuguuggugcaaugccaccgauacgugggugaccuauggaacauguucccagaccggcgagcacagacgggagaagcgcucugucgcccuggcuccucauguggggcugggacucgaaacaagaaccgagacguggaugagcuccgaaggcgccuggaaacagauucagcggguugagacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggacuuuguugagggacugagcggcgccacauggguggaugucgugcucgaacacgggucuugugugacgaccauggcuaaggacaaacccacacuggauaucgagcugcucaagaccgaagucacaaacccugccguucugcgcaaacuuugcauugaggcgaagaucuccaauaccacgacagacagcagauguccgacccagggagaagccacccugguggaggagcaggaugcuaacuucgugugccggcgcacauuugucgacagaggcuggggcaauggguguggacucuucggcaaagggucucugcuuaccugcgccaaguuuaagugcgugacaaaacuggaaggaaagauuguucaguacgagaaccucaaauauuccgugaucgucacggugcacaccggcgaucagcaucaaguugggaaugaaagcacagagcacggaaccacagcuaccaucacgccccaggccccuaccacagaaauucagcugaccgacuacggcgcccugacacucgacuguucuccccggaccggccuggauuucaacgagauggugcuucugacgaugaaggagaaauccuggcucguccauaagcagugguuucuggaccuuccucugcccuggacaagcggggcuuccaccucucaagaaacauggaaucgccaggaucuccuggugaccuucaaaaccgcgcacgccaagaagcaggaggucgugguucugggaagccaagaaggcgcuaugcacacagcccucacgggggccaccgagauccagacauccggaaccacaaccauuuuugcuggccaucugaaaugcagacuuaagauggacaaacugacgcucaaggggaugagcuaugugauguguacaggcucuuucaaacuggaaaaggaggucgccgagacccagcacggaaccgugcugguucagaucaaguacgaaggcacagaugcgccgugcaaaauuccuuucuccacccaagacgggaagggagugacacagaacggccggcuuaucacggcuaaucccaucgucaccgauaaagagaagccugugaacauugaagccgagccgcccuuuggggagagcuauaucgugauuggagccggcgaaaaagcucucaagcugucuugguucaagaaagggagcuccaucggcaagauguuugaggccacagcuagaggagcccgccggauggcgauucugggcgacaccgccugggauuucgggucuaucggaggcguuuuuacaagcgucgggaaacucgugcaucagaucuucggaaccgcuuacggcgugcuguuuuccggggucagcuggacgaugaagauuggcaucggagugcuucugaccuggcucggccucaauucuagauccacaagccugucuaugaccuguauugccguugggcuugugacacucuaccugggagucauggugcaggcugacuccggcugcguuaucaacuggaaagggcgcgaacugaaguguggaagcggcauuuucgugaccaaugagguccacacauggaccgaacaauauaaguuucaggccgauuccccuaaacggcucucugcggccaucgggaaggcuugggaggagggcgugugcggaauuagaagcgccacgcgccuggaaaacaucauguggaaacagaucuccaacgagcuuaaucauauucugcucgaaaacgacaugaaguucacaguuguggucggcgacguggcugggauccuggugcagggcaagaagaugauucggccgcaacccauggaguacaaauauucuuggaaaagcuggggcaaggccaaaaucauuggggccgauguccaaaauuccaccuuuaucaucgacggaccuaacacccccgaauguccugaugaccagagagcuuggaauauuugggagguugaggauuacggcuucggcaucuuuacaaccaacauuuggcugaaacuucgcgacagcuauacacaggugugcgaucaccggcucaugucugcggccaucaaagacuccaaggcugugcacgccgauaugggguacuggauugaaagcgagaaaaaugaaacauggaagcuggccagagcuucuuucaucgaggucaagaccuguaucuggcccaaaucccauacacuguggagcaacggagugcucgaaucugagaugauuaucccgaagauucacggcgggccuaucagccaacauaauuaucgccccggauacuucacccagacagccggcccuuggcaccuggggaaacuugagcuggacuuugaucucugcgaaggaaccacgguuguggucgacgagcacugcggcaaccggggccccucccugagaaccacaaccgugacagggaagauuauccaugaaugguguugccggagcuguacccugccuccccuucgcuucagaggagaggauggcugcugguacgggauggagauccggccgguuaaagaaaaggaggaaaaucucgugaagucuauggucuccgcgggaagcggcgagguggacuccuuuucucuggggcugcucuguauuagcaucaugauugaagagguuaugagaucccgcuggucucggaaaaugcugaugacgggaacacuugcuguguucuuucugcucaucaugggccagcugaccuggaacgaccugauuagacuuugcaucauggucggcgccaaugccagcgaucgcauggggaugggaacaaccuaucuggcucucauggccaccuucaagaugagaccuauguuugcggugggccugcuguuccggcgccugacauccagagaggugcuucugcucacgauugggcugucucuggucgcuagcguugaacuucccaacucccuggaggaacucggagacggccuggccauggggaucaugauccucaaacugcuuaccgauuuucaaagcuaccagcugugggccacacuccugucucugaccuucauuaagacaaccuuuucccuucacuaugcuuggaaaacgauggccauggugcugagcaucgugucucucuucccccugugucucuccacaaccagccagaagaccacauggcugccuguccuucugggaucucugggcugcaagccgcucaccauguuucugauugcugagaauaaaaucuggggccggaaguccuggccccuuaacgaagggauuauggccgugggaaucguuagcauccugcucuccagccugcucaaaaacgacgugccucuggcgggcccccuuauugccgggggaaugcugaucgcuuguuacgucauuucuggcagcuccgccgaucugucucucgagaaggcugccgaggugagcugggaagaggaagccgagcauuccggggcuucucacaauauccugguugaagugcaggacgauggaacaaugaaaauuaaggacgaggagcgcgaugacacgcuuaccauccugcucaaagcgacacugcucgccgucagcggcguguauccucuguccauccccgcuacccuuuucgucuggcauuucuggcaaaagaagaaacagagaucuggcgugcugugggauacaccuagcccucccgaaguugagcgggccgugcuggacgaugggauuuaccgcaucaugcagagaggacuccugggccggucccaggucggggugggaguuuuucaagaaaacguguuccacaccauguggcacgucacgcgcggcgccgugcuuauguaucaggggaagagacuggagcccagcugggcuucugugaaaaaggaccucauuuccuacggaggcggcuggcgguuucaggggagcuggaauaccggagaggaaguucaggucaucgccguggagcccggcaaaaacccuaagaaugugcaaacagcgcccgggaccuucaagacaccggaaggagaggucggcgcuauugcccuggacuuuaaaccugggaccucuggaucccccaucgugaacagagaaggcaagauuguuggccucuacgggaauggaguggucacaacgagcggcaccuauguguccgccaucgcucaggccaaagcgucucaggaggggccucugcccgagaucgaagaugagguuuuccgcaagcggaaccuuacaauuauggaccugcaucccggaagcggcaaaaccagacgcuaccugccugcuaucgugcgggaagccauuaagagaaagcuccgcacccugauccuugccccgacacgggucguggcuuccgagauggccgaagcucugaaagggaugcccauuagauaucaaacgaccgccguuaagagcgagcacacaggcaaagagaucguggaucucaugugccaugcgaccuuuacaaugcgccugcugucuccuguccgggugcccaauuacaacaugaucauuauggacgaagcccacuucaccgauccuuccagcaucgcugccagaggauauauuucuacgcgggugggcaugggggaggcugccgccaucuuuaugacagcuacacccccuggaagcauggaagcguucccgcaguccaaugccgucauucaggacgaggaacgcgauauccccgagagaucuuggaacagcggcuacgaguggaucaccgacuuuccugggaagacaguuugguucgugcccuccauuaaagcuggaaaugauaucgccaacugucuccggaagaauggcaagcgcgugauucagcuuucuagaaaaaccuucgacacagaauaucaaaagaccaaaaacaacgauugggacuacgucgugacgacagacaucagcgagaugggggccaauuuucgggcugauagaguuauugacccucgccggugccugaagcccgugauccugaaagauggcccggaaagagucauucucgccggaccuaugcccgugaccguugcguccgcugcccagcgccggggcagaaucgggcgcaaccauaauaaggagggagaccaguacaucuauaugggccagccccugaacaaugaugaggaccacgcccacuggacagaagcuaagaugcuucuggauaacauuaauaccccugaggggaucauucccgcccucuucgaaccugagcgggaaaagagcgcggccaucgacggagaguacagacugcgcggcgaggcuagaaagacguuuguggaacugaugcggcgcggggaucucccggucuggcuuucuuauaaaguggccuccgagggcuuccaauacagcgacagacgguggugcuuugauggagaacgcaacaaucagguccuggaggaaaacauggacguggagauuuggaccaaggagggcgaacgcaaaaagcugcggcccagauggcucgaugcucgcacauauuccgacccucuggcccuucgggaguucaaagaauuugcugccgggagacgcucuguuagcggagaccugauccucgagaucggcaagcugccccagcaucugacccagcgggcgcaaaaugcccucgauaaccuugugaugcugcacaauuccgaacaagggggcagagcuuaccggcaugccauggaggagcugccugacacaauugaaacccucaugcugcuugcucugaucgccgugcucacaggcggcgucacccuguucuuucugucugggaagggacucggcaaaacgagcauugggcuucuguguguuauggccuccagcgugcugcucuggauggcuucuguggagccccacuggaucgcggccuccauuauccuggaguucuuucuuaugguccugcucaucccggagccugaucgccagagaacaccccaggacaaccaacuggcuuaugugguuauuggacuccuguucaugauccuuaccguggccgccaaugagaugggccugcuggaaaccacaaagaaagaucucgggauuggacacgucgcuguggagaaccaucaccaugccgcgaugcuggacgucgaucuucacccugccagcgcuuggacccuguacgccguggcuacaacgaucauuacccccaugaugcggcauacaaucgaaaacaccacagccaauauuucucucaccgcgaucgccaaccaggcugccauccugaugggccuggacaagggcuggccuauuuccaaaauggauaucgggguuccccuccuugcucugggaugcuacagccaggugaauccgcugacgcucaccgccgcuguccugaugcuuguggcccacuaugcgauuaucggcccugggcugcaagccaaggcuacacgcgaggcccagaagagaaccgcugccggaauuaugaaaaaccccacaaucgacggcaucguugccauugaucucgaccccguggucuacgaugcgaaguuugaaaaacagcuggggcagaucaugcugcucauucuuuguaccucucaaauccugcugaugcggacgacaugggcucucugcgagagcauuacccuggccacaggaccucuuaccacccugugggagggcuccccgggcaaguucuggaauacaacgaucgcugugucuauggccaacaucuuccgcgggagcuaucucgccggagcuggccuggccuuuucccugaugaaaagccucgggggaggcagacgggggaccggagcgcagggcgaaacacuuggcgagaaguggaagcgccagcugaaucagcuguccaaaucugaguucaacaccuacaagagaagcgggauuauggagguggaccgguccgaagccaaagagggacucaagagaggcgagacaaccaaacacgcuguuucucgcgggacggccaagcugcggugguuugucgaaagaaaucuugugaagcccgagggaaaagugaucgaccugggcugugggcgcggaggcuggagcuauuacugcgcuggccucaagaaagucacagaaguuaagggguauaccaaaggaggcccugggcaugaggaacccauuccuauggccaccuacggauggaaccuggugaagcugcacuccggcaaagauguguucuuuauucccccugagaagugugacacacuccuuugcgauaucggggagucuagcccgaaucccaccaucgaagagggacggacacugagaguccugaagaugguggaaccuuggcuccgcggcaaccaauucuguauuaaaauccugaaucccuacaugccuuccguuguggagacgcuugagcagaugcagcggaagcauggcgggaugcuggucagaaacccccucagccgcaauucuacccacgaaauguauuggguguccugcggaacaggcaacaucguuagcgcggugaauaugaccucucggaugcugcugaacagauuuacaauggcccaccgcaaaccgaccuacgagcgggacgucgaucucggggcuggaacgagacauguggccguggaaccugaggucgcuaaccuggacauuaucggccagcgcauugaaaauaucaagcacgagcauaaauccaccuggcacuaugaugaggacaaccccuacaagacaugggccuaucaugggagcuacgaaguuaagcccucuggauccgcuagcuccauggugaauggcguggucaaacuucugaccaagccuugggaugugauucccaugguuacacaaaucgccaugaccgacacaaccccuuucggccagcagagaguguuuaaagagaaggucgauacgcggacaccgaaagcgaagcgcgggaccgcccaaaucauggaagugaccgcuagauggcucuggggauuccugagccggaacaagaaacccagaauuuguacacgggaggaauuuacgcgcaagguuagaucuaaugccgcuaucggcgccguguucgucgacgagaaccaguggaauagcgccaaagaggcgguggaagacgaucgguuuugggaccuuguucaccgcgagagagaacugcacaagcaggggaaaugcgcuaccugcguguauaacaugaugggaaagcgggagaagaaacucggcgaguucgggaaggccaaaggcucccgcgccauuugguacauguggcugggagcuagauuccuggaguuugaggcccucggcuucaugaaugaagaucauugguuuucucgggagaacagccuguccggggucgaaggagagggccuucacaagcugggguacauccuccgcgacauuucuaaaaucccuggaggcaauauguaugcugaugacacagccgggugggauaccagaaucacagaggacgaucugcagaacgaagcgaagauuaccgacaucauggagcccgaacaugcccuucuggcuaaaagcauuuucaagcucacauaccaaaauaaggugguccgggugcagcgcccugccaaaaacggcaccguuauggaugugaucuccagacgggaccagcgcggaucuggccaggucgggacguauggacugaauaccuuuacaaacauggaggcucaacugauuagacagauggaaagcgagggcaucuuccuccccaacgagcuggaaaccccgaaucuugccgggcgggugcuggauuggcucgagaaguacggaguggaaagacugaaacgcauggcgaucuccggcgacgacuguguugugaagccuauugaugaccgguuugccacagcucuuaccgcccugaacgauauggggaaagucagaaaggacaucccccagugggagccuagcaagggcuggaaugauuggcagcaagugcccuucugcucucaccacuuucaucagcucauuaugaaagacggacgcgaaaucguugugccuugucggaaccaggaugagcuggucggcagagcucgcgugucccagggggccggauggagccugcgggagacggcuugccucggcaagucuuaugcccaaauguggcagcugauguacuuccacagacgcgaccuucggcuggcggccaaugcuauuuguuccgccguccccguggauuggguuccgacaagcagaaccacaugguccauccaugcccaccaucaguggaugaccacggaagacaugcucucuguguggaaccgcgucuggauugaggaaaauccuuggauggaggauaaaacccggaucagcuccugggaagacgugcccuaucuggggaagagagaggaccaauggugcggaagccuuaucggccugacagcucgggccaccugggcgacaaacauucagguugcuaucaaucaggugagacgccucauugggaacgagaauuacucugauuacaugaccuccaugaaacgguuuaagaacgaaagcgagcccgaaggcgcccugugguga

SEQ ID NO: 18978 - RNA, 9879 nt, Artificial Sequence
  derived and/or modified CDS sequence (opt5) from DENV-1__FJ461339__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagagcaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguuccccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccccccuucggcgagucuuauauugugaucggggccggagaaaaagcucugaagcuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacugaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaagcugacgguuguggucggagauguggcuggcauucucgcccaggggaaaaagaugauccggccgcaacccauggaguacaaauauagcuggaaguccuggggaaaggccaaaauuaucggcgcugacgugcagaauacaaccuuuaucauugaugggccuaacacccccgaauguccugacgaucagagagcguggaauaucugggaggucgaggacuacggauucggcauuuuuacaaccaacaucuggcugaagcugcgcgauagccacacgcagguuugcgaccaccggcuuaugucugccgcuauuaaagauuccaaggccgugcaugccgacaugggcuauuggaucgaaagcgagaaaaaugaaacauggaagcucgcuagagccucuuucaucgaggugaagaccuguauuuggcccaaaucccacacacuguggagcaacgggguccuggaaucugagaugaucauuccgaagaucuacggaggcccuauuagccaacauaauuaucgccccggguacuucacccagacagcgggaccuuggcaccucggcaaacuggagcuugauuuugaccugugcgaagggaccacggugguuguggaugagcacugcggaaaccggggccccucccucagaaccacaaccgucacaggcaagaucauccaugaaugguguugccggagcuguacccugccuccccugcgcuucaaaggggaggacggaugcugguacggcauggagauuagaccggugaaggaaaaggaggaaaaucuuguuaaaucuaugguguccgcugggagcggagaggucgacuccuuuucucucggccugcuguguaucagcauuaugaucgaagaggugaugcgguccagauggucucgcaagaugcucaugacggggacacuggccguuuucuuucuucugauuaugggacagcucaccuggaacgaucugauccggcugugcauuauggugggcgccaaugcuagcgacagaaugggcauggggacaaccuaucuugcccugauggcgaccuucaaaaugcgcccuauguuugcugucggacuccuguucagacggcucacaucccgcgaggugcugcuucugacgaucggccucucucugguggccagcgucgaacugcccaacucccuugaggaacugggggauggacucgccaugggcaucaugauucugaagcuccugaccgacuuucaaccccaccagcuuugggcuacacugcucagccugaccuucaucagaacaaccuuuucucugcauuacgccuggaaaacgauggcuaugguucuuuccauugugagccuguucccucucugucugucuacaaccucccagaagaccacauggcucccggugcugcuugggagccugggaugcaagccccugaccauguuucucaucgccgagaauaaaauuuggggccggaagucuuggccucugaacgaaggcaucauggcggucgggaucguguccauucuucugagcucccuccugaaaaacgauguuccccucgccggaccucugaucgcuggcgggaugcuuauugccuguuaugugaucagcggaucuagcgcugaccugucccuggagaaggccgccgaggucucuugggaagaggaagcugagcacagcggcgcgucccauaauauucucguggaaguucaggaugacgggacaaugaaaaucaaggaugaggagcgcgacgauacgcugaccauccuucugaaagccacacuccuggcugugucuggagucuacccccucagcauuccugccacccuguucgugugguauuucuggcaaaagaagaaacagagauccggcguccuuugggacacacccucuccgccugaaguggagcgggccguucuggaugacggcaucuaccgcauuaugcagagagggcugcucggacggagccaggugggcgucgggguguuucaagaaaacguuuuccacaccauguggcacgugacgcgcggagcuguccugauguaucagggcaagagacuugagcccuccugggccagcgugaaaaaggaccugaucucuuacgggggaggcuggcggcuccagggcuccuggaauaccggggaggaagugcagguuauugcggucgagccuggaaaaaaccccaagaaugugcaaacagcuccgggcaccuuuaagacaagcgaaggggaggugggagccaucgcccuggauuucaaaccuggcaccucugggucccccauugucaacagagaaggaaagaucgugggccucuacggcaaugggguugugacaacgagcggaaccuaugucuccgcuaucgcccaggcgaaagcuucucaggagggcccucugcccgagauugaagacgagguguuucgcaagcggaaccuuacaaucauggaucugcaucccgggagcggaaaaaccagacgcuaccugccugccauuguucgggaagccaucaagagacgccuccggacccugauucuugcuccgacaagaguggucgccuccgagauggcugaagcccugaagggcaugcccauccgcuaucaaacgaccgcggugaaaagcgagcacacagggaaggagaucguugaccucaugugccaugccaccuucacaaugcggcugcugucuccugugagaguccccaauuacaacaugauuaucauggaugaagcucacuuuaccgacccuuccagcauugccgcucggggcuauaucucuacgcgcgugggaaugggcgaggccgccgcuauuuucaugacagcgacccccccugggagcguggaagccuuuccgcaguccaaugcugucauccaggaugaggaaagagacauccccgagcggucuuggaacagcggauacgaguggauuaccgauuucccuggcaaaacaguuugguuugugcccuccaucaagucugggaaugacauugccaacugucuccgcaaaaauggaaagagagugauccagcuuagccggaagaccuucgauacagaauaucaaaaaaccaagaacaacgacugggacuacgucgugacgacagauauuuccgagaugggcgccaauuucagagcugaccgcguuaucgauccucggagaugccugaaacccgugauucugaaggacgggccggaacgcgucauccucgccggcccuaugcccgugaccguugcgagcgcugcccagcggagaggacgcaucggccggaaccauaauaaagagggggaucaguacauuuauaugggacagccccugaacaaugacgaggaucacgcccacuggacagaagcuaagaugcuucuggacaacaucaauaccccugagggcauuauccccgcccucuuugaaccugagagagaaaagucugcggccauugauggggaguaccgccugagaggagaggcucggaaaacguucguggaacugaugcgcagaggcgaccucccggucuggcuuuccuauaagguggccagcgagggguuucaauacuccgaucggcgcuggugcuucgacggcgaaagaaacaaucagguccuggaggaaaacauggauguggagaucuggaccaaagagggagaacggaagaaacugagaccccgcuggcucgacgcucggacauauucugacccucuggcccuuagagaguuuaaggaauucgcugccggccgccggagcguuuccggggaucugauccucgagauuggaaaacugccccagcaucugacccagagagcgcaaaaugcccucgacaaccuugugaugcugcacaauucugaacagggcgggcgggcuuaccgccaugccauggaggagcugccugauacaaucgaaacccucaugcugcuugcucugauugccgugcucacaggaggcgucacccuguuuuuccugagcggcagagggcucggaaagacguccaucggccuucuguguguuauugccagcucugugcugcucuggauggcuuccguggagccccacuggaucgcggccagcaucauucuggaauuuuuccuuaugguccugcucaucccggagccugaccggcagcgcacaccccaggauaaccaacuggcuuaugugguuauugggcugcucuuuaugauccuuaccguggccgccaaugagaugggacugcuggaaaccacaaagaaagaccucggcauugggcacgucgcuguggagaaccaucaccaugccgcgaugcuggaugucgaccuucacccugccucugcuuggacccuguacgccguggcuacaacgaucauuacccccaugaugagacauacaaucgaaaacaccacagccaauaucucccucaccgcgauugccaaccaggcugccauccugaugggacuggauaagggcuggccuauuagcaaaauggacaucggcguuccccuccuugcucuggggugcuacucucaggugaauccgcugacgcucaccgccgcuguccugaugcuuguggcccacuaugcgauuaucggaccuggccugcaagccaaggcuacacgggaggcccagaaacgcaccgcugccgggaucaugaagaaccccacaguugauggaauuguggccaucgaccucgaucccgucguguacgacgcgaaguucgaaaaacagcugggccagauuaugcugcucauccuuuguaccagccaaauucugcugaugagaacgacaugggcucucugcgaguccaucacccuggccacagggccucuuaccacccugugggagggaucuccgggcaaguuuuggaauacaacgaucgcugugagcauggccaacauuuuccggggcuccuaucucgccgggguuggacuggcuuucagccugaugaaaucccucggcgggggacgcagaggcaccggggcccagggagaaacacuuggcgagaaguggaaacggcagcugaaucagcugucuaagagcgaauuuaacaccuacaagagauccggcaucauggaggucgaccgcucugaagcgaaagaggggcucaagcggggagagacaaccaaacacgccgugagcagaggcacggcuaagcugcgcugguucguggaacggaaucuugucaaacccgaggggaagguuauugaucugggauguggcagagggggaugguccuauuacugcgccggccucaagaaagugacagaagugaagggcuauaccaaagggggaccuggccaugaggaacccaucccuauggcuaccuacggguggaaccuggucaagcugcacucuggaaaagacguguuuuucauucccccugagaagugugauacacuccuuugcgacaucggcgagagcuccccgaaucccaccauugaagaggggcgcacacugcggguucugaaaaugguggaaccuuggcucagaggaaaccaauuuuguaucaagauccugaaucccuacaugccuagcgucguggagacgcuugagcagaugcagcgcaagcauggcggcaugcugguucggaacccccucucuagaaauuccacccacgaaauguauugggugagcugcgggacaggaaacauugucucugccgugaauaugaccucccgcaugcugcugaaccgguucacaauggcgcacagaaaaccgaccuacgagcgcgauguggaccucggcgccgggacgagacaugucgcuguugaaccugagguggccaaccuggauaucauuggacagcggaucgaaaauauuaagcacgagcauaaaagcaccuggcacuaugacgaggauaaccccuacaagacaugggcuuaucauggcucuuacgaagugaaacccuccgggagcgccuccagcauggucaauggagugguuaagcuucugaccaagccuugggacgugauccccauggucacacaaaucgcuaugaccgauacaaccccuuuuggccagcagcgcguguucaaagagaagguugacacgagaacaccgaaagccaagcggggcaccgcgcaaauuauggaagugaccgccaaauggcucuggggguuucugucuagaaacaagaagccccggaucuguacacgcgaggaauucacgagaaaaguccggagcaaugcugccauuggagcuguguuuguugacgagaaccaguggaauuccgccaaggaggccguggaagaugagcgcuucugggaccuuguccacagagaacgggagcugcacaaacagggcaagugcgcgaccugcguguauaacaugauggggaaacgcgaaaagaagcucggagaguuuggcaaagcuaaggggucuagagccaucugguacauguggcugggcgcccgguuccuggaguucgaagcucucggauuuaugaaugaggaucauugguucagccgcgaaaacucccugucuggcgucgagggggagggacuucacaaacugggcuacauucucagagacaucagcaagaucccugggggaaauauguaugccgaugacacagcuggcugggauacccggauuacagaagacgaucugcagaacgaggccaaaaucaccgacauuauggaacccgagcaugcgcuucuggccaaguccaucuuuaaacucacauaccaaaauaaggugguucgcgugcagagaccugcuaagaacgggaccgucauggaugugauuucucggcgcgaccagagaggcagcggacaggugggcacguaugggcugaauaccuucacaaacauggaagcccaacugauccggcagauggaguccgagggaaucuuuagccccucugaacucgagaccuccaaccuggcuggcagaguucuugauuggcuggaaaaacacgggguggagcgccucaagcggauggccauuagcggagacgacugugucgugaaaccgaucgaugacagauucgcgacagcccugaccgcucuuaaugauaugggcaagguucgcaaagacauuccucagugggaacccucuaagggguggaacgauuggcagcaagugccuuuuugcucccaccauuuccaccagcugaucaugaaggacggccgggagauugucgugcccuguagaaaucaggaugagcucgucggacgcgcccgggugagccagggcgcuggguggucccugagagaaacggccugccugggaaaaucuuacgcucaaauguggcagcucauguauuuucaucgccgggaccugagacuugccgcgaacgccaucuguagcgcuguuccuguggauuggguccccacaucccgcaccacauggagcauucacgcccaucaccaguggaugaccacggaggacaugcugucuguguggaaucggguuuggaucgaagagaacccguggauggaagauaagacccacguguccagcuggggcgacgucccuuaccucgggaaaagagaggaccaauggugcggaucucugaucggccuuacagcccgggcuaccugggccacaaauauucagguggcgaucaaccaggugagacgccugcucgggaaugagaacuaucuggauuacaugaccagcaugaagcgguucaaaaaugaauccgaccccgagggcgcucugugguga

SEQ ID NO: 18979 - RNA, 9879 nt, Artificial Sequence
  derived and/or modified CDS sequence (opt5) from DENV-1__FJ882515__SS-prME
agcgugaccaugcugcucaugcugaugcccaccgcccuugcuuuccaccugacgacccggggcggggaaccucauaugaucgucaccaagcaggaacggggaaaaucccuccuguuuaagaccucugccggcguuaacaugugcacccuuauugccauggaccugggggagcucugugaagauaccaugacauacaaaugcccccgcaucaccgaggcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcauuggcaaacugguucaucagaucuucgggaccgcuuacggaguccucuuuuccggcgugagcuggacgaugaagauugggaucggcgugcugcuuaccuggcugggacucaauucuagauccacaagccugucuaugaccuguauugccgucggccuggugacacuuuaccucgggguuauggugcaggcugauuccggaugcgucaucaacuggaaaggccgcgaacugaagugugggagcggaauuuucgugaccaaugagguucacacauggaccgaacaauauaaguuucaggccgacuccccuaaacggcugucugcggccaucggcaaggcuugggaggagggggugugcggcaucagaagcgccacgcgccucgaaaacauuauguggaaacagaucuccaacgagcugaaucauauucuucuggaaaacgacaugaaguucacagucgugguuggagauguggucggcauccucgcucaggggaaaaagaugauucggccgcaacccauggagcacaaauacucuuggaaaagcuggggaaaggccaagaucaucggcgccgacgugcagaauaccaccuuuauuaucgaugggccuaacacacccgaauguccugacgaucagagagcuuggaauauuugggagguggaggacuauggauucggcaucuuuaccacgaacauuuggcugaagaugcgcgauuccuacacacaggucugcgaccaccggcugaugagcgcggccaucaaagauucuaaggcuguucaugccgacaugggcuauuggaucgaauccgagaaaaaugaaaccuggaaacuugccagagcuagcuucauugaggugaagacauguaucuggcccaaaucucacacccucugguccaacggggugcuggaaagcgagaugauuaucccgaagauuuacggaggcccuaucucucaacauaauuaucgccccggguacuucacacagaccgccggaccuuggcaccugggcaaacucgagcuggauuuugaccuuugcgaagggacgaccgucgugguugaugagcacugcggaaaccggggccccagccugagaacaaccacagugaccggcaagaucauucaugaaugguguugccgguccuguacgcucccuccccugcgcuucaaaggggaggacggaugcugguacggcauggagaucagaccggucaaggaaaaggaggaaaaucuggugaaaagcaugguuucugcgggguccggagagguggacagcuuuucccuuggccuccuguguauuucuaucaugauugaagaggucaugcggagcagauggucccgcaagaugcugaugacagggacccucgcuguguuccugcuucugaucaugggacagcucacauggaacgaucugauucggcugugcaucaugguuggcgccaaugccucugacagaaugggcauggggaccaccuaucuugcucugauggccacauuuaaaaugcgcccuauguucgcggugggacuccuguuuagacggcucacgagccgcgagguccugcuucugaccaucggccucucccugguggcuucuguggaacugcccaacagccuugaggaacugggggauggacucgccaugggcauuaugauccugaagcuccugacagacuuccaaucccaccagcuuugggccacccugcucagccugacauuuauuaaaaccacgcugucucuucauuacgcuuggaagacaauggccaugguccuguccaucguuagccucauuccccugugucucucuaccaccucccagaagacaaccuggcugccugugcuucuggggagccugggaugcaaaccgcucacaauguuccugaucgcugagaauaagaucuggggcagaaaaucuuggccccuuaacgaaggcauuauggccgugggggucguguccauccugcucagcucccugcucaagaacgauguuccucuggcgggaccccuuauugccggcgggaugcugaucgcuuguuaugugauuagcggaucuagcgccgaccugucccucgagaaagcugccgaggucucuugggaagaggaagccgagcacagcggcgcuucccauaauauccugguggaaguucaggaugacgggacgaugaagaucaaagaugaggagcgggacgauacccuuacaauucugcucaaggcgacccugcucgccgugucuggagucuacccucugagcauccccgcuacacuuuuugugugguauuucuggcaaaagaaaaagcagcgcuccggcguccugugggacaccccuucucccccggaaguggagagagccguucuggaugacggcauuuaccggaucaugcagcgcgggcuccugggaagaagccaggugggcgucgggguguuucaagaaaacguuuuccacacgauguggcacgugacccggggagccguccuuauguaucagggcaaacgccuggagccuuccugggcuagcgugaagaaagaccucauuucuuacgggggaggcuggagacugcagggcuccuggaauacaggggaggaagugcagguuaucgccgucgagcccggaaagaacccuaagaaugugcaaaccgcgcccggcacauucaaaaccccggaaggggaggugggagcuauugcccucgauuuuaagccuggcacaagcgggucucccaucgucaaccgggaaggaaaaaucgugggccuguacggcaaugggguugugacgaccuccggaacauaugucagcgccauugcucaggccaaggcgucccaggagggcccucuucccgagaucgaagacgagguguucagaaaacgcaaccugaccauuauggaucugcaucccgggucuggaaagacccggagauaccucccugcuaucguucgcgaagccauuaagcggaaacugagaacacuuauccuggccccgacgcgcguggucgcuagcgagauggccgaagcucucaagggcaugcccauccgguaucaaaccacagccgugaaauccgagcacaccgggaaggagauuguugaccugaugugccaugcgacauuuaccaugagacugcucagcccugugcgcguccccaauuacaacaugaucauuauggaugaagcccacuucacggacccuucuuccaucgcugcccggggcuauauuagcacaagagugggaaugggcgaggcugccgccaucuuuaugaccgcuacacccccugggucuguggaagcguucccgcagagcaaugccgucauccaggaugaggaacgggacauucccgagcgcuccuggaacucuggauacgaguggaucacagauuuuccuggcaaaaccguuugguucgugcccagcauuaaguccgggaaugacaucgcuaacugucuuagaaagaauggaaaacgggugauucagcugucucgcaagacauuugauaccgaauaucagaagacgaagaacaacgacugggacuacgucgugacaaccgauaucagcgagaugggcgccaauuucagagccgaccggguuauugauccuagacgcugccugaaacccgugauccucaaggacgggccggaacgggucauccuggcuggcccuaugcccgugacaguugccuccgcggcucagagacgcggacggauuggcagaaaccauaauaaggagggggaucaguacaucuauaugggacagccccuuaacaaugacgaggaucacgcccacuggaccgaagccaaaaugcugcucgacaacauuaauacgccugagggcaucauucccgcucuguuugaaccugagcgcgaaaagagcgccgcgaucgauggggaguaccggcugagaggagaggcccgcaaaaccuucguggaacucaugagacggggcgaccuuccggucuggcugucuuauaagguggcuuccgagggguuccaauacagcgaucgcagauggugcuuugacggcgaacggaacaaucagguccuggaggaaaacauggauguggagaucuggacaaaagagggagaacgcaagaaacucagaccccgguggcuggacgccagaaccuauuccgacccucuugcucugcgcgaguucaaggaauuugccgcuggccggagaucuguuagcggggaucucauucuggagaucggaaagcugccccagcaucucacacagcgcgcccaaaaugcgcuugacaaccuggugaugcugcacaauuccgaacagggcgggcgggccuacagacaugcuauggaggagcucccugauaccauugaaacacugaugcuucuggcccucaucgcugugcugaccggaggcgucacgcuguucuuucucucuggccgggggcuuggaaaaacaagcauuggccugcuguguguuauggccuccagcgugcuccuguggauggccucuguggagccccacuggaucgcugcguccaucauucuugaguucuuucugaugguccuccugaucccggagccugaccgccagagaacaccccaggauaaccaacuggccuaugugguuauugggcuccuuuucaugauccugaccguggcugccaaugagaugggacugcucgaaacaaccaagaaagaccugggcauugggcacgucgccguggagaaccaucaccaugcuacaaugcuugaugucgaccugcacccugccagcgcguggacgcucuacgccguggcuaccacaaucauuacccccaugaugcggcauacaaucgaaaacaccacggccaauaucucucugaccgcuauugccaaccaggcggccauccugaugggacucgauaagggcuggccuauuuccaaaauggacaucggcguuccccuucuggcucuggggugcuacagccaggugaauccgcucacacugaccgccgcuguccuuaugcugguggcccacuaugcuauuaucggaccuggccuccaagccaaggcgacacgcgaggcccagaagagaaccgcugccgggaucaugaaaaaccccacgguugauggaauuguggcuaucgaccuggaucccgucguguacgacgccaaguuugaaaaacagcugggccagauuaugcuccuuauccuguguacaucucaaauucugcucaugcggaccacaugggcccugugcgagagcaucacccuugcgaccgggccucugacaacgcucugggagggauccccgggcaaguucuggaauaccacaaucgcugugucuauggccaacauuuuucgcggcagcuaucuggcuggggccggacuggccuucucccucaugaaaagccuuggcgggggaagacggggcaccggggcucagggagaaacacugggcgagaaguggaagcgccagcugaaucagcucuccaaaucugaauuuaacaucuacaagagaagcggcauuauggagguugaccgguccgaagccaaagaggggcugaagagaggagagaccacgcgccacgcggucucucggggcacagccaaacuuagaugguucguggaacgcaaucuggugaagcccgaggggaaggucaucgaucucggauguggcagagggggauggagcuauuacugcgcuggccugaaaaagguuaccgaagugaaaggcuauaccaaagggggaccuggccaugaggaacccauuccuauggccacauacggguggaaccuggugaaacuccacuccggaaaggacgucuucuuuacacccccugagaaaugugauacacuucugugcgacaucggcgagucuagcccgaaucccacgauugaagaggggagaacccugcgcgugcucaagaugguugaaccuuggcugcggggaaaccaauucuguaucaagauccuuaaucccuacaugccuuccguggucgagacacuggagcagaugcagagaaaacauggcggcaugcucgugcgcaacccccugagcagaaauucuacccacgaaauguauuggguuuccugcgggacaggaaacauugugagcgcugucaauaugaccucuagaaugcugcucaaccgcuuuacgauggcccaccggaagccgaccuacgagaaagauguggaccugggcgcggggacaagacauguggccgucgaaccugagguugcuaaccuugauaucauuggacagcgcaucgaaaauauuaagcacgagcauaaauccaccuggcacuaugacgaggauaaccccuacaagacaugggccuaucauggcagcuacgaagugaagcccucuggguccgcuagcuccauggugaauggagucgugaaacugcucaccaagccuugggacguuauccccauggugacacaaaucgccaugaccgauacgacaccuuucggccagcagagagucuuuaaagagaagguggacacccggaccccgaaagcuaagcgcggcacaguucaaauuauggaagugacggccagauggcuguggggguuccuuagccggaacaagaaacccagaaucuguacccgggaggaauuuacacgcaaggucagaucuaaugcggccauuggagcuguguucguugacgagaaccaguggaauagcgccaaagaggcuguggaagaugagcgguuuugggaccugguccagaaggaacgcgagcuccacaaacagggcaagugcgcgaccugcguguauaacaugauggggaagagagagaagaagcugggagaguucggcaaagccaaggggucccgggcgaucugguacauguggcugggcgcucgcuuucucgaguucgaagcccugggauuuaugaaugaggaucacugguucucuagagaaaacagccuuuccggcgucgagggggagggacugcauaaacucggcuacauucugcgggacaucucuaagaucccugggggaaauauguaugccgaugacacagcuggcugggauacccgcauuacagaagacgaucuucaaaacgaggccaaaaucaccgacauuauggaacccgagcacgcucugcucgccacgagcaucuucaagcugaccuaccagaauaaggugguuagagugcagcggccugcgaaaaacgggacagucauggaugugauuucccgcagagaccagcggggcucuggacaagugggcaccuaugggcugaauacauuuaccaacauggaagcccagcucauccgccagauggagagcgagggaaucuuccugcccuccgaacuugagacgccgaaccuggcugaaagaguucucgauuggcuggagaaguacggcguggaacggcuuaaaagaauggccauuagcggggacgacugugucgugaagccuaucgaugaccgcuuugcuacagcccugaccgcgcucaaugauaugggaaaaguucggaaggacauuccccagugggagccuucuaagggcuggaacgauuggccccaagugccucauugcucccaccacuuccaucagcugaucaugaaagacgggagagagauugucgugcccugucgcaaucaggaugaacuggucggccgggccagagugagccagggagcuggcuggucucuccgcgagacagccugccuggggaaguccuaugcucaaauguggcagcuuauguacuuucaccggagagaccugcgccucgccgcuaacgccaucuguagcgcgguuccgguggauugggucccuaccucccggacgaccuggucuauucaugcccaccaucaguggaugacaaccgaagacaugcugagcguguggaauagaguuuggaucgaggaaaaccccuggauggaggauaaaacacacguguccagcuggggagacguccccuaucuuggcaagcgcgaggaccaauggugcgggucucugaucggacucaccgcucgggccacaugggccuccaauauucagguggcuaucaaccaggugagacggcugauuggcaaugaaaacuaccuggauuacaugaccagcaugaaaagauucaagaaugaggacgauccugaaggggcccucugguga

SEQ ID NO: 18980 - RNA, 9879 nt, Artificial Sequence
  derived and/or modified CDS sequence (opt5) from DENV-1__FJ882517__SS-prME
agcgugaccaugcugcucaugcugaugcccaccgcccuugcuuuccaccugacgaccagaggcggggagccucauaugaucgucuccaagcaggaacggggaaagucucuccuguuuaagacaagcgccggcguuaauaugugcacccuuauugccauggaccugggggaguucugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaagaggcucugaaacuuagcugguuuaagaaaggcuccucuaucgggaagauguucgaagccacagcuagaggcgcccgccggauggcgauucucggagauaccgccugggacuuuggcagcaucgggggaguuuucacauccgucggcaaacuggugcaucagaucuuugggaccgcuuacggagugcuguucagcggcgucucuuggacgaugaagauugggaucggcgugcuccugaccuggcuuggacucaauuccagaagcacaucucucuccaugaccuguauugccguuggccuggugacacuguaccuuggggucauggugcaggcugauagcggaugcguuaucaacuggaaaggccgcgagcucaaguguggguccggaauuuuugugaccaaugaaguccacacauggaccgagcaguauaaguuccaagccgacucuccuaaacggcugagcgcggccaucggcaaggcuugggaggaaggggugugcggcauuagauccgccacgcgccuggagaacaucauguggaaacagaucucuaacgaacucaaucauauucugcuugagaacgacaugaaguuuacaguuguggucggagauguggcuggcauccuggcccaggggaaaaagaugauucggccgcagcccauggaauacaaauauagcuggaaguccuggggaaaggccaaaaucauuggcgcugacgugcaaaauaccaccuucaucaucgaugggccuaacacacccgaguguccugacgaucagagagcguggaauauuugggaggucgaagacuacggauuuggcaucuucaccacgaacauuuggcucaagcugcgcgauagcuauacacagguuugcgaccaccggcugaugucugccgcuaucaaagauuccaaggccgugcacgccgacaugggcuacuggauugagagcgagaagaaugagaccuggaaacuugcuagagccucuuucaucgaagugaagacauguaucuggcccaaaucccauacccucuggagcaacgggguccuggagucugagaugauuaucccgaagauuuauggaggcccuaucagccagcacaauuaccgccccggguacuuuacacaaaccgcgggaccuuggcaucugggcaaacucgaacuggauuucgaccuuugcgaggggacgaccgugguuguggaugaacacugcggaaaccggggccccucccugagaacaaccacagucaccggcaagauuauccacgagugguguugccggagcuguacgcucccuccccugcgcuuuaaaggggaggacggaugcugguauggcauggaaaucagaccggugaaggagaaggaagagaaucugguuaaaucuaugguguccgcugggagcggagaagucgacuccuucucucuuggccuccuguguauuagcaucaugauugaggaggugaugcgguccagauggucucgcaagaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggucacauuuaaaaugcgcccuauguucgcggugggacugcucuuuagacggcugacgucccgcgaagugcuccugcuuaccauuggccugucucucgucgcuagcguugagcugcccaacucccuggaagaacuuggggauggacuggccaugggcaucaugauccucaagcugcucacagacuuccagagccaucaacugugggccacccuucugucucucacauuuauuaaaaccacguucucccugcacuaugcuuggaagacaauggccauggugcugagcaucgugucucuuuuuccccugugucucuccaccaccagccagaagacaaccuggcugccuguccuccuggggucucuuggaugcaaaccgcugacaauguuccugauugcugaaaauaagaucuggggcagaaaauccuggccccucaacgagggcauuauggccguggggaucguuagcauccugcuuuccagccugcucaagaacgaugugccucuggcgggaccccucauugccggcgggaugcugaucgcuuguuacgucauuucuggaagcuccgccgaccuuucucuggagaaagcugccgaagugagcugggaggaagaggccgaacauuccggcgcuucucacaauauccugguugaggugcaggaugacgggacgaugaagauuaaagaugaggaacgggacgauacccucacaauccugcuuaaggcgacccugcucgccgucagcggaguguauccucuguccauccccgcuacacucuucgucugguacuuuuggcagaagaaaaagcaacgcucuggcgugcugugggacaccccuuccccucccgagguugaaagagccgugcuugaugacggcauuuaucggaucaugcagcgcgggcugcugggaagaucccaggucggcguggggguuuuccaggagaacguguuucauacgauguggcacgucacccggggagccgugcucauguaccaaggcaaacgccuggagcccagcugggcuucugugaagaaagaccuuauuuccuacgggggaggcuggagacugcagggcagcuggaauacaggggaagagguucaggucaucgccguggaacccggaaagaacccuaagaaugugcagaccgcgcccggcacauucaaaaccucugagggggaagucggagcuauugcccucgauuuuaagccgggcacauccgggagcccuaucgugaaccgggagggaaaaauuguuggccuguauggcaaugggguggucacgaccuccggaacauacgugucugccaucgcucaagccaaggcgagccaggagggcccccucccugaaaucgaggacgaaguuuucagaaaacgcaaccugaccauuauggaucuucaccccggguccggaaagacccggagauaucugcccgcuaucgugcgcgaggccauuaagcggaaacugagaacacucauccuggccccuacgcgcgucguggcuagcgaaauggccgaggcucuuaagggcaugccgauucgguaccagaccacagccguuaaaucugagcauaccgggaaggaaaucguggaccugaugugccacgcgacauuuaccaugagacuccugucccccguccgcgugccuaauuauaacaugaucauuauggaugaggcccauuucacggaccccagcucuaucgcugcccggggcuacauuagcacaagagugggaaugggcgaagcugccgccaucuuuaugaccgcuaccccucccggguccgucgaggcguucccucaaucuaaugccguuauucaggaugaggaacgggacaucccggagcgcagcuggaacuccggauaugaauggaucacagauuuucccggcaaaaccgugugguucgugccuucuauuaagagcgggaaugacaucgcuaacugucugagaaagaauggaaaacgggucauucagcucucccgcaagacauucgauaccgaguaccagaaaacgaagaacaacgacugggacuacgugguuacaaccgauaucagcgaaaugggcgccaauuuuagagccgaccgggugauugaucccagacgcugccuuaaaccugucauccugaaggacgggcccgagcgggugauucuggcuggcccgaugccuguuacaguggccucugcggcucaaagacgcggacggaucggcagaaaccacaauaaggagggggaucaguauaucuacaugggacagccccucaacaaugacgaagaucaugcccacuggaccgaggccaaaaugcugcuugacaacauuaauacgcccgaaggcaucauuccugcucuguucgagcccgaacgcgagaaguccgccgcgaucgauggggaguaucggcucagaggagaagcccgcaaaaccuuugucgagcugaugagacggggcgaccugccuguguggcucagcuacaaggucgcuuccgaaggguuccaguauucugaucgcagauggugcuuugacggcgagcggaacaaucaagugcuugaagagaacauggauguugagauuuggacaaaagaaggagagcgcaagaaacugagaccgcgguggcuggacgccagaaccuacagcgacccccucgcucugcgcgaguucaaggaguuugccgcuggccggagauccgugucuggggaucuuauccuggaaaucggaaagcucccucagcaccugacacagcgcgcccagaaugcgcuggacaaccucgugaugcuucauaauagcgagcaaggcgggcgggccuauagacacgcuauggaggaacugcccgauaccauugagacacugaugcuccuggcccuuaucgcuguccugaccggaggcguuacgcuguucuuucuguccggccgggggcugggaaaaacaagcauuggccuccuuugugugauggccucuuccgugcugcuguggauggccagcgucgaaccucauuggaucgcugcgucuauuauccucgaguucuuucugauggugcuucugauccccgagccggaccgccagagaaccccucaggauaaccagcucgccuacguugugauugggcugcuguucaugauccucaccgucgcugccaaugaaaugggacuucuggagacaaccaagaaagaccugggcauugggcacguggccgucgaaaaccaccaucacgcugccaugcucgauguggaccugcaucccgcguccgccuggacacuuuacgcuguugccacgaccaucauuacaccuaugaugcggcacaccaucgagaacacaaccgcuaauauuagccugacggccaucgcgaaccaagccgcuauccucaugggacuggauaagggcuggcccauuucuaaaauggacaucggcgugccucugcucgcccuugggugcuauagccaggucaauccccugacccugacagcugccgugcucaugcugguugcucauuacgccauuaucggaccgggccuucaggcgaaggccacccgcgaagcucaaaagagaacagccgcugggauuaugaaaaacccuaccguggauggaaucgucgccaucgaccuggaucccgugguguaugacacgaaguuugagaaacagcucggccagauuaugcugcugauccucuguacaucccagauucuucugaugcggaccacaugggcccugugcgagucuaucacccucgcgaccgggccccugacaacgcuuugggaaggaagcccuggcaaguucuggaauaccacaauugcuguuuccauggccaacaucuuccgcggcagcuaccuggcuggggccggacucgccuuuucccugaugaaaucucugggcgggggaagacggggcaccggggcucaaggagagacacucggcgaaaaguggaagcgccagcuuaaucagcugagcaaauccgaguucaacaccuauaagagaucuggcaucauggaagucgaccggagcgaggccaaagaggggcugaagagaggagaaacgacaaaacacgcggugucccgcggcaccgccaagcuccggugguuuguggagagaaaucuggucaagccggaagggaaaguuauugaucuuggauguggccgcgggggauggucuuacuauugcgcuggccugaagaaagugaccgaggugaagggcuacacaaaagggggacccggccacgaggaaccuauccccauggccaccuacggguggaaccucgucaagcugcauagcggaaaagacguguucuuuauuccucccgagaagugugauacacugcucugcgacaucggcgaauccagcccuaauccgacgauugaggaagggcggacccuuagaguucugaagaugguggagcccuggcugcgcggaaaccaguucuguaucaaaauucucaauccuuauaugcccucugucguggagacacuggaacaaaugcagcggaagcacggcggcaugcuuguuagaaacccucugucccgcaauagcacccaugagauguacugggugucuugcgggacaggaaacaucgucuccgcugugaauaugaccagccggaugcuccugaacagauuuacgauggcccaccgcaaacccaccuaugaacgggauguggaccugggcgcggggacaagacacgucgccguugagccggaaguggcuaaccucgauaucauuggacagcgcaucgagaauauuaagcaugagcacaaaucuaccuggcauuacgacgaagauaacccuuauaagacaugggccuaccacggcuccuaugaggugaagcccagcggguccgcuagcucuauggucaauggagugguuaaacugcuuaccaagcccugggacgugaucccuauggucacacagauugccaugaccgauacgacacccuucggccaacagagaguguuuaaagaaaagguugacacccggaccccuaaagcuaagcgcggcacagcccagaucauggaggugacggcgaaguggcuguggggguuccucagcagaaacaaaaagccgcggaucuguaccagagaagaguuuacacggaaaguccgcuccaaugccgcuauuggagccguguucguugacgagaaccaauggaacucugcuaaggaagccguggaggaugaaagauuuugggaccugguccaucgggagcgcgaacuucacaaacagggcaagugcgcgaccugcguguacaacaugauggggaagagagagaaaaagcugggagaguucggcaaagcgaaggggagccgggcuaucugguacauguggcucggcgcccgcuuccuggaauuugaggcccugggauucaugaaugaagaucacugguuuuccagagagaacucucucagcggcgucgagggggaaggacugcauaaacuuggcuauauucugcgggacaucuccaagauucccgggggaaauauguacgcugaugacacagccggcugggauacccgcaucacagaggacgaucuccagaacgaagcuaaaaucaccgacauuauggagccugaacacgcccugcuugcgaagucuaucuucaagcugacguaucagaauaaagugguuagagugcaacggcccgccaagaacgggaccgucauggaugugauuagccgcagagaccagcggggcuccggacaggugggcacauacgggcucaauaccuuuacaaacauggaggcucagcugauccgccaaauggagagcgaaggaauuuucucuccuuccgagcuggaaacccccaaccucgccggcagaguucuggauuggcuugagaaacaugggguggaacggcugaagagaauggcuaucagcggagacgacugugucgugaaaccgaucgaugaccgcuuugccacggcgcucacagcccugaaugauaugggcaagguucggaaggacauuccucagugggagcccucuaaaggguggaacgauuggcaacaggugccuuucugcucccaccacuuucaucaacuuaucaugaaggacggcagagagauugucgugcccugucgcaaucaggaugaacuggucggacgggcuagagugagccagggcgccggguggucccuccgcgagaccgcuugccugggaaaaucuuaugcccagauguggcaacugauguacuuccaccggagagaccuccgccuggcugccaacgcgaucuguagcgccguuccuguggauuggguccccacaucccggaccacguggagcauucaugcucaccaucaguggaugaccacagaagacaugcuuucuguguggaauagaguuuggaucgaggaaaacccguggauggaggauaagacccacauuuccagcuggggcgacgugccuuaucuggggaaacgcgaggaccaguggugcggaucucucaucggccugacagcccgggccaccugggcuacaaauauccaagucgccauuaaccaggugagacggcuuaucgggaaugaaaacuaccuggauuacaugaccagcaugaagagauuuaagaaugaguccgaccccgaaggcgcgcucugguga

SEQ ID NO: 18981 - RNA, 9879 nt, Artificial Sequence
  derived and/or modified CDS sequence (opt5) from DENV-1__JQ287661__SS-prME
agcgugaccaugcugcucaugcugaugcccaccgcccuugcuuuccaccugacgacccggggcggggagccucauaugaucgucaccaagcaggaacggggaaagucccuccuguuuaagaccucugccggcguuaacaugugcacccuuauugccauggaccugggggagcucugugaagauaccaugacauacaaaugcccccgcaucaccgaggcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcauuggcaaacugguucaucagaucuucgggaccgcuuacggaguccucuuuuccggcgugagcuggacgaugaagauugggaucggcgugcugcuuaccuggcugggacucaauucuagauccacaagccugucuaugaccuguauugccgucggccuggugacacuuuaccucgggguuauggugcaggcugauuccggaugcgucaucaacuggaaaggccgcgaacugaagugugggagcggaauuuucgugaccaaugagguucacacauggaccgaacaauauaaguuucaggccgacuccccuaaacggcugucugcggccaucggcaaggcuugggaggagggggugugcggcaucagaagcgccacgcgccucgaaaacgucauguggaaacagauuuccaacgagcugaaucauauccuucuggaaaacgacaugaaguucacagugguugugggagaugucgugggcauucucgcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaagaugcgcgauuccuacacacagguuugcgaccaccggcugaugagcgcggccauuaaagauucuaaggcugugcaugccgacaugggcuauuggaucgaauccgagaaaaaugaaaccuggaaacuugccagagcuagcuucaucgaggugaagacauguauuuggcccaaaucucacacccucugguccaacgggguccuggaaagcgagaugaucauuccgaagaucuacggaggcccuauuucucaacauaauuaucgccccggguacuucacacagaccgccggaccuuggcaccugggcaaacucgagcuggauuuugaccuuugcgaagggacgaccgugguuguggaugagcacugcggaaaccggggccccagccugagaacaaccacagucaccggcaagaucauccaugaaugguguugccgguccuguacgcucccuccccugcgcuucaaaggggaggacggaugcugguacggcauggagauuagaccggugaaggaaaaggaggaaaaucugguuaaaagcauggugucugcgggguccggagaggucgacagcuuuucccuuggccuccuguguaucucuauuaugaucgaagaggugaugcggagcagauggucccgcaagaugcugaugacagggacccucgcuguuuuccugcuucugauuaugggacagcucacauggaacgaucugauccggcugugcauuauggugggcgccaaugccucugacagaaugggcauggggaccaccuaucuugcucugauggccacauuuaaaaugcgcccuauguucgcggucggacuccuguuuagacggcucacgagccgcgaggugcugcuucugaccaucggccucucccugguggcuucugucgaacugcccaacagccuugaggaacugggggauggacucgccaugggcaucaugauucugaagcuccugacagacuuccaaucccaccagcuuugggccacccugcucagccugacauuuaucaaaaccacgcugucucuucauuacgcuuggaagacaauggccaugguucuguccauugugagccucaucccccugugucucucuaccaccucccagaagacaaccuggcugccugugcuucuggggagccugggaugcaaaccgcucacaauguuccugauugcugagaauaagaucuggggcagaaaaucuuggccccuuaacgaaggcaucauggccgucggggugguuuccauucugcucagcucccugcucaagaacgaugugccucuggcgggaccccuuaucgccggcgggaugcugauugcuuguuaugucaucagcggaucuagcgccgaccugucccucgagaaagcugccgaggugucuugggaagaggaagccgagcacagcggcgcuucccauaauauucugguugaagugcaggaugacgggacgaugaagaucaaagaugaggagcgggacgauacccuuacaauccugcucaaggcgacccugcucgccgucucuggaguguacccucugagcauucccgcuacacuuuuugucugguauuucuggcaaaagaaaaagcagcgcuccggcgugcugugggacaccccuucucccccggaaguugagagagccgugcuggaugacggcaucuaccggauuaugcagcgcgggcuccugggaagaagccaggucggcguggggguuuuucaagaaaacguguuccacacgauguggcacgucacccggggagccgugcuuauguaucagggcaaacgccuggagccuuccugggcuagcgugaagaaagaccucaucucuuacgggggaggcuggagacugcagggcuccuggaauacaggggaggaaguucaggucauugccguggagcccggaaagaacccuaagaaugugcaaaccgcgcccggcacauucaaaaccccggaaggggaggucggagcuaucgcccucgauuuuaagccuggcacaagcgggucucccauugugaaccgggaaggaaaaaucguuggccuguacggcaaugggguggucacgaccuccggaacauaugugagcgccaucgcucaggccaaggcgucccaggagggcccucuucccgagauugaagacgagguuuucagaaaacgcaaccugaccaucauggaucugcaucccgggucuggaaagacccggagauaccucccugcuauugugcgcgaagccaucaagcggaaacugagaacacuuauucuggccccgacgcgcgucguggcuagcgagauggccgaagcucucaagggcaugcccauccgguaucaaaccacagccguuaaauccgagcacaccgggaaggagaucguggaccugaugugccaugcgacauuuaccaugagacugcucagcccuguccgcgugcccaauuacaacaugauuaucauggaugaagcccacuucacggacccuucuuccauugcugcccggggcuauaucagcacaagagugggaaugggcgaggcugccgccauuuuuaugaccgcuacacccccugggucugucgaagcguucccgcagagcaaugccguuauccaggaugaggaacgggacauccccgagcgcuccuggaacucuggauacgaguggauuacagauuuuccuggcaaaaccgugugguucgugcccagcaucaaguccgggaaugacauugcuaacugucuuagaaagaauggaaaacgggucauccagcugucucgcaagacauuugauaccgaauaucagaagacgaagaacaacgacugggacuacgugguuacaaccgauauuagcgagaugggcgccaauuucagagccgaccgggugaucgauccuagacgcugccugaaacccgucauucucaaggacgggccggaacgggugauccuggcuggcccuaugcccguuacaguggccuccgcggcucagagacgcggacggaucggcagaaaccauaauaaggagggggaucaguacauuuauaugggacagccccuuaacaaugacgaggaucacgcccacuggaccgaagccaaaaugcugcucgacaacaucaauacgccugagggcauuauccccgcucuguuugaaccugagcgcgaaaagagcgccgcgauugauggggaguaccggcugagaggagaggcccgcaaaaccuucgucgaacucaugagacggggcgaccuuccgguguggcugucuuauaaggucgcuuccgagggguuccaauacagcgaucgcagauggugcuuugacggcgaacggaacaaucaggugcuggaggaaaacauggauguugagaucuggacaaaagagggagaacgcaagaaacucagaccccgguggcuggacgccagaaccuauuccgacccucuugcucugcgcgaguucaaggaauuugccgcuggccggagaucugugagcggggaucucauccuggagauuggaaagcugccccagcaucucacacagcgcgcccaaaaugcgcuugacaaccuggugaugcugcacaauuccgaacagggcgggcgggccuacagacaugcuauggaggagcucccugauaccaucgaaacacugaugcuucuggcccucauugcuguccugaccggaggcguuacgcuguucuuucucucuggccgggggcuuggaaaaacaagcaucggccugcugugugugauggccuccagcgugcuccuguggauggccucugucgagccccacuggauugcugcguccaucauccuugaguucuuucugauggugcuccugauuccggagccugaccgccagagaacaccccaggauaaccaacuggccuauguugugaucgggcuccuuuucaugauucugaccgucgcugccaaugagaugggacugcucgaaacaaccaagaaagaccugggcaucgggcacguggccgucgagaaccaucaccaugcuacaaugcuugauguggaccugcacccugccagcgcguggacgcucuacgccguugcuaccacaauuaucacccccaugaugcggcauacaauugaaaacaccacggccaauaucucucugaccgcuaucgccaaccaggcggccauucugaugggacucgauaagggcuggccuaucuccaaaauggacauuggcgugccccuucuggcucuggggugcuacagccaggucaauccgcucacacugaccgccgcugugcuuaugcugguugcccacuaugcuaucauuggaccuggccuccaagccaaggcgacacgcgaggcccagaagagaaccgcugccgggaucaugaaaaaccccacgguggauggaaucgucgcuauugaccuggaucccgugguguacgacgccaaguuugaaaaacagcugggccagaucaugcuccuuauucuguguacaucucaaauccugcucaugcggaccacaugggcccugugcgagagcauuacccuugcgaccgggccucugacaacgcucugggagggauccccgggcaaguucuggaauaccacaaucgcuguuucuauggccaacaucuuucgcggcagcuaucuggcuggggccggacuggccuucucccucaugaaaagccuuggcgggggaagacggggcaccggggcucagggagaaacacugggcgagaaguggaagcgccagcugaaucagcucuccaaaucugaauuuaacauuuacaagagaagcggcaucauggaggucgaccgguccgaagccaaagaggggcugaagagaggagagaccacgcgccacgcggugucucggggcacagccaaacuuagaugguucguggaacgcaaucuggucaagcccgaggggaagguuauugaucucggauguggcagagggggauggagcuauuacugcgcuggccugaaaaaggugaccgaagugaaaggcuauaccaaagggggaccuggccaugaggaacccaucccuauggccacauacggguggaaccuggucaaacuccacuccggaaaggacguguucuuuacacccccugagaaaugugauacacuucugugcgacauuggcgagucuagcccgaaucccacgaucgaagaggggagaacccugcgcguucucaagaugguggaaccuuggcugcggggaaaccaauucuguauuaagauccuuaaucccuacaugccuuccgucguggagacacuggagcagaugcagagaaaacauggcggcaugcucguucgcaacccccugagcagaaauucuacccacgaaauguauuggguguccugcgggacaggaaacaucgucagcgcugugaauaugaccucuagaaugcugcucaaccgcuuuacgauggcccaccggaagccgaccuacgagaaagauguggaccugggcgcggggacaagacaugucgccguugaaccugagguggcuaaccuugauauuaucggacagcgcauugaaaauaucaagcacgagcauaaauccaccuggcacuaugacgaggauaaccccuacaagacaugggccuaucauggcagcuacgaagugaagcccucuggguccgcuagcuccauggucaauggagugguuaaacugcucaccaagccuugggacgugauucccauggucacacaaaucgccaugaccgauacgacaccuuucggccagcagagaguguuuaaagagaagguugacacccggaccccgaaagcuaagcgcggcacagugcaaaucauggaagucacggccagauggcuguggggguuccuuagccggaacaagaaacccagaauuuguacccgggaggaauuuacacgcaaggugagaucuaaugcggccaucggagcuguuuucguggacgagaaccaguggaauagcgccaaagaggcugucgaagaugagcgguuuugggaccuggugaagaaagaacgcgagcuccacaagcagggcaagugcgcgaccugcgucuauaacaugauggggaaaagagaaaagaaacugggagaguucggcaaggccaaagggucccgggcgauuugguacauguggcugggcgcucgcuuucucgaguucgaagcccugggauuuaugaaugaggaucacugguucucuagagaaaacagccuuuccggcguggagggggagggacugcauaagcucggcuacauccugcgggacauuucuaaaaucccugggggaaauauguaugccgaugacacagcuggcugggauacccgcaucacagaagacgaucuucagaacgaggccaagauuaccgacaucauggaacccgagcacgcucugcucgccacgagcauuuucaagcugaccuaccaaaauaaaguugugagaguccagcggccugcgaagaacgggacagugauggaugugaucucccgcagagaccagcggggcucuggacagguuggcaccuaugggcugaauacauuuaccaacauggaagcccaacucauucgccagauggagagcgagggaaucuuccugcccuccgaacuugagacgccgaaccuggcugaaagagugcucgauuggcuggagaaauacggcgucgaacggcuuaagagaauggccaucagcggggacgacugugugguuaaaccuauugaugaccgcuuugcuacagcccugaccgcgcucaaugauaugggaaaggugcggaaggacaucccccagugggagccuucuaaaggcuggaacgauuggcagcaaguccccuucugcucccaucacuuucaccagcugauuaugaaggacgggagagagaucguggucccuugucgcaaucaggaugaacuggugggccgggccagaguuagccagggagcuggcuggucucuccgcgagacagccugccuggggaaauccuaugcucaaauguggcagcuuauguacuuccaucggagagaccugcgccucgccgcuaacgccauuuguagcgcggugcccgucgauugggugccgaccucccggacgaccuggucuauccacgcccaucaccaguggaugacaaccgaagacaugcugagcguuuggaauagaguguggauugaggaaaacccuuggauggaggauaagacacaugucuccagcuggggagacgugcccuaucuuggcaaacgcgaggaccaauggugcgggucucugaucggacucaccgcucgggccacaugggccuccaauauccagguggcuauuaaccagguuagacggcugaucggcaaugaaaacuaccuggauuacaugaccagcaugaagagauuuaagaaugagggggaccccgaaggcgcccucugguga

SEQ ID NO: 18982 - RNA, 9879 nt, Artificial Sequence
  derived and/or modified CDS sequence (opt5) from DENV-1__FJ882518__SS-prME
agcgugaccaugcugcucaugcugaugcccaccgcccuugcuuuccaccugacgacccggggcggggagccucauaugaucgugacaaagcaggaacggggaaaaucccuccuguuuaagaccucugccggcguuaauaugugcacccuuauugccauggaccugggggagcucugugaagauaccaugacauacaaaugcccgcgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuuguuacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacguccagaauaccaccuuuaucaucgaugggccuuccacacccgaauguccugacgaucagagagcuuggaacauuugggagguugaggacuauggauucggcaucuuuaccacgaauauuuggcugaagcugcgcgauagcuacacacaggugugcgaccaccggcuuaugucugcggccaucaaagauuccaaggcugugcaugccgacaugggcuauuggauugaaagcgagaaaaacgaaaccuggaagcucgccagagcuucuuucaucgaggucaagacauguaucuggcccaaaucccacacccuguggagcaauggggugcuggaaucugagaugauuaucccgaagauuuacggaggcccuaucagccaacauaacuaucgccccggguacuucacacagaccgccggaccuuggcaccucggcaaacuggagcuugauuuugaccugugcgaagggacgaccguuguggucgaugagcacugcggaaaucggggccccucccucagaacaaccacagugaccggcaagauuauccaugaaugguguugccggagcuguacgcugccuccccugcgcuucaaaggggaggacggaugcugguacggcauggagaucagaccgguuaaggaaaaggaggaaaaccuugugaaaucuauggucuccgcggggagcggagagguggacuccuuuucucucggccugcuguguauuagcaucaugauugaagagguuaugcgguccagauggucucgcaagaugcucaugacagggacccuggcuguguuccuucugcucaucaugggacagcugacauggaaugaucugauucggcuuugcaucauggucggcgccaacgccagcgacagaaugggcauggggaccaccuaucuggcucucauggccacauuuaaaaugcgcccuauguucgcggugggacugcucuuuagacggcugacgucccgcgaggugcuucugcucaccauuggccugucucuggucgcuagcguugaacuucccaauucccuggaggaacucggggauggacuggccaugggcaucaugauccucaagcugcuuacagacuuccaaagccaccagcugugggccacccuccugucucugacauuuauuaaaaccacgcuuucccugcauuacgcuuggaagacaauggccauggugcucagcaucgcuucucuguucccccucugucuguccaccaccagccagaagacaaccuggcuuccugugcugcuggggucucucggaugcaaaccgcugacaauguuucuuauuacggagaccaagaucuggggcagaaaauccuggccccugaacgaaggcauuauggccgucggggugguuagcauccuccuguccagccuccugaagaaugaugugccucuugcgggaccccugaucgccggcgggaugcugauugcuuguuaugucaucucuggaagcuccgccgaccucucucuggagaaagcugccgaggugagcugggaagaggaagccgagcacuccggcgcuucucauaacauucuuguugugguccaggaugacgggacaaugaagaucaaagaugaggaacgggacgauacccugacaauucuccugaaggcgacccuccuggccgugagcggagucuacccucuuuccauccccgcuacgcuguucgugugguauuuuuggcaaaagaaaaagcagcgcucuggcguucugugggacaccccuagcccucccgagguggaaagagccguccucgaugacggcaucuaccggauuaugcagcgcgggcugcuuggaagaucccaggugggcguugggguguuccaagagaacgucuuccacacaauguggcacgugacccggggagccgugcugauguaucagggcaaacgccucgaacccagcugggcuucuguuaagaaagaccugaucuccuacgggggaggcuggagacuccagggcagcuggaauacaggggaggagguccaggugauugccguggaacccggaaagaacccuaagaauguccaaaccgcgcccggcacauuuaaaacgccggagggggaagugggagcuaucgcccuggauuucaagccuggcaccucugggucccccauuguuaaccgggagggaaaaaucgugggccuuuacggcaauggggucgugacaaccagcggaaccuauguuuccgccauugcucaggccaaggcgucucaggaaggcccucugcccgagaucgaggacgaaguguuuagaaaacgcaaccugacaaucauggaucuccaucccgggagcggaaagacgcggagauaccugccugcuauuguccgcgaggccaucaagcggaaacuuagaacccugauucucgccccgacacgcgugguugcuuccgaaauggccgaggcucugaagggcaugcccauccgguaucaaaccacagccgugaaaagcgaacacaccgggaaggagauugucgaccugaugugccaugcgacguucacaaugagacuccuuucuccugugcgcgugcccaauuacaacaugaucaucauggaugaggcccacuuuaccgacccuuccagcauugcugcccggggcuauaucucuaccagagucggaaugggcgaagcugccgccauuuucaugacagcuacacccccugggagcguugaggcguuuccgcaguccaaugccgugauccaggaugaggaacgggacauucccgaacgcucuuggaacagcggauacgaguggaucacagauuucccuggcaaaaccgugugguuuguccccuccaucaagucugggaaugacauugcuaacugucugagaaagaauggaaaacgggugauccagcugagccgcaagacguucgauacagaguaucagaagaccaagaacaaugacugggacuacguugugacaaccgauauuuccgaaaugggcgccaacuuuagagccgaccgggucaucgauccuagacgcugccucaaacccgugauucugaaggacgggccggagcggguuauccuugcuggcccuaugcccgugacggucgccagcgcggcucagagacgcggacggauuggcagaaaccauaauaaggaaggggaucaguacaucuauaugggacagccccugaacaaugacgaggaucacgcccacuggaccgaggccaaaaugcuccuggacaacaucaauacaccugaaggcauuauccccgcucuguucgagccugaacgcgagaagucugccgcgauugauggggaauaccggcucagaggagaggcccgcaaaaccuucguggagcuuaugagacggggcgaccugccggucuggcuguccuauaagguggcuagcgaaggguuucaauacuccgaucgcagauggugcuucgacggcgagcggaacaaucagguucucgaagagaacauggauguggaaaucuggacaaaagagggagagcgcaagaaacugagaccccgguggcuugacgccagaaccuauucugacccucuggcucuccgcgaauuuaaggaguucgccgcuggccggagaagcguguccggggaucugauucuggaaaucggaaagcucccccagcaucuuacacagcgcgcccaaaaugcgcuggacaaccuggucaugcuccacaauucugagcagggcgggcgggccuacagacaugcuauggaggaacugccugauaccaucgagacgcuuaugcugcucgcccugauugcuguucugacaggaggcgugacccucuuuuuccuuagcggccgggggcugggaaaaaccuccaucggccugcucugugugauggccagcucuguccugcuuuggauggccuccguggaaccccacuggauugcugcgagcaucauucuggaguuuuuccucaugguucugcugaucccggaaccugaccgccagagaacaccccaggauaaccaacucgccuauguggucaucgggcuucuguuuaugauucugaccguggcugccaaugagaugggacuccuggagacaacgaagaaagaccuuggcaucgggcacgucgccguggaaaaccaucaccaugcuaccaugcuggauguugaccuccacccugccucugcguggacacuguacgccguggcuaccacaauuaucacccccaugaugcggcauacgauugagaauaccacagccaacaucucccugaccgcuauugccaaccaggcggccauccucaugggacuugauaagggcuggccuaucagcaaaauggacauuggcgucccccugcuggcucucgggugcuacucucaggugaauccgcugacacuuaccgccgcuguucugaugcucguggcccacuaugcuaucauuggaccuggccugcaagccaaggcgacgcgcgaagcccagaagagaacagcugccgggaucaugaaaaaccccaccgucgauggaauuguggcuaucgaccuggaucccgugguuuacgacgccaaguucgagaaacagcucggccagaucaugcuucugauucuguguacaagccaaauccuccugaugcggaccaccugggcccuuugcgaauccauuacacuggcgacggggccucucaccacacugugggagggaucuccgggcaaguuuuggaauaccacaaucgcugucagcauggccaacauuuuccgcggcuccuaucuggcuggggccggacucgccuuuagccuuaugaaaucccugggcgggggaagacggggcaccggggcucagggagagacgcugggcgaaaaguggaagcgccagcucaaucagcugucuaaaagcgaguucaacaucuacaagagauccggcaucauggaaguggaccggucugaggccaaagaagggcuuaagagaggagagacaacccgccacgcggugagccggggcaccgccaaacugagaugguucgucgagcgcaaucucguuaagcccgaagggaaggugauugaucugggauguggcagagggggaugguccuauuacugcgcuggccugaaaaaggugacagaggucaaaggcuauaccaaagggggaccuggccaugaggagcccaucccuauggccacauacggguggaaccucgugaaacuucacucuggaaaggacgucuuuuucacgcccccugaaaaaugugauacccugcugugcgacauuggcgagagcuccccgaaucccacaaucgaggaagggagaacccuccgcgugcugaagauggucgagccuuggcuucggggaaaccaauuuuguauuaagauccugaaucccuacaugccuagcgugguugaaacacucgagcagaugcagagaaaacauggcggcaugcuggugcgcaacccccugucuagaaauuccacccacgagauguauugggucagcugcgggacgggaaacauugugucugcugugaauaugaccuccagaaugcuccugaaccgcuucacaauggcccaccggaagccgaccuacgaaagagaugucgaccuuggcgcggggacacgccauguugccguggagccugaaguggcuaaucuggauaucaucggacagagaauugagaacaucaaacacgaacauaagagcaccuggcacuaugacgaggauaaccccuacaaaacaugggccuaucauggcucuuacgaggucaagcccuccgggagcgcuuccagcauggugaauggaguugugaagcuccugaccaaaccuugggacgucauucccauggugacgcaaaucgccaugacagauaccaccccuuuuggccagcagcggguuuucaaggaaaaaguggacacacgcacgccgaaggcuaaaagaggcaccgcccaaauuauggaggucacagcgcgguggcuuuggggguuucugucuagaaacaagaagccccggaucuguacccgcgaagaguucacaagaaaagugcggagcaaugccgcuaucggagccguuuuuguggacgaaaaccaguggaacuccgcuaaggaggccgucgaggaugaacgcuucugggaccucgugcagaaagagagagaacugcacaagcagggcaaaugcgcgaccugcgucuauaacaugauggggaagcgggagaagaaacugggagaauuuggcaaggcgaaagggucucgcgcuauuugguacauguggcucggcgccagauuccuggaguuugaggcccuuggauucaugaaugaagaucacugguucagccgggagaacucccugucuggcguggaaggggagggacuccauaagcugggcuacauccuucgcgacauuagcaaaaucccugggggaaauauguaugcugaugacacagccggcugggauaccagaauuacggaggacgaucugcaaaacgaagcuaagaucaccgacaucauggagcccgaacacgcccuccuggcgacauccauuuuuaaacugaccuaccagaauaagguugugcggguccagcgcccugccaagaacgggacagugauggaugugaucucuagacgggaccagcgcggcagcggacaaguuggcaccuaugggcucaauacguucacaaacauggaggcucagcugauuagacagauggaauccgagggaaucuuucuucccagcgagcuggaaaccccgaaucucgccgagcgggugcuggauuggcuugaaaaauacggcgucgagagacugaagcgcauggcuauuucuggggacgacugugugguuaaaccuaucgaugaccgguucgccacagcgcucaccgcccugaacgauaugggaaaggugagaaaagacaucccccagugggaaccuuccaagggcuggaacgauuggcaacagguccccuuuugcagccaucacuuccaccagcugauuaugaaggacgggcgcgagaucguggucccuugucggaaucaggaugagcucgugggcagagcucgcguuucucaaggagccggcuggucccugcgggaaacggcuugccuugggaaaagcuaugcccagauguggcagcugauguacuuucauagacgcgaccuccggcuggcugccaacgcgauuuguuccgccgugcccgucgauugggugccgaccucuagaacaaccuggagcauccacgcucaucaccaauggaugacaaccgaggacaugcuuuccguuuggaaucgcguguggauugaagagaacccuuggauggaagauaagacacaugucagcucuuggggagacgugcccuaucugggcaaacgggaggaccaguggugcgggucccucaucggacugaccgccagagccacgugggcuagcaauauucagguggccaucaaccagguucggagacugaucggcaaugagaacuaccucgauuacaugacaucuaugaagcgcuucaaaaaugaaggggaccccgagggcgcgcugugguga

SEQ ID NO: 18983 - RNA, 9879 nt, Artificial Sequence
  derived and/or modified CDS sequence (opt5) from DENV-1__FJ882519__SS-prME
agcgugacaaugcugcugaugcugaugcccacagcccuugcuuuccaccugacgaccagaggaggggaaccucauaugaucgucuccaagcaggaacggggaaaaucucuccuguuuaagacaagcgccggcguuaauaugugcacccuuauugcgauggaccugggggaguucugugaagauacaaugaccuacaaaugcccgagaaucacagaagcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacagaacaguauaaauuccaagccgacucuccuaagcggcugagcgcggccauuggcaaggcuugggaggagggggugugcggcaucagauccgccacccgccuggaaaacaucauguggaagcagauuucuaacgagcucaaucauauccugcuugaaaacgacaugaaauuuacgguuguggucggagauguggcuggcauucuggcccaggggaagaaaaugauccggccgcagcccauggaguacaaguauagcuggaaguccuggggaaaagccaagauuaucggcgcugacgugcaaaauacaaccuucaucauugaugggccuaacacccccgaauguccugacgaucagagagcguggaauaucugggaggucgaggacuacggauuuggcauuuucacaaccaacaucuggcucaaacugcgcgauagcuauacgcagguuugcgaccaccggcugaugucugccgcuauuaaggauuccaaagccgugcacgccgacaugggcuacuggaucgaaagcgagaagaaugaaacauggaaacuugcuagagccucuuucaucgaggugaaaaccuguauuuggcccaagucccauacacucuggagcaacgggguccuggaaucugagaugaucauuccgaaaaucuauggaggcccuauuagccagcacaauuaccgccccggguacuuuacccaaacagcgggaccuuggcaucugggcaagcucgagcuggauuucgaccuuugcgaagggaccacggugguuguggaugagcacugcggaaaccggggccccucccugagaaccacaaccgucacaggcaaaaucauccacgaaugguguugccggagcuguacccucccuccccugcgcuuuaagggggaggacggaugcugguauggcauggagauuagaccggugaaggaaaaagaggaaaaucugguuaagucuaugguguccgcugggagcggagaggucgacuccuucucucuuggccuccuguguaucagcauuaugaucgaagaggugaugcgguccagauggucucgcaaaaugcugaugacggggacacucgccgucuuuuuccugcuuauuaugggacagcugaccuggaacgaucucauccggcugugcauuauggugggcgccaaugcuagcgacagaaugggcauggggacaaccuaccuggcccuuauggcgaccuuuaagaugcgcccuauguucgcugucggacugcucuuuagacggcugacaucccgcgaggugcuccugcuuacgaucggccugucucucguggccagcgucgaacugcccaacucccuggaggaacuuggggauggacuggccaugggcaucaugauucucaaacugcucaccgacuuccagagccaucaacugugggcuacacuucugucucucaccuuuaucaagacaaccuucucccugcacuaugccuggaagacgauggcuaugguucugagcauugugucucuuuuuccccugugucucuccacaaccagccagaaaaccacauggcugccugugcuccuggggucucuuggaugcaagccgcugaccauguuccugaucgccgagaauaaaauuuggggcagaaaguccuggccccucaacgaaggcaucauggcggucgggaucgugagcauucugcuuuccagccugcucaaaaacgauguuccucuggccggaccccucaucgcuggcgggaugcugauugccuguuacgugaucucuggaagcuccgcugaccuuucucuggagaaggccgccgaggucagcugggaagaggaagcugagcauuccggcgcgucucacaauauucugguggaaguucaggaugacgggacaaugaaaaucaaggaugaggagcgggacgauacgcucaccauccugcuuaaggccacacugcucgcugugagcggagucuauccucuguccauucccgccacccucuucgugugguacuuuuggcagaaaaagaaacaacgcucuggcguccugugggacacaccuuccccucccgaaguggagagagccguucuugaugacggcaucuaucggauuaugcagcgcgggcugcugggaagaucccaggugggcgucgggguguuccaggaaaacguuuuucauaccauguggcacgugacgcggggagcuguccucauguaccaaggcaagcgccuggagcccagcugggccucugugaaaaaggaccuuaucuccuacgggggaggcuggagacugcagggcagcuggaauaccggggaggaagugcagguuauugcggucgagcccggaaagaacccuaaaaaugugcagacagcucccggcaccuucaagacaucugaaggggaggugggagccaucgcccucgauuuuaaaccgggcaccuccgggagcccuauugucaaccgggaaggaaagaucgugggccuguauggcaaugggguugugacaacguccggaaccuacgucucugcuaucgcccaagcgaaagcuagccaggagggcccccucccugagauugaagacgagguguucagaaagcgcaaccugacaaucauggaucuucaccccggguccggaaagacccggagauaucugcccgccauuguucgcgaagccaucaaacggaagcugagaacccucauucuggcuccuacacgcguggucgccagcgagauggcugaagcccuuaaaggcaugccgauccgguaccagacgaccgcggugaagucugagcauacagggaaagagaucguugaccugaugugccacgccaccuuuacaaugagacuccugucccccgugcgcgucccuaauuauaacaugauuaucauggaugaagcucauuucaccgaccccagcucuauugccgcucggggcuacaucagcacgagagugggaaugggcgaggccgccgcuauuuuuaugacagcgaccccucccggguccguggaagccuucccucaaucuaaugcugucauccaggaugaggaacgggacaucccggagcgcagcuggaacuccggauaugaguggauuaccgauuuucccggcaagacaguuugguucgugccuucuaucaagagcgggaaugacauugccaacugucugcgcaagaauggaaagcgggugauccagcucucccgcaaaaccuucgauacagaauaccagaagaccaaaaacaacgacugggacuacgucgugacgacagauauuagcgagaugggcgccaauuuuagagcugaccggguuaucgaucccagacgcugccuuaagccugugauucugaaggacgggcccgaacgggucauccuggccggcccgaugccugugaccguugcgucugcugcccaaagacgcggacggaucggcagaaaccacaauaaagagggggaucaguauauuuacaugggacagccccucaacaaugacgaggaucaugcccacuggacagaagcuaagaugcugcuugacaacaucaauacccccgagggcauuaucccugcccuguucgaacccgagcgcgaaaaauccgcggccauugauggggaguaucggcucagaggagaggcucgcaagacguuuguggaacugaugagacggggcgaccugccugucuggcucagcuacaaaguggccuccgagggguuccaguauucugaucgcagauggugcuuugacggcgaacggaacaaucaaguccuugaggaaaacauggauguggagaucuggaccaaggagggagaacgcaaaaagcugagaccgcgguggcuggacgcuagaacauacagcgacccccucgcccugcgcgaguucaaggaauuugcugccggccggagauccguuucuggggaucuuauccuggagauuggaaaacucccucagcaccugacccagcgcgcgcagaaugcccuggacaaccucgugaugcuucauaauagcgaacaaggcgggcgggcuuauagacacgccauggaggagcugcccgauacaaucgaaacccugaugcuccuggcucuuauugccgugcugacaggaggcgucacccucuucuuucuguccggccgggggcugggaaagacgagcaucggccuccuuuguguuauggccucuuccgugcugcuguggauggcuagcguggagccucauuggauugcggccucuaucauccucgaguucuuucugaugguccuucugauucccgagccggaccgccagagaacaccucaggauaaccagcucgcuuacgugguuaucgggcugcuguucaugauucucaccguggccgccaaugagaugggacuucuggaaaccaccaagaaggaccugggcaucgggcacgucgcuguggagaaccaccaucacgccgcgaugcucgaugucgaccugcaucccgccuccgcuuggacccuuuacgccguggcuacaacgauuaucaccccuaugaugcggcacacaauugaaaacaccacagccaauaucagccugaccgcgaucgccaaccaagcugccauucucaugggacuggauaaaggcuggcccaucucuaagauggacauuggcguuccucugcucgcucuugggugcuauagccaggugaauccccugacgcugaccgccgcuguccucaugcugguggcccauuacgcgaucauuggaccgggccuucaggccaaggcuacacgcgaggcccagaaaagaaccgcugccgggaucaugaagaacccuacaguugauggaaucguggccauugaccuggaucccgucguguaugacgcgaaauuugaaaagcagcucggccagaucaugcugcugauucucuguaccucccagauccuucugaugcggacgacaugggcucugugcgagucuauuacccucgccacagggccccugaccacccuuugggagggaagcccuggcaaauucuggaauacaacgaucgcuguguccauggccaacaucuuccgcggcagcuaccuggccggggcuggacucgccuuuucccugaugaagucucugggcgggggaagacggggcaccggggcgcaaggagaaacacucggcgagaaguggaaacgccagcuuaaucagcugagcaaguccgaguucaacaccuauaaaagaucuggcauuauggagguugaccggagcgaagccaaggaggggcugaaaagaggagagacaaccaagcacgcugucucccgcggcacggccaagcuccggugguuuguggaaagaaaucuggugaaaccggaggggaaggucaucgaucuuggauguggccgcgggggauggucuuacuauugcgcuggccugaaaaagguuacagaagugaaaggcuacaccaaagggggacccggccacgaggaaccuauucccauggccaccuacggguggaaccucgugaaacugcauagcggaaaggacgucuucuuuaucccucccgagaagugugauacacugcucugcgacauuggcgaguccagcccuaauccgaccaucgaagaggggcggacacuuagagugcugaaaaugguugaacccuggcugcgcggaaaccaguucuguauuaagauccucaauccuuauaugcccucuguggucgagacgcuggagcaaaugcagcggagacacggcggcaugcuugugcgcaacccucugucccggaauagcacccaugaaauguacuggguuucuugcgggacaggaaacaucguguccgcggucaauaugaccagcagaaugcuccugaaccgcuuuacaauggcccaccggaaacccaccuaugagagagauguggaccugggcgcugggacgcgccacguggccgucgaaccggagguugcuaaccucgauauuaucggacagagaauugaaaauaucaagcaugagcacaaaucuaccuggcauuacgacgaggauaacccuuauaagacaugggccuaccacggcuccuaugaagugaagcccagcggguccgcuagcucuauggugaauggagucgugaaacugcuuaccaagcccugggacguuauuccuauggugacacagaucgccaugaccgauacaacccccuucggccaacagcgggucuuuaaagagaagguggacacgcgcacaccuaaagcgaagagaggcaccgcccagaucauggaaguuaccgcuaaguggcuguggggguuccucagccggaacaaaaagccgagaauuuguacacgggaggaauuuacgcgcaaagugagauccaaugccgcuaucggagccgucuucguggacgagaaccaauggaacucugccaaggaggcgguugaagaugagcgguuuugggaccuggugcaucgcgaaagagagcuucacaaacagggcaagugcgcuaccugcgucuacaacaugauggggaagcgggagaaaaagcugggagaguucggcaaagccaaggggagccgcgccauuugguacauguggcucggcgcuagauuccuggaguuugaagcccugggauucaugaaugaggaucacugguuuucccgggaaaacucucucagcggcguggagggggagggacugcauaaacuuggcuauauccugcgcgacauuuccaagauccccgggggaaauauguacgcugaugacacagccggcugggauaccagaaucacagaagacgaucuccagaacgaggcgaaaauuaccgacaucauggaaccugagcacgcccugcuugcuaagucuauuuucaagcugacauaucagaauaaagucgugcggguucaacgccccgccaagaacgggaccgugauggaugucaucagcagacgggaccagcgcggcuccggacaggugggcacguacgggcucaauaccuuuacaaacauggaagcucagcugauuagacaaauggagagcgagggaaucuucucuccuuccgaacuggagacccccaaccucgccggccgggugcuggauuggcuugaaaaacaugggguugagagacugaagcgcauggcgaucagcggagacgacuguguggucaaaccgauugaugaccgguuugccacagcucucaccgcccugaaugauaugggcaaggugagaaaggacaucccucagugggaacccucuaaaggguggaacgauuggcagcagguuccuuucugcucccaccacuuucaucaacuuauuaugaaggacggccgcgagaucgugguccccugucggaaucaggaugagcuggugggcagagcucgcgucagccagggcgccggguggucccuccgggaaacggcuugccugggaaaaucuuaugcccagauguggcaacugauguacuuccacagacgcgaccuccggcuggcggccaacgcuauuuguagcgccgugccuguugauugggugcccacauccagaaccacauggagcauccaugcccaccaucaguggaugaccacggaggacaugcuuucugucuggaaucgcguguggauugaagagaacccguggauggaagauaagacccacaucuccagcuggggcgacguuccuuaucuggggaaacgggaggaccaguggugcggaucucucaucggccugacagcuagagccaccugggcgacaaauauucaaguggcuaucaaccagguccggagacuuauugggaaugagaacuaccuggauuacaugaccagcaugaagcgcuuuaagaaugaauccgaccccgagggcgcccucugguga

SEQ ID NO: 18984 - RNA, 9879 nt, Artificial Sequence
  derived and/or modified CDS sequence (opt5) from DENV-1__FJ882520__SS-prME
agcgugaccaugcugcucaugcugaugcccaccgcccuugcuuuccaccugacgaccagaggcggggaaccucauaugaucgucuccaagcaggaacggggaaagucucuccuguuuaagacgagcgccggcguuaauaugugcacccuuaucgcgauggaccugggggaacucugugaagauacaaugaccuacaaaugcccgagaaucacagagguggaacccgacgauguggacuguuggugcaauaccacggauaccugggucacauauggaaccuguucccaaacaggcgagcacagacgggacaagcgcucuguggcucuggccccucauguugggcugggacucgagaccagagccgaaacguggaugagcuccgagggcgcuuggaaacagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaagauaagcccacacuggacaucgaacugcucaaaaccgagguuacaaacccugcugugcugcggaaacuuugcauugaagccaaaaucuccaauaccacgacagauagccgcuguccgacccaaggagaggcgacccugguggaagaacaggacgccaacuucgucugcagacggacauuuguggaucgcggcuggggcaauggguguggacucuucggcaaggggucucugauuaccugcgcuaaguuuaaaugcguuacaaaacuugagggaaaaaucgugcaguacgaaaaccugaaguauuccgucaucgugacgguucacaccggcgaccagcaucaaguggggaaugagagcacagaacacggaaccacagccaccauuacgccccaggcuccuaccucugagauccagcucacagacuacggcgcccugacccuggauuguucccccagaacaggccucgacuucaacgaaaugguccugcuuaccaugaaagaaaaguccuggcuggugcauaaacagugguuucucgaucugccucuucccuggacguccggggccucuacaagccaagagaccuggaaucggcaggaccugcucgucacauucaagaccgcucacgcgaagaaacaggaagugguugugcugggaucccaagagggcgccaugcacaccgcucugacaggggccacggaaauucagaccagcggaacaaccacaaucuuugccggccaucucaagugccgccugaaaauggauaaacuuacccugaaagggaugucuuaugucauguguacgggcuccuucaagcucgagaaggaaguggcugagacacagcacggaaccguucuggugcagauuaaauacgagggcaccgacgccccgugcaagaucccuuucagcacacaagaugaaaaaggggucacccagaacggaagacugaucacagcgaaucccauugugacggacaaggagaaaccugugaacaucgaagcugagccgcccuuuggcgagucuuauauuguuaucggggccggagaaaaggcccuuaagcucagcugguucaaaaagggcuccucuauugggaaaauguuugaggcuaccgcccggggcgcuagacgcauggccauccugggagauacagcgugggacuucggcagcaucgggggagucuuuaccuccgugggcaagcuggugcaucagauuuucgggacagccuacggaguccucuuuagcggcgugucuuggaccaugaaaaucgggauuggcguucugcuuacguggcugggacucaauucccggagcaccucucuguccaugacauguaucgcugugggccuggucacccuuuaccucggggugaugguucaggccgauagcggaugcgugauuaacuggaagggcagagaacugaaguguggguccggaaucuucgucacaaaugaggugcacaccuggacagaacaauauaaauuucaggcugacucuccuaagcgccugagcgccgcgauuggcaaagccugggaggaggggguuugcggcauccgguccgcuaccagacucgaaaacaucauguggcgccagauuucuaacgagcugaaucauauccuucuggaaaacgacaugaaguucacgguggucgugggagauguggucggcauucucgcccaggggaaaaagaugauccggccgcaacccauggagcacaaauacagcuggaaguccuggggaaaggcuaaaauuaucggcgccgacguucagaauacaaccuuuaucauugaugggccuaacacccccgaauguccugacgaucagagagccuggaauaucugggagguggaggacuauggauucggcauuuuuacaaccaacaucuggcugaagcugcgcgauagcuacacacaggugugcgaccaccggcuuaugucugcugcgauuaaagauuccaaggccguccaugcugacaugggcuauuggaucgaaagcgagaaaaaugaaacauggaagcucgccagagccucuuucaucgaggugaagaccuguauuuggcccaaaucccacacacuguggagcaacgggguucuggaaucugagaugaucauuccgaagaucuacggaggcccuauuagccaacauaauuaucgccccggguacuucacccagacagcuggaccuuggcaccucggcaaacuggagcuugauuuugaccugugcgaagggaccacgguggucguggaugagcacugcggaaaccggggccccucccucagaaccacaaccguuacaggcaagaucauccaugaaugguguugccggagcuguacccugccuccccugcgcuucaaaggggaggacggaugcugguacggcauggagauuagaccggugaaggaaaaggaggaaaaucuugucaaaucuaugguguccgccgggagcggagagguugacuccuuuucucucggccugcuguguaucagcauuaugaucgaagaggugaugcgguccagauggucucgcaagaugcucaugacggggacacuggcggucuucuuucuucugauuaugggacagcucaccuggaacgaucugauccggagcugcauuauggugggcgcuaaugccuccgacagaaugggcauggggacaaccuaucuggcccuuauggcuaccuucaaaaugcgcccuauguuugccgugggacuccuguucagacggcugacaucucgcgagguccuccugcuuacgaucggccugagccucguugcguccguggaacugcccaacagccuggaggaacuuggggauggacuggcuaugggcaucaugauucucaagcugcucaccgacuuucaaucuuaccagcugugggccacacuucugucccucaccuucaucaaaacaaccuuuagccugcacuaugccuggaagacgauggcuauggugcugucuauugucucccuucugccccucugucugagcacaaccucucagaagaccacauggcucccugugcugcuugggucccugggaugcaaaccgcugaccauguuccucaucgccgagaauaagauuuggggcagaaaaagcuggccccugaacgaaggcaucauggcuguugggaucguguccauucuucugagcucucuccugaagaacgaugucccucucgccggaccccugaucgcgggcgggaugcuuauugccuguuacgugaucagcggauccucugcugaccugagccuggagaaagccgcugagguuuccugggaagaggaagccgagcauucuggcgccagccacaauauucucguggaaguccaggaugacgggacaaugaagaucaaagaugaggagcgggacgauacgcugaccauccuucugaaggcuacacuccuggcgguguccggagucuauccucucucuauucccgccacccuguuugugugguacuucuggcaaaagaaaaagcagcgcagcggcguucuuugggacacaccuagcccucccgaaguggagagagcuguccuggaugacggcaucuaucggauuaugcagcgcgggcugcucggaagaagccaggugggcguugggguguuccaagaaaacgucuuucauaccauguggcacgugacgcggggagccgugcugauguaccagggcaaacgccuugagcccucuugggccuccguuaagaaagaccugaucagcuacgggggaggcuggagacuccagggcucuuggaauaccggggaggaaguccaggugauugcuguggagcccggaaagaacccuaagaauguccaaacagcccccggcaccuucaaaacaccggaaggggaggugggagcgaucgcucuggauuuuaagccuggcaccuccgggagccccauuguuaaccgggaaggaaaaaucgugggccucuauggcaauggggucgugacaacguccggaaccuacguuucugccaucgcccaggcuaaggccagccaggagggcccucugcccgagauugaagacgagguguucagaaaacgcaaccuuacaaucauggaucugcaccccggguccggaaagacccggagauaucugccugcgauuguccgcgaagcuaucaagcggaaacucagaacccugauucuugccccgacacgcgugguugccagcgagauggcugaagcccugaagggcaugcccauccgguaccaaacgaccgcugugaaaucugagcauacagggagagagaucgucgaccucaugugccacgccaccuuuacaaugcgccugcuguccccugugcgggugcccaauuauaacaugauuaucauggaugaagcgcauuucaccgacccuagcucuauugccgcuagaggcuacaucagcacgcgggucggaaugggcgaggccgcugccauuuuuaugacagccacacccccuggguccguugaggcuuucccgcagucuaaugcggugauccaggaugaggaacgcgacauccccgagagaagcuggaacuccggauaugaguggauuaccgauuuuccuggcaagacagugugguucguccccucuaucaaaagcgggaaugacauugccaacugucuccggaagaauggaaagcgcgugauccagcuuuccagaaaaaccuuugauacagaauaccaaaagaccaaaaacaacgacugggacuacguugugacgacagauauuagcgagaugggcgcuaauuuccgggccgacagagucaucgauccucgccggugccugaagcccgugauucugaaagacgggccggaaagaguuauccucgccggcccuaugcccgugaccgucgcuucugccgcgcagcgccggggaagaaucggccgcaaccacaauaaggagggggaucaguauauuuacaugggacagccccugaacaaugacgaggaucaugcucacuggacagaagccaagaugcuucuggacaacaucaauaccccugagggcauuauccccgcccucuucgaaccugagcgggaaaaauccgcugccauugauggggaguauagacugcgcggagaggcgagaaagacguuuguggaacugaugcggcgcggcgaccucccggucuggcuuagcuacaaaguggccuccgagggguuccaauauucugauagacgguggugcuuugacggcgaacgcaacaaucagguucuggaggaaaacauggauguggagaucuggaccaaggagggagaacgcaagaagcugcggcccagauggcucgacgcucgcacauacagcgacccucuggcccuucgggaguucaaagaauuugcugccggcagacgcuccgugucuggggaucugauccucgagauuggaaagcugccccagcaccugacccagcgggcucaaaaugcccucgacaaccuugucaugcugcauaauagcgaacagggcgggagagcguaucggcacgccauggaggagcugccugauacaaucgaaacccucaugcugcuugcucugauugccguucucacaggaggcgugacccuguucuuucuguccggccgcgggcucggaaagacgagcaucggccuucugugugugauggcuucuuccgcccugcucuggauggccagcgucgagccccauuggauugcugcgucuaucauccuggaguucuuucuuauggugcugcucauuccggagccugacagacagcggacaccccaggauaaccaacuggccuacguugugaucgggcuccuguucaugauucuuaccgucgcugccaaugagaugggacugcuggaaaccaccaagaaggaccucggcaucgggcacguggccgucgagaaccaccaucacgcuaccaugcuggauguggaccuucauccugccuccgcguggacacuguacgccguugcuacgaccauuaucacacccaugaugcgccacaccauugaaaacacaaccgccaauaucagccucacggcuaucgccaaccaggcggccauucugaugggacuggauaaaggcuggccuaucucuaagauggacauuggcgugccccuccuugcucuggggugcuauagccaggucaauccgcugacccucacagccgcugugcugaugcuuguugcccauuacgcuaucauuggaccuggccugcaagccaaagcgaccagagaggcccagaagcggacagcugccgggaucaugaagaaccccaccguggauggaaucgucgcuauugaccucgaucccgugguguaugacgccaaauuugaaaagcagcugggccagaucaugcugcucauucuuuguacgucccaaauccugcugaugcgcacaaccugggcccucugcgagucuauuacacuggcgaccgggccucuuaccacacugugggagggaagcccgggcaaauucuggaauacgaccaucgcuguuuccauggccaacaucuuuagaggcagcuaccucgcuggggccggacuggccuucucccugaugaagucucucggcgggggacggcgcggcacaggggcucagggagaaacccuuggcgagaaauggaagagacagcugaaucagcugagcaaguccgaguucaacacauauaaacggucuggcauuauggaggucgacagaagcgaagccaaggaggggcuccgccggggagagaccacgaaacacgcgguguccagaggcacagccaagcugcgcugguuuguggaacggaaucuugucaaacccgaggggaagguuaucgaucugggauguggcagagggggauggucuuacuauugcgcuggccucaagaaagugaccgaagugaagggcuacaccaaagggggaccuggccacgaggaacccauuccuauggccacauacggguggaaccuggucaagcugcauagcggaaaagacguguucuuuauucccccugagaagugugauacccuccuuugcgacauuggcgaguccagcccgaaucccacaaucgaagaggggcgcacgcugcggguucugaaaaugguggaaccuuggcucagaggaaaccaauucuguauuaagauccugaaucccuauaugccuucugucguggagacccuugagcagaugcagcgcaagcacggcggcaugcugguucggaacccccucuccagaaauagcacacaugaaauguacugggugucuugcgggaccggaaacaucgucuccgcugugaauaugacaagccgcaugcugcugaaccgguuuaccauggcccacagaaaaccgacguaugagcgcgauguggaccucggcgcggggaccagacacgucgccguugaaccugagguggcuaaccuggauauuaucggacagcggauugaaaauaucaagcaugagcacaaaucuacauggcauuacgacgaggauaaccccuauaagaccugggccuaccacggcuccuaugaagugaaacccagcggguccgcuagcucuauggucaauggagugguuaaacuucugacaaagccuugggacgugauucccauggucacccaaaucgccaugacagauaccacgccuuucggccagcagcgcguguuuaaagagaagguugacacaagaaccccgaaagcuaagcggggcaccgcccaaaucauggaagugacagcgagauggcucuggggguuccugagccggaacaaaaagccccgcauuuguacgagagaggaauuuacccggaagguccgcuccaaugccgcuaucggagccguguucguugacgagaaccaguggaacucugcuaaagaggccguggaagaugagagauuuugggaccuuguccaucgggaacgcgagcugcacaagcagggcaaaugcgccacaugcguguacaacaugauggggaagagagagaagaagcucggagaguucggcaaggcgaaagggagccgggcuauuugguacauguggcugggcgcccgcuuucuggaguucgaagcccucggauucaugaaugaggaucacugguuuuccagagaaaacucucugagcggcgucgagggggagggacuucauaagcugggcuauauccuccgggacauuuccaaaaucccugggggaaauauguacgcugaugacaccgccggcugggauacacgcaucaccgaagacgaucugcagaacgaggcuaagauuacagacaucauggaacccgagcacgcccuucuggcgaccucuauuuucaaacucacguaucaaaauaaggugguuagagugcagcggccugcccgcaacgggaccgucauggaugugaucagcagacgggaccagagaggcuccggacaggugggcacauacgggcugaauaccuuuacaaacauggaagcucaacugauucgccagauggagagcgagggaaucuucucucccuccgaacucgagaccccgaaccuggccgaacggguucuugauuggcuggagaaacauggcguggaaagacucaagcgcauggcuaucagcggggacgacugugucgugaagccuauugaugaccgguuugccacggcgcugucugcccuuaaugauaugggaaaaguuagaaaggacaucccccagugggagccuuccaaaggcuggaacgauuggcagcaagugcccuucugcagccaccacuuucaucagcugauuaugaaggacgggcgcgagaucgucgugccuugucggaaucaggaugaacucgucggcagagcucgcgugucccagggagccggcuggucucugcgggagacagcuugccuggggaaaagcuaugcccaaauguggcagcucauguacuuccacagacgcgaccugcggcuugcugccaacgcgauuuguuccgccguucccguggauugggucccgaccagcagaacaaccuggucuauccaugcucaccaucaguggaugacgaccgaagacaugcuguccguguggaaucggguuuggauugaggaaaacccuuggauggaggauaagacacacaucagcucuuggggagacgugcccuaucucggcaagagagaggaccaauggugcgggagccugaucggacuuaccgcccgcgccacaugggcuaccaauauucaggucgccaucaaccaggugcggagacugauuggcaaugaaaacuaccucgauuacaugacauccaugaaacgcuuuaagaaugagucugaccccgaaggggcgcugugguga

SEQ ID NO: 18985 - RNA, 9879 nt, Artificial Sequence
  derived and/or modified CDS sequence (opt5) from DENV-1__FJ882523__SS-prME
agcgugaccaugcugcucaugcugaugcccaccgcccuugcuuuccaccugacgacccggggaggggagccucauaugauugucaccaagcaggaacggggaaagucccuccuguuuaagaccucugccggcguuaacaugugcacccuuauugccauggaccugggggagcucugugaagauaccaugacauacaaaugcccccgcaucaccgaggcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaggaacaggacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacgaggaaaaaccugucaacaucgaggccgagccgcccuuuggcgaaagcuauauugugaucggggccggagagaaggcucuuaaacucucuugguucaagaagggcagcuccauugggaaaauguuugaagccacagcuagaggcgcccgccggauggcgauccugggagauaccgccugggacuucggcucuaucgggggaguguuuacaagcguuggcaagcugguccaucagauuuucgggaccgcuuacggagugcucuuuuccggcgugagcuggacgaugaaaaucgggauuggcguccugcuuaccuggcugggacucaauucuagauccacaagccugucuaugaccuguaucgccgugggccugguuacacuuuaccucggggugaugguccaggcugauuccggaugcgugauuaacuggaagggccgcgagcugaaaugugggagcggaaucuucguuaccaaugaagugcacacauggaccgagcaauauaaguuucaggccgacuccccuaagcggcugucugcggccauuggcaaggcuugggaggaaggggucugcggcaucagaagcgccacgcgccucgagaacaucauguggaagcagauuuccaacgaacugaaucauauccuucuggagaacgacaugaaauucacagugguugugggagaugucgugggcauucucgcucaggggaagaaaaugauccggccgcaacccauggaacacaaguacucuuggaaaagcuggggaaaggccaagauuaucggcgccgacgugcagaauaccaccuuuaucauugaugggccuaacacacccgaguguccugacgaucagagagcuuggaauaucugggaggucgaagacuauggauucggcauuuuuaccacgaacaucuggcugaaacugcgcgauuccuacacacagguuugcgaccaccggcuuaugagcgcggccauuaaggauucuaaagcugugcaugccgacaugggcuauuggaucgaguccgaaaagaaugagaccuggaaacucgccagagcuagcuucaucgaagugaagacauguauuuggcccaagucucacacccugugguccaacgggguccuggagagcgagaugaucauuccgaaaaucuacggaggcccuauuucucaacauaauuaucgccccggguacuucacacagaccgccggaccuuggcaccucggcaagcuggaacuugauuuugaccugugcgaggggacgaccgugguuguggaugaacacugcggaaaccggggccccagccucagaacaaccacagucaccggcaaaaucauccaugagugguguugccgguccuguacgcugccuccccugcgcuucaagggggaggacggaugcugguacggcauggaaauuagaccggugaaagagaaggaagagaaucuuguuaagagcauggugucugcgggguccggagaagucgacagcuuuucccucggccugcuguguaucucuauuaugaucgaggaggugaugcggagcagauggucccgcaaaaugcucaugacagggacccuggcuguuuuccuucugcucauuaugggacagcugacauggaacgaucugauccggcuuugcauuauggugggcgccaaugccucugacagaaugggcauggggaccaccuaucuggcucucauggccacauuuaagaugcgcccuauguucgcggucggacugcucuuuagacggcugacgagccgcgaagugcuucugcucaccaucggccugucccugguggcuucugucgagcuucccaacagccuggaggaacucggggauggacuggccaugggcaucaugauucucaaacugcuuacagacuuccaaucccaccagcugugggccacccuccugagccugacauuuaucaagaccacgcuuucucugcauuacgcuuggaaaacaauggccaugguucucuccauugugagccuguucccccucugucugucuaccaccucccagaagacaaccuggcuuccugugcugcuggggagccucggaugcaagccgcugacaauguuucuuaucgcugaaaauaaaauuuggggcagaaagucuuggccccugaacgagggcaucauggccgucggggugguuuccauccuccugagcucccuccugaaaaacgaugugccucuugcgggaccccugauugccggcgggaugcugaucgcuuguuaugucauuagcggaucuagcgccgaccucucccuggagaaggcugccgaagugucuugggaggaagaggccgaacacagcggcgcuucccauaauauccuuguugaggugcaggaugacgggacgaugaaaauuaaggaugaggaacgggacgauacccugacaauccuccugaaagcgacccuccuggccgucucuggaguguacccucuuagcauccccgcuacacuguucgucugguauuuuuggcaaaagaagaaacagcgcuccggcgugcugugggacaccccuucucccccggagguugaaagagccgugcucgaugacggcauuuaccggaucaugcagcgcgggcugcuuggaagaagccaggucggcguggggguuuuccaagagaacguguuccacacgauguggcacgucacccggggagccgugcugauguaucagggcaagcgccucgagccuuccugggcuagcgugaaaaaggaccugauuucuuacgggggaggcuggagacuccagggcuccuggaauacaggggaagagguucaggucaucgccguggaacccggcaagaacccuaagaaugugcaaaccgcgcccggcacauuuaagaccccggagggggaagucggagcuauugcccuggauuucaaaccuggcacaagcgggucucccaucgugaaccgggagggaaagauuguuggccuuuacggcaaugggguggucacgaccuccggaacauaugugagcgccaucgcucaggccaaagcgucccaggagggcccucugcccgaaaucgaggacgaaguuuuuagaaagcgcaaccugaccauuauggaucuccaucccgggucuggaaaaacccggagauaccugccugcuaucgugcgcgaggccauuaagcggaaacuuagaacacugauccucgccccgacgcgcgucguggcuagcgaaauggccgaggcucugaaaggcaugcccauucgguaucaaaccacagccguuaaguccgagcacaccgggaaagaaaucguggaccugaugugccaugcgacauucaccaugagacuccuuagcccuguccgcgugcccaauuacaacaugaucauuauggaugaggcccacuuuacggacccuucuuccaucgcugcccggggcuauauuagcacaagagugggaaugggcgaagcugccgccaucuucaugaccgcuacacccccugggucugucgaggcguuuccgcagagcaaugccguuauucaggaugaggaacgggacauccccgagcgcuccuggaacucuggauacgaauggaucacagauuucccuggcaagaccgugugguuugugcccagcauuaaauccgggaaugacaucgcuaacugucugagaaagaauggaaagcgggucauucagcugucucgcaaaacauucgauaccgaguaucaaaagacgaaaaacaacgacugggacuacgugguuacaaccgauaucagcgaaaugggcgccaauuuuagagccgaccgggugauugauccuagacgcugccucaagcccgucauccugaaagacgggccggagcgggugauucuugcuggcccuaugcccguuacaguggccuccgcggcucagagacgcggacggaucggcagaaaccauaauaaggagggggaucaguacaucuauaugggacagccccugaacaaugacgaagaucacgcccacuggaccgaggccaagaugcuccuggacaacauuaauacgccugaaggcaucauucccgcucuguucgagccugaacgcgagaaaagcgccgcgaucgauggggaguaccggcucagaggagaagcccgcaagaccuucgucgagcuuaugagacggggcgaccugccgguguggcugucuuauaaagucgcuuccgaaggguuucaauacagcgaucgcagauggugcuucgacggcgagcggaacaaucaggugcucgaagagaacauggauguugagauuuggacaaaggaaggagagcgcaaaaagcugagaccccgguggcuugacgccagaaccuauuccgacccucuggcucuccgcgaauuuaaagaguucgccgcuggccggagaucugugagcggggaucugauccuggaaaucggaaagcucccccagcaucuuacacagcgcgcccaaaaugcgcuggacaaccuggugaugcuccacaauuccgagcagggcgggcgggccuacagacaugcuauggaggaacugccugauaccauugagacacuuaugcugcucgcccugaucgcuguccugaccggaggcguuacgcucuuuuuccuuucuggccgggggcugggaaagacaagcauuggccugcucugugugauggccuccagcgugcugcuuuggauggccucugucgaaccccacuggaucgcugcguccauuauccuggaguuuuuccucauggugcugcugaucccggagccugaccgccagagaacaccccaggauaaccaacucgccuauguugugauugggcuucuguuuaugauccugaccgucgcugccaaugaaaugggacuccuggagacaaccaaaaaggaccuuggcauugggcacguggccgucgaaaaccaucaccaugcuacaaugcuggauguggaccuccacccugccagcgcguggacgcuguacgccguugcuaccacaaucauuacccccaugaugcggcauacaaucgagaacaccacggccaauauuucucugaccgcuaucgccaaccaggcggccauccucaugggacuugauaaaggcuggccuauuuccaagauggacaucggcgugccccugcuggcucucgggugcuacagccaggucaauccgcugacacuuaccgccgcugugcugaugcucguugcccacuaugcuauuaucggaccuggccugcaagccaaagcgacacgcgaagcccagaagagaaccgcugccgggauuaugaagaaccccacgguggauggaaucgucgcuaucgaccuggaucccgugguguacgacgccaaauucgagaagcagcucggccagauuaugcuucugauccuguguacaucucaaauucuccugaugcggaccacaugggcccuuugcgagagcaucacccuggcgaccgggccucucacaacgcugugggaaggauccccgggcaaauuuuggaauaccacaauugcuguuucuauggccaacaucuuccgcggcagcuaucuggcuggggccggacucgccuuuucccuuaugaaaagccugggcgggggaagacggggcaccggggcucagggagagacacugggcgaaaaauggaagcgccagcucaaucagcuguccaagucugaguucaacaucuacaaaagaagcggcauuauggaagucgaccgguccgaggccaaggaggggcuuaaaagaggagaaaccacgcgccacgcggugucucggggcacagccaagcugagaugguucguggagcgcaaucucgucaaacccgaagggaagguuaucgaucugggauguggcagaggcggguggagcuauuacugcgcugggcugaagaaagugaccgaggugaagggcuauaccaaagggggaccuggccaugaggaacccauuccuauggccacauacggguggaaccucgucaaacuucacuccggaaaagacguguuuuucacacccccugagaagugugauacacugcugugcgacaucggcgaaucuagcccgaaucccacgauugaggaagggagaacccuccgcguucugaaaaugguggagccuuggcuucggggaaaccaauuuuguaucaagauucugaaucccuacaugccuuccgucguggagacacucgaacagaugcagagaaagcauggcggcaugcugguucgcaacccccugagcagaaauucuacccacgagauguauuggguguccugcgggacaggaaacaucgucagcgcugugaauaugaccucuagaaugcuccugaaccgcuucacgauggcccaccggaaaccgaccuacgaaagagauguggaccuuggcgcggggacacgccaugucgccguugagccugaaguggcuaaccuggauaucauuggacagagaaucgagaauauuaagcacgagcauaaauccaccuggcacuaugacgaagauaaccccuacaagacaugggccuaucauggcagcuacgaggugaaacccucuggguccgcuagcuccauggucaauggagugguuaagcuccugaccaagccuugggacgugauccccauggucacacaaauugccaugaccgauacgacaccuuuuggccagcagcggguguucaaagaaaagguugacacccgcaccccgaaagcuaagagaggcacagcccaaaucauggaggugacggcgcgguggcuuuggggguuucugagcagaaacaaaaagccccggaucuguacccgcgaagaguucacaagaaagguccggucuaaugccgcuauuggagccguguuuguugacgagaaccaguggaauagcgcuaaagaagccguggaggaugaacgcuucugggaccucguccagaaggagagagaacugcacaaacagggcaagugcgcgaccugcguguauaacaugauggggaaacgggagaagaagcugggagaguuuggcaaagcgaaggggucccgcgcuaucugguacauguggcucggcgccagauuccuggaauuugaggcccuuggauucaugaaugaagaucacugguucucucgggagaacagccuguccggcgucgagggggaaggacuccauaaacugggcuacauucuucgcgacaucucuaagauuccugggggaaauauguaugcugaugacacagccggcugggauaccagaaucacagaggacgaucugcaaaacgaagcuaaaaucaccgacauuauggagcccgaacacgcccuccuggcgacgagcaucuuuaagcugaccuaccagaauaaagugguucgggugcagcgcccugccaagaacgggacagucauggaugugauuuccagacgggaccagcgcggcucuggacaagugggcaccuaugggcucaauacauucaccaacauggaggcucagcugaucagacagauggagagcgaaggaaucuuuucccccagcgagcuugaaaucccgaaccuggccgagcggguucucgauuggcuggaaaaguacggcguggagagacuuaaacgcauggcuaucucuggggacgacugugucgugaagccuauugaugaccgguucgccacggcgcugacagcccucaaugauaugggaaaaguuagaaaggacgugccccagugggagccuuccaaaggcuggaacgauuggcaacagguccccuuuugcagccaucacuuccaccagcugaucaugaaggacgggcgcgaaauuguggucccuugucggaaucaggaugagcuggugggcagagcucgcguuucucaaggagccggcuggucccuccgggaaaccgcuugccugggaaagagcuaugcccagauguggcagcuuauguacuuucauagacgcgaccugcggcucgcugccaacgcgaucuguuccgccgugcccgucgauugggugccgacaucuagaaccacguggagcauucacgcucaucaccaauggaugaccacagaggacaugcuguccguuuggaaucgcguguggaucgaagagaacccuuggauggaggauaaaacccaugucagcucuuggggagacgugcccuaucuuggcaagcgggaagaccaguggugcgggucccugauuggacucacagccagagccaccugggcuagcaauauccagguggccaucaaccagguucggagacugauuggcaaugagaacuaccuggauuacaugacaucuaugaaacgcuucaagaaugaaggggaccccgagggcgcgcucugguga

SEQ ID NO: 18986 - RNA, 9879 nt, Artificial Sequence
  derived and/or modified CDS sequence (opt5) from DENV-1__FJ882524__SS-prME
agcgugaccaugcugcucaugcugaugcccaccgcccuugcuuuccaccugacgacccggggcggggagccucauaugaucgugaccaagcaggaacggggaaaaucccuccuguuuaagaccucugccggcguuaacaugugcacccuuauugcgauggaccugggggagcucugugaagauaccaugacguacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuacgugugccggcgcaccuucguggauagaggcuggggcaauggguguggacucuuuggcaaagggagccugauuacaugcgccaaguucaagugcgucacgaaacuugagggaaagaucgugcaguaugaaaaccugaaauacucuguuaucgugaccguccacacaggcgaccagcaucaaguggggaaugaguccaccgaacacggaacaaccgcuacgauuacaccccaggccccuacaagcgagauccagcucaccgacuauggcgcccugacacuggauuguucuccccggaccggccucgacuuuaacgaaaugguucugcuuacgaugaaggagaaauccuggcuggugcauaagcagugguuccucgaucugccucuucccuggacaagcggggcuuccaccucucaagagacauggaaucgccaggaccugcucgucaccuuuaaaaccgcgcacgccaagaagcaggaaguggucgugcugggaagccaagagggcgcuaugcacacagcccugacgggggccaccgaaauucagacauccggaaccacaaccaucuucgcuggccaucucaaaugcagacugaagauggauaaacuuacgcugaaggggaugagcuacguuauguguacaggcucuuuuaaacucgagaaggaaguggccgagacccagcacggaaccguccuggugcagauuaaguaugagggcacagacgcgccgugcaaaaucccuuucuccacccaagaugaaaaggggguuacacagaacggacggcugaucacggcuaaucccauugugaccgacaaagagaagccugucaacaucgaagccgagccgcccuucggcgagagcuacauugugaucggggccggagaaaaagcucuuaagcucucuugguuuaagaaaggcagcuccauugggaagauguucgaggccacagcuagaggcgcccgccggauggcgauccugggagauaccgccugggacuuuggcucuaucgggggaguguucacaagcguuggcaaacugguccaucagauuuuugggaccgcuuacggaguccuguucuccggcgugagcuggacgaugaagaucgggauuggcguccugcuuaccuggcugggacucaauucuagauccacaagccugucuaugaccuguaucgccgugggccugguuacacuuuaucucggggugaugguccaggcugauuccggaugcgugauuaacuggaaaggccgcgaacugaagugugggagcggaaucuuuguuaccaaugaggugcacacauggaccgaacaauacaaguuccaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguuuacagugguugugggagaugucgugggcauucucgcucaggggaaaaagaugauccggccgcaacccauggagcacaaauauucuuggaaaagcuggggaaaggccaagauuaucggcgccgacgugcagaauaccaccuucaucauugaugggccuaacacacccgaauguccugacgaucagagagcuuggaauaucugggaggucgaggacuacggauuuggcauuuucaccacgaacaucuggcugaagcugcgcgauuccuauacacagguuugcgaccaccggcuuaugagcgcggccauuaaagauucuaaggcugugcaugccgacaugggcuacuggaucgaauccgagaaaaaugaaaccuggaagcucgccagagcuagcuuuaucgaggugaagacauguauuuggcccaaaucucacacccugugguccaacgggguccuggaaagcgagaugaucauuccgaagaucuauggaggcccuauuucucaacauaauuaccgccccggguacuucacacagaccgccggaccuuggcaccucggcaaacuggagcuugauuucgaccugugcgaagggacgaccgugguuguggaugagcacugcggaaaccggggccccagccucagaacaaccacagucaccggcaagaucauccaugaaugguguugccgguccuguacgcugccuccccugcgcuuuaaaggggaggacggaugcugguauggcauggagauuagaccggugaaggaaaaggaggaaaaucuuguuaaaagcauggugucugcgggguccggagaggucgacagcuucucccucggccugcuguguaucucuauuaugaucgaagaggugaugcggagcagauggucccgcaagaugcucaugacagggacccuggcuguuuuucuucugcucauuaugggacagcugacauggaacgaucugauccggcuuugcauuauggugggcgccaaugccucugacagaaugggcauggggaccaccuaccuggcucucauggccacauucaaaaugcgcccuauguuugcggucggacuccucuucagacggcugacgagccgcgaggugcuucugcucaccaucggccugucccugguggcuucugucgaacuucccaacagccuggaggaacucggggauggacuggccaugggcaucaugauucucaagcugcuuacagacuuucaaucccaccagcugugggccacccuccugagccugacauucaucaaaaccacgcuuucucugcauuaugcuuggaagacaauggccaugguucucuccauugugagccuguuuccccucugucugucuaccaccucccagaagacaaccuggcuuccugugcugcuggggagccucggaugcaaaccgcugacaauguuccuuaucgcugagaauaagauuuggggcagaaaaucuuggccccugaacgaaggcaucauggccgucggggugguuuccauccuccugagcucccuccugaagaacgaugugccucuugcgggaccccugauugccggcgggaugcugaucgcuuguuacgucauuagcggaucuagcgccgaccucucccuggagaaagcugccgaggugucuugggaagaggaagccgagcacagcggcgcuucccauaauauccuuguugaagugcaggaugacgggacgaugaagauuaaagaugaggagcgggacgauacccugacaauccuccugaaggcgacccuccuggccgucucuggaguguauccucuuagcauccccgcuacacuguuugucugguacuucuggcaaaagaaaaagcagcgcuccggcgugcugugggacaccccuucucccccggaaguugagagagccgugcucgaugacggcauuuaucggaucaugcagcgcgggcugcuuggaagaagccaggucggcguggggguuuuucaagaaaacguguuccacacgauguggcacgucacccggggagccgugcugauguaccagggcaaacgccucgagccuuccugggcuagcgugaagaaagaccugauuucuuacgggggaggcuggagacuccagggcuccuggaauacaggggaggaaguucaggucaucgccguggagcccggaaagaacccuaagaaugugcaaaccgcgcccggcacauucaaaaccccggaaggggaggucggagcuauugcccuggauuuuaagccuggcacaagcgggucucccaucgugaaccgggaaggaaaaauuguuggccuuuauggcaaugggguggucacgaccuccggaacauacgugagcgccaucgcucaggccaaggcgucccaggagggcccucugcccgagaucgaagacgagguuuucagaaaacgcaaccugaccauuauggaucuccaucccgggucuggaaagacccggagauaucugccugcuaucgugcgcgaagccauuaagcggaaacuuagaacacugauccucgccccgacgcgcgucguggcuagcgagauggccgaagcucugaagggcaugcccauucgguaccaaaccacagccguuaaauccgagcacaccgggaaggagaucguggaccugaugugccaugcgacauuuaccaugagacuccuuagcccuguccgcgugcccaauuauaacaugaucauuauggaugaagcccacuucacggacccuucuuccaucgcugcccggggcuacauuagcacaagagugggaaugggcgaggcugccgccaucuuuaugaccgcuacacccccugggucugucgaagcguucccgcagagcaaugccguuauucaggaugaggaacgggacauccccgagcgcuccuggaacucuggauaugaguggaucacagauuuuccuggcaaaaccgugugguucgugcccagcauuaaguccgggaaugacaucgcuaacugucugagaaagaauggaaaacgggucauucagcugucucgcaagacauuugauaccgaauaccagaagacgaagaacaacgacugggacuacgugguuacaaccgauaucagcgagaugggcgccaauuucagagccgaccgggugauugauccuagacgcugccucaaacccgucauccugaaggacgggccggaacgggugauucuugcuggcccuaugcccguuacaguggccuccgcggcucagagacgcggacggaucggcagaaaccauaauaaggagggggaucaguauaucuacaugggacagccccugaacaaugacgaggaucacgcccacuggaccgaagccaaaaugcuccuggacaacauuaauacgccugagggcaucauucccgcucuguuugaaccugagcgcgaaaagagcgccgcgaucgauggggaguaucggcucagaggagaggcccgcaaaaccuucgucgaacuuaugagacggggcgaccugccgguguggcugucuuacaaggucgcuuccgagggguuccaauauagcgaucgcagauggugcuuugacggcgaacggaacaaucaggugcucgaggaaaacauggauguugagauuuggacaaaagagggagaacgcaagaaacugagaccccgguggcuugacgccagaaccuacuccgacccucuggcucuccgcgaguucaaggaauuugccgcuggccggagaucugugagcggggaucugauccuggagaucggaaagcucccccagcaucuuacacagcgcgcccaaaaugcgcuggacaaccuggugaugcuccacaauuccgaacagggcgggcgggccuauagacaugcuauggaggagcugccugauaccauugaaacacuuaugcugcucgcccugaucgcuguccugaccggaggcguuacacucuucuuucuuucuggccgggggcugggaaaaacaagcauuggccugcucugugugaccgccuccagcgugcugcuuuggauggccucugucgagccccacuggaucgcugcguccauuauccuggaguucuuucucauggugcugcugaucccggagccugaccgccagagaacaccccaggauaaccaacucgccuacguugugauugggcuucuguucaugauccugacagucgcugccaaugagaugggacuccuggaaaccacaaagaaagaccuuggcauugggcacguggccgucgagaaccaucaccaugcuacgaugcuggauguggaccuccacccugccagcgcguggacccuguacgccguugcuacaaccaucauuacacccaugaugcggcauaccaucgaaaacacgaccgccaauauuucucugacagcuaucgccaaccaggcggccauccucaugggacuugauaagggcuggccuauuuccaaaauggacaucggcgugccccugcuggcucucgggugcuauagccaggucaauccgcugacccuuacagccgcugugcugaugcucguugcccacuacgcuauuaucggaccuggccugcaagccaaggcgacccgcgaggcccagaagagaacggcugccgggauuaugaaaaaccccacaguggauggaaucgucgcuaucgaccuggaucccgugguguaugacgccaaguuugaaaaacagcucggccagauuaugcuucugauccuguguaccucucaaauucuccugaugcggacaaccugggcccuuugcgagagcaucacccuggcgacagggccucucacgacccugugggagggauccccgggcaaguucuggaauacaaccauugcuguuucuauggccaacaucuuucgcggcagcuaccuggcuggggccggacucgccuucucccuuaugaaaagccugggcgggggaagacggggcacaggggcucagggagaaacccugggcgagaaguggaagcgccagcucaaucagcuguccaaaucugaauuuaacaucuauaagagaagcggcauuauggaggucgaccgguccgaagccaaagaggggcuuaagagaggagagacgacacgccacgcggugucucggggcaccgccaaacugagaugguucguggaacgcaaucucgucaagcccgaggggaagguuaucgaucugggauguggcagagggggauggagcuacuauugcgcuggccugaaaaaggugaccgaagugaaaggcuacacaaaagggggaccuggccaugaggaacccauuccuauggccaccuacggguggaaccucgucaaacuucacuccggaaaggacguguucuuuacacccccugagaaaugugauacgcugcugugcgacaucggcgagucuagcccgaaucccaccauugaagaggggagaacacuccgcguucugaagaugguggaaccuuggcuucggggaaaccaauucuguaucaagauucugaaucccuauaugccuuccgucguggagacccucgagcagaugcagagaaaacauggcggcaugcugguucgcaacccccugagcagaaauucuacacacgaaauguacuggguguccugcgggaccggaaacaucgucagcgcugugaauaugacgucuagaaugcuccugaaccgcuuuaccauggcccaccggaagccgacauaugagagagauguggaccuuggcgcggggacccgccaugucgccguugaaccugagguggcuaaccuggauaucauuggacagagaaucgaaaauauuaaacacgagcauaaguccacauggcacuacgacgaggauaaccccuauaaaaccugggccuaccauggcagcuaugaagugaagcccucuggguccgcuagcuccauggucaauggagugguuaagcuccugacaaaaccuugggacgugauccccauggucacccaaauugccaugacggauacaaccccuuucggccagcagcggguguuuaaggagaaaguugacacccgcacaccgaaggcuaaaagaggcacggcccaaaucauggaagugaccgcgcgguggcuuuggggguuccugagcagaaacaagaagccccggaucuguacacgcgaggaauuuaccagaaaaguccggucuaaugccgcuauuggagccguguucguugacgagaaccaguggaauagcgcuaaggaggccguggaagaugagcgcuuuugggaccucguccagaaagaaagagagcugcacaagcagggcaaaugcgccacaugcguguacaacaugauggggaagcgggaaaagaaacugggagaguucggcaaggcgaaagggucccgcgcuaucugguacauguggcucggcgccagauuucuggaguucgaagcccuuggauuuaugaaugaggaucacugguucucucgggaaaacagccuguccggcgucgagggggagggacuccauaagcugggcuauauucuucgcgacaucucuaaaauuccugggggaaauauguacgcugaugacaccgccggcugggauacaagaaucaccgaagacgaucugcaaaacgaggcuaagaucacggacauuauggaacccgagcacgcccuccuggcgaccagcaucuucaaacugacauaucagaauaaggugguucgggugcagcgcccugccaagaacgggaccgucauggaugugauuuccagacgggaccagcgcggcucuggacaagugggcacauacgggcucaauaccuuuacgaacauggaagcucagcugaucagacagauggagagcgagggaauuuucucccccagcgaacuugagaucccgaaccuggccgaacggguucucgauuggcuggagaaauauggcguggaaagacuuaagcgcauggcuaucucuggggacgacugugucgugaaaccuauugaugaccgguuugccacagcgcugaccgcccucaaugauaugggaaagguuagaaaagacgugccccagugggagccuuccaagggcuggaacgauuggcaacagguccccuucugcagccaucacuuucaccagcugaucaugaaggacgggcgcgagauuguggucccuugucggaaucaggaugaacuggugggcagagcucgcguuucucaaggagccggcuggucccuccgggagacagcuugccuggggaaaagcuacgcccagauguggcagcuuauguauuuccauagacgcgaccugcggcucgcugccaacgcgaucuguuccgccgugcccgucgauugggugccgaccucuagaacgaccuggagcauucacgcucaucaccaauggaugacaaccgaagacaugcuguccguuuggaaucgcguguggaucgaggaaaacccuuggauggaggauaagacacaugucagcucuuggggagacgugcccuaccuuggcaaacgggaggaccaguggugcgggucccugauuggacucaccgccagagccacaugggcuagcaauauccagguggccaucaaccagguucggagacugauuggcaaugaaaacuaccuggauuauaugaccucuaugaagcgcuuuaaaaaugagggggaccccgaaggcgcgcucugguga

SEQ ID NO: 18987 - RNA, 9879 nt, Artificial Sequence
  derived and/or modified CDS sequence (opt5) from DENV-1__FJ882525__SS-prME
agcgugaccaugcugcucaugcugaugcccaccgcccuugcuuuccaccugacgaccagaggaggggaaccucauaugaucgucuccaagcaggaacggggaaagucucuccuguuuaagacaagcgccggcguuaacaugugcacccuuguggcgauggaccugggggaguucugugaagauacaaugaccuacaagugcccgcgcauuacagaagcugaacccgacgauguggacuguuggugcaaugccaccgauacgugggucaccuauggaacauguucccagaccggcgagcacagacgggacaagcgcucuguggcccucgcuccucauguugggcugggacuggagacaagaaccgaaacguggaugagcuccgagggcgccuggaaacagauccagcggguggaaacaugggcucuccgccaccccggcuuuaccgucauugcccuguuccuugcgcaugccaucgggacaucuauuacccagaagggaaucaucuuuauucugcucaugcuggugaccccuagcauggcuaugagaugcguuggcaucgggucccgggauuucguggagggacuuagcggcgccacaugggucgacguggugcuggagcacgggucuugugucacgaccauggcuaaggauaaacccacacucgacauugaacugcugaagaccgagguuacaaacccugccgugcuccgcaaacugugcaucgaagcgaagauuuccaauaccacgacagauagcagauguccgacccaaggagaggccacccuuguggaagaacaggacgcuaacuuugucugccggcgcacauucguggauagaggcuggggcaauggguguggacuguuuggcaaagggucucucauuaccugcgccaaguucaagugcguuacaaaacuggagggaaagacggugcaguacgaaaaccuuaaauauuccgucauugugaccguucacacaggcgaccagcaucaaguggggaaugagagcaccgaacacggaacaaccgcuacgaucacaccccaggccccuucuacagagauccagcugaccgacuacggcgcccucacacuggauuguagcccccggaccggccuggacuuuaacgaaaugguccuccugacgaugaaggagaaaagcuggcuugugcauaagcagugguuccuggaucucccucugcccuggacauccggggcuucuaccagccaagagacauggaaucgcaaagaccuucuggucaccuuuaagaccgcgcacgccaagaaacaggaagugguugugcucggaucccaggagggcgcuaugcacacagcccugacgggggccaccgaaauucaaacaagcggaaccacaaccaucuucgcuggccaucugaagugcagacucaaaauggauaagcugacgcuuaaagggaugucuuaugucauguguacaggcuccuucaagcuggagaaggaaguggccgagacccagcacggaaccguucucgugcagauucgguacgagggcacagacgcgccgugcaaaaucccuuuuagcacccaggaugaaaagggggucacacaaaacggaagacugauuacggcuaaucccaucgugaccgacaaagagaagccugugaacaucgaagccgagccgcccuucggcgagucuuauauuguuaucggggccggagaaaaagcucugaaacuuagcugguuuaagaaaggcuccucuauugggaagauguucgaggccacagcucgcggcgcccggagaauggcgauccucggagauaccgccugggacuuuggcagcauugggggagucuucacauccgugggcaaacuggugcaucagaucuuugggaccgcuuacggaguccuguucagcggcgugucuuggacgaugaagaucgggauuggcguucuccugaccuggcuuggacucaauucccgcagcacaucucucuccaugaccuguaucgccgugggccuggucacacuguaccuuggggugaugguucaggcugauagcggaugcgugauuaacuggaaaggccgggaacucaaguguggguccggaaucuuugucaccaaugaggugcacacauggaccgaacaguauaaguuccaagccgacucuccuaaaagacugagcgcggccauuggcaaggcuugggaggaggggguuugcggcauccgcuccgccacgcggcuggaaaacauuauguggaaacagaucucuaacgagcucaaucauauccugcuugaaaacgacaugaaguuuacaguggucgugggagauguggcuggcauucuggcccaggggaaaaagaugaucagaccgcagcccauggaguacaaauauagcuggaaguccuggggaaaggccaaaauuaucggcgcugacguccaaaauaccaccuucauuaucgaugggccuaacacacccgaauguccugacgaucagcgcgcguggaauaucugggagguugaggacuacggauuuggcauuuucaccacgaacaucuggcucaagcugcgggauagcuauacacaggugugcgaccacagacugaugucugccgcuauuaaagauuccaaggccgugcacgccgacaugggcuacuggaucgaaagcgagaaaaaugaaaccuggaaacuugcucgcgccucuuucauugaggucaagacauguaucuggcccaagucccauacccucuggagcaacggggugcuggaaucugagaugaucauuccgaagaucuauggaggcccuauuagccagcacaauuaccggcccggguacuuuacacaaaccgcgggaccuuggcaucugggcaaacucgagcuggauuucgaccuuugcgaagggacgaccguuguggucgaugagcacugcggaaacagaggccccucccugcggacaaccacagugaccggcaagaucauucacgaaugguguugccgcagcuguacgcucccuccccugagauuuaaaggggaggacggaugcugguauggcauggagauccggccgguuaaggaaaaggaggaaaaucuggugaaaucuauggucuccgcugggagcggagagguggacuccuucucucuuggccuccuguguaucagcauuaugaucgaagagguuaugagaucccgcuggucucggaagaugcugaugacagggacccucgccguguuuuuccugcuuauuaucggacagcugacauggaacgaucucauuagacugugcaucauggucggcgccaaugcuagcgaccgcaugggcauggggaccaccuaccuggcccuuauggcgacauuuaaaaugagaccuauguucgcugugggacugcucuuucggcgccugacguccagagaggugcuccugcuuaccauuggccugucucucgucgccagcguugaacugcccaacucccuggaggaacuuggggauggacuggccaugggcaucaugauccucaagcugcucacagacuuccagagccaucaacugugggcuacccuucugucucucacauuuauuaaaaccacguucucccugcacuaugccuggaagacaauggcuauggugcugagcaucgugucucuuuuuccccugugucucuccaccaccagccagaagacaaccuggcugccuguccuccuggggucucuuggaugcaaaccgcugacaauguuccugauugccgagaauaagaucuggggccggcgcuccuggccccucaacgaaggcauuauggcgguggggaucguuagcauccugcuuuccagccugcucaaaaacgaugugccucuggccggaccccucauugcuggcgggaugcugaucgccuguuacgucauuucuggaagcuccgcugaccuuucucuggagaaggccgccgaggugagcugggaagaggaagcugagcauuccggcgcgucucacaauauccugguugaagugcaggaugacgggacgaugaaaauuaaggaugaggagagagacgauacccucacaauccugcuuaaagccacccugcucgcugucagcggaguguauccucuguccauccccgccacacucuucgucugguacuuuuggcagaagaagaaacaacggucuggcgugcugugggacaccccuuccccucccgaaguugagcgcgccgugcuugaugacggcauuuauagaaucaugcagcgggggcugcugggacgcucccaggucggcguggggguuuuccaggaaaacguguuucauacgauguggcacgucaccagaggagcugugcucauguaccaaggcaagcggcuggagcccagcugggccucugugaaaaaggaccuuauuuccuacgggggaggcuggagacugcagggcagcuggaauacaggggaggaaguucaggucaucgcgguggagcccggcaagaauccuaagaaugugcagaccgcucccggcacauucaagaccucugaaggggaggucggagccauugcccucgauuuuaaaccgggcacauccgggagcccuaucgugaaccgcgaaggaaagauuguuggccuguauggcaaugggguggucacgaccuccggaacauacgugucugcuaucgcccaagcgaaagcuagccaggagggcccccucccugagaucgaagacgagguuuuccggaagagaaaccugaccauuauggaucuucaccccggguccggaaaaacccgccgguaucugcccgccaucgugagagaagccauuaagcgcaagcugcggacacucauccuggcuccuacgagagucguggccagcgagauggcugaagcccuuaaaggcaugccgauucgcuaccagaccacagcgguuaagucugagcauaccgggaaagagaucguggaccugaugugccacgccacauuuaccaugcggcuccugucccccgucagagugccuaauuauaacaugaucauuauggaugaagcucauuucacggaccccagcucuaucgccgcucggggcuacauuagcacacgcgugggaaugggcgaggccgccgcuaucuuuaugaccgcgaccccucccggguccgucgaagccuucccucaaucuaaugcuguuauucaggaugaggaaagagacaucccggagcggagcuggaacuccggauaugaguggaucacagauuuucccggcaagaccgugugguucgugccuucuauuaaaagcgggaaugacaucgccaacugucugcgcaagaauggaaagagagucauucagcucucccggaaaacauucgauaccgaauaccagaagacgaaaaacaacgacugggacuacgugguuacaaccgauaucagcgagaugggcgccaauuuuagagcugaccgcgugauugauccccggagaugccuuaagccugucauccugaaagacgggcccgaacgcgugauucuggccggcccgaugccuguuacaguggcgucugcugcccaacggagaggacgcaucggccggaaccacaauaaggagggggaucaguauaucuacaugggacagccccucaacaaugacgaggaucaugcccacuggaccgaagcuaagaugcugcuugacaacauuaauacgcccgagggcaucauuccugcccuguucgaacccgagagagaaaaauccgcggccaucgauggggaguaucgccucagaggagaggcucggaagaccuuugucgaacugaugcgcagaggcgaccugccuguguggcucagcuacaaagucgccuccgagggguuccaguauucugaucggcgcuggugcuuugacggcgaaagaaacaaucaagugcuugaggaaaacauggauguugagauuuggacaaaggagggagaacggaaaaagcugagaccgcgcuggcuggacgcucggaccuacagcgacccccucgcccugagagaguucaaagaauuugcugccggccgccgguccgugucuggggaucuuauccuggagaucggaaagcucccucagcaccugacacagagagcgcagaaugcccuggacaaccucgugaugcuucauaauagcgaacaaggcgggcgggcuuaucgccacgccauggaggagcugcccgauaccauugaaacacugaugcuccuggcucuuaucgccguccugaccggaggcguuacgcuguucuuucuguccggcagagggcugggaaagacaagcauuggccuccuuugugugauggccucuuccgugcugcuguggauggcuagcgucgagccucauuggaucgcggccucuauuauccucgaguucuuucugauggugcuucugauccccgagccggaccggcagcgcaccccucaggauaaccagcucgcuuacguugugauugggcugcuguucaugauccucaccgucgccgccaaugagaugggacuucuggaaacaaccaaaaaggaccugggcauugggcacguggcugucgagaaccaccaucacgccgcgaugcucgauguggaccugcaucccgccuccgcuuggacacuuuacgccguugcuacgaccaucauuacaccuaugaugagacacaccaucgaaaacacaaccgccaauauuagccugacggcgaucgccaaccaagcugccauccucaugggacuggauaaaggcuggcccauuucuaagauggacaucggcgugccucugcucgcucuugggugcuauagccaggucaauccccugacccugacagccgcugugcucaugcugguugcccauuacgcgauuaucggaccgggccuucaggccaaagcuacccgggaggcccaaaagcgcacagcugccgggauuaugaagaacccuaccguggauggaaucgucgccaucgaccuggaucccgugguguaugacgcgaaauuugaaaagcagcucggccagauuaugcugcugauccucuguacgucccagauucuucugaugagaacaaccugggcucugugcgagucuaucacacucgccaccgggccccugaccacacuuugggagggaagcccuggcaaauucuggaauacgaccauugcuguuuccauggccaacaucuuccggggcagcuaccuggccggggcuggacucgccuuuucccugaugaagucucugggcgggggacgcagaggcacaggggcgcaaggagaaacccucggcgagaaauggaagcggcagcuuaaucagcugagcaaguccgaguucaacacauauaaaagaucuggcaucauggaggucgaccgcagcgaagccaaggaggggcugaaacggggagagaccacgaagcacgcuguguccagaggcacagccaaacuccgcugguuuguggaacggaauuucgucaagccggaggggaagguuauugaucugggauguggcagagggggauggucuuacuauugcgcuggccuuaaaaaggugaccgaagugaaaggcuacaccaaagggggacccggccacgaggaaccuauccccauggccacauacggguggaaccuggucaaacuccauagcggaaaggacguguuuuucauuccucccgagaaaugugauacccugcugugcgacaucggcgaguccagcccuaauccgacaauugaagaggggcgcacgcuccggguucuuaagaugguggaacccuggcugagaggaaaccaguuuuguaucaagauucugaauccuuauaugcccucugucguggagacccucgagcgcaugcaacggaaacacggcggcaugcugguuagaaacccucuuucccgcaauagcacacaugaaauguacugggugucuugcgggaccggaaacaucgucuccgcggugaauaugacaagccggaugcugcucaacagauucaccauggcccaccgcaagcccacguaugagagagauguggaccugggcgcugggacccggcacgucgccguugaaccggagguggcuaaccuggauaucauuggacagcgcaucgaaaauauuaaacaugagcacaagucuacauggcauuacgacgaggauaacccuuauaaaaccugggccuaccacggcuccuaugaagugaagcccagcggguccgcuagcucuauggucaauggagugguuaagcuccugacaaaacccugggacgugaucccuauggucacccagauugccaugacagauaccacgcccuuuggccagcaaagaguguucaaggagaaaguugacacacggaccccuaaggcgaaaagaggcaccgcccagaucauggaagugacagcuaaguggcuuuggggguuucugagccggaacaagaaaccgcgcaucuguacgagagaggaguucacccggaagguccgcuccaaugccgcuauuggagccguguuuguugacgagaaccaguggaacucugccaaagaggcgguggaagaugagagauucugggaccucguccaucgggaacgcgagcugcacaagcaaggcaaaugcgcuacaugcguguacaacaugauggggaagagagaaaagaaacuuggagaguucggcaaggccaaagggagccgggccaucugguacauguggcugggcgcucgcuuucucgaguucgaagcccugggauuuaugaaugaggaucacugguucuccagagaaaacucucugagcggcgucgagggggagggacuccauaagcugggcuauauucuucgggacaucuccaaaauucccgggggaaauauguacgcugaugacaccgccggcugggauacacgcaucaccgaagacgaucugcagaacgaggcgaagaucacagacauuauggaaccugagcacgcccuccuggcuaaaucuaucuuuaaacuuaccuaucagaauaaggugguuagagugcagcggcccgccaaaaacgggacggucauggaugugauuagccgcagagaccaacggggcuccggacaggugggcaccuacgggcugaauacauucaccaacauggaagcucagcucaucagacagauggagagcgagggaaucuuuucuccuuccgaacuggagacacccaaccuggccggccgcguucucgauuggcuggaaaagcaugggguggagcggcuuaaaagaauggcgaucagcggagacgacugugucgugaagccgaucgaugaccgcuucgccaccgcucugacggcccucaaugauaugggcaaaguucggaaggacauuccucaaugggaacccucuaagggguggaacgauuggcaacaggugccuuuuugcucccaccacuuccaucagcugaucaugaaagacggcagagagauugucgugcccugucgcaaucaagaugagcuugucggacgggcuagagugagccagggcgccggguggucccugcgcgaaacagcuugccucggaaagucuuaugcccagauguggcagcugauguacuuucaccggagagaccugcgccucgcggccaacgcuaucuguagcgccguuccuguggauuggguccccaccucccggacaaccuggagcauucaugcccaccaucaauggaugacgaccgaggacaugcugucuguguggaauagaguuuggaucgaagagaacccguggauggaagauaaaacacacauuuccagcuggggcgacgugccuuaucuugggaagcgggaggaccaguggugcggaucucugaucggccucaccgcuagagccacaugggcgaccaauauccaggucgcuauuaaccaagugcgccggcugaucgggaaugagaacuaccuugauuacaugacaagcaugaaaagauucaagaaugaauccgaccccgagggcgcccugugguga

SEQ ID NO: 18988 - RNA, 9879 nt, Artificial Sequence
  derived and/or modified CDS sequence (opt5) from DENV-1__FJ882526__SS-prME
uccgugaccaugcugcugaugcugaugcccacagcccuugcuuuccaccugacgacccggggcggggaaccucauaugaucgucuccaagcaggaacggggaaagucucuccuguuuaagacaagcgccggcguuaauaugugcacccuuauugccauggaccugggggaguucugugaagauacaaugaccuacaaaugcccccgcaucacagaagcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaagagcucugaaacuuagcugguuuaagaaaggcuccucuauugggaagauguucgaggccaccgcucgcggcgcccggagaauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauucccgcagcaccucucucuccaugacauguaucgccguuggccuggugacccuguaccuuggggucauggugcaggcugauagcggaugcguuauuaacuggaaaggccgggaacucaaguguggguccggaaucuuugugacaaaugagguccacaccuggacagaacaguauaaguuccaagccgacucuccuaaaagacugagcgcggccauuggcaaggcuugggaggagggggugugcggcauccgcuccgccacccggcuggaaaacaucauguggaaacagauuucuaacgagcucaaucauauccugcuugaaaacgacaugaaguuuacgguuguggucggagauguggcuggcauucuggcccaggggaaaaagaugaucagaccgcagcccauggaguacaaauauagcuggaaguccuggggaaaggccaaaauuaucggcgcugacgugcaaaauacaaccuucaucauugaugggccuaacacccccgaauguccugacgaucagcgcgcguggaauaucugggaggucgaggacuacggauuuggcauuuucacaaccaacaucuggcucaagcugcgggauagcuauacgcagguuugcgaccacagacugaugucugccgcuauuaaagauuccaaggccgugcacgccgacaugggcuacuggaucgaaagcgagaaaaaugaaacauggaaacuugcucgcgccucuuucaucgaggugaagaccuguauuuggcccaaaucccauacacucuggagcaacgggguccuggaaucugagaugaucauuccgaagaucuauggaggcccuauuagccagcacaauuaccggcccggguacuuuacccaaacagcgggaccuuggcaucugggcaaacucgagcuggauuucgaccuuugcgaagggaccacggugguuguggaugagcacugcggaaacagaggccccucccugcggaccacaaccgucacaggcaagaucauccacgaaugguguugccgcagcuguacccucccuccccugagauuuaaaggggaggacggaugcugguauggcauggagauucggccggugaaggaaaaggaggaaaaucugguuaaaucuaugguguccgcugggagcggagaggucgacuccuucucucuuggccuccuguguaucagcauuaugaucgaagaggugaugagaucccgcuggucucggaagaugcugaugacggggacacucgccgucuuuuuccugcuuauuaugggacagcugaccuggaacgaucucaucagacugugcauuauggugggcgccaaugcuagcgaccgcaugggcauggggacaaccuaccuggcccuuauggcgaccuuuaaaaugagaccuauguucgcugucggacugcucuuucggcgccugacauccagagaggugcuccugcuuacgaucggccugucucucguggccagcgucgaacugcccaacucccuggaggaacuuggggauggacuggccaugggcaucaugauucucaagcugcucaccgacuuccagagccaucaacugugggcuacacuucugucucucaccuuuaucaaaacaaccuucucccugcacuaugccuggaagacgauggcuaugguucugagcauugugucucuuuuuccccugugucucuccacaaccagccagaagaccacauggcugccugugcuccuggggucucuuggaugcaaaccgcugaccauguuccugaucgccgagaauaagauuuggggccggaaauccuggccccucaacgaaggcaucauggcggucgggaucgugagcauucugcuuuccgcccugcucaagaacgauguuccucuggcuggaccccucaucgccggcgggaugcugauugcuuguuacgugaucagcggaucuagcgccgaccuuucccuggagaaagccgcugaggucucuugggaagaggaagcggagcauagcggcgccucccacaauauucugguggaaguucaggaugacgggacaaugaagaucaaagaugaggagcgcgacgauacgcucaccauccugcuuaaggcuacacugcucgccgugucuggagucuauccucugagcauucccgccacccucuucgugugguacuuuuggcagaagaaaaagcaaagauccggcguccugugggacacaccuucucccccggaaguggagcgggcuguucuugaugacggcaucuaucgcauuaugcagagagggcugcugggacggagccaggugggcgucgggguguuccaggaaaacguuuuucauaccauguggcacgugacgcgcggagccguccucauguaccaaggcaaaagacuggagccuuccugggcgagcgugaagaaagaccuuaucucuuacgggggaggcuggcggcugcagggcuccuggaauaccggggaggaagugcagguuauugcugucgagcccggaaagaacccuaagaaugugcagacagcccccggcaccuucaaaacaagcgaaggggaggugggagccaucgcucucgauuuuaagccgggcaccucuggguccccuauugucaacagagaaggaaaaaucgugggccuguauggcaaugggguugugacaacgagcggaaccuacgucuccgccaucgcgcaagcuaaggccucucaggagggcccccucccugagauugaagacgagguguuccgcaaacggaaccugacaaucauggaucuucaccccgggagcggaaagaccagacgcuaucugcccgccauuguucgggaagcuaucaagagaaaacugcgcacccucauucuggccccuacacggguggucgcuuccgagauggccgaagcgcuuaagggcaugccgaucagauaccagacgaccgccgugaaaagcgagcauacagggaaggagaucguugaccugaugugccacgcuaccuuuacaaugcgccuccugucucccgugcgggucccuaauuauaacaugauuaucauggaugaagcccauuucaccgaccccuccagcauugcugccagaggcuacaucucuacgcgggugggaaugggcgaggccgcugcgauuuuuaugacagccaccccucccgggagcguggaggcuuucccucaauccaaugccgucauccaggaugaagaacgcgacaucccggagagaucuuggaacagcggauaugaguggauuaccgauuuucccggcaaaacaguuugguucgugccuuccaucaagucugggaaugacauugccaacugucugcggaagaauggaaaacgcgugauccagcucagcagaaagaccuucgauacagaauaccagaaaaccaagaacaacgacugggacuacgucgugacgacagauauuuccgagaugggcgcuaauuuucgggccgacagaguuaucgauccccgccggugccuuaaaccugugauucugaaggacgggcccgaaagagucauccuggcgggcccgaugccugugaccguugcuagcgccgcccaacgccggggaagaaucggccgcaaccacaauaaggagggggaucaguauauuuacaugggacagccccucaacaaugacgaggaucaugcucacuggacagaagccaaaaugcugcuugacaacaucaauacccccgagggcauuaucccugcgcuguucgaacccgagcgggaaaagucugccgcuauugauggggaguauagacuccgcggagaggccagaaaaacguuuguggaacugaugcggcgcggcgaccugccugucuggcucuccuacaagguggcuagcgagggguuccaguauuccgauagacgguggugcuuugacggcgaacgcaacaaucaaguccuugaggaaaacauggauguggagaucuggaccaaagagggagaaagaaagaaacugcggccgagauggcuggacgcccgcacauacucugacccccucgcucugcgggaguucaaggaauuugccgcgggcagacgcagcguuuccggggaucuuauccuggagauuggaaagcucccucagcaccugacccagcgggcccagaaugcucuggacaaccucgugaugcuucauaauucugaacaaggcgggagagccuaucggcacgcuauggaggagcugcccgauacaaucgaaacccugaugcuccuggcccuuauugccgugcugacaggaggcgucacccucuucuuucugagcggccgcgggcugggaaaaacguccaucggccuccuuuguguuauggcuagcucugugcugcuguggauggcguccguggagccucauuggauugccgcuagcaucauccucgaguucuuucugaugguccuucugauucccgagccggacagacagcggacaccucaggauaaccagcucgccuacgugguuaucgggcugcuguucaugauucucaccguggccgcuaaugagaugggacuucuggaaaccacaaagaaagaccugggcaucgggcacgucgccguggagaaccaccaucacgcggccaugcucgaugucgaccugcaucccgcuucugccuggacccuuuacgcuguggccacaacgauuaucaccccuaugaugcgccacacaauugaaaacaccacagcgaauaucucccugaccgccaucgcuaaccaagccgcuauucucaugggacuggauaagggcuggcccaucagcaaaauggacauuggcguuccucugcucgcccuugggugcuauucucaggugaauccccugacgcugaccgcugccguccucaugcugguggcgcauuacgccaucauuggaccgggccuucaggcuaaggccacaagagaggcucaaaagcggaccgccgccgggaucaugaaaaacccuacaguugauggaaucguggcgauugaccuggaucccgucguguaugacgcuaaguuugaaaaacagcucggccagaucaugcugcugauucucuguaccagccagauccuucugaugcgcacgacaugggcccugugcgaguccauuacccucgcuacagggccccugaccacccuuugggagggaucuccuggcaaguucuggaauacaacgaucgccgugagcauggccaacaucuucagaggcuccuaccuggcuggggccggacucgcguuuagccugaugaaaucccugggcgggggacggcgcggcaccggggcccaaggagaaacacucggcgagaaguggaagagacagcuuaaucagcugucuaaaagcgaguucaacaccuauaagcgguccggcauuauggagguugacagaucugaagcuaaagaggggcugaagcgcggagagacaaccaaacacgccgucagccggggcacggcuaagcucagaugguuuguggaacgcaaucuggugaagccggaggggaaagucaucgaucuuggauguggcagagggggaugguccuacuauugcgccggccugaagaaaguuacagaagugaagggcuacaccaaagggggacccggccacgaggaaccuauucccauggcgaccuacggguggaaccucgugaagcugcauucuggaaaagacgucuucuuuaucccucccgagaagugugauacacugcucugcgacauuggcgagagcuccccuaauccgaccaucgaagaggggagaacacuucgcgugcugaagaugguugaacccuggcugcggggaaaccaguucuguauuaaaauccucaauccuuauaugcccagcguggucgagacgcuggagcaaaugcagagaaagcacggcggcaugcuugugcgcaacccucugucuagaaauuccacccaugaaauguacuggguuagcugcgggacaggaaacaucgugucugccgucaauaugaccuccagaaugcuccugaaccgcuuuacaauggcucaccggaaacccaccuaugagagagauguggaccugggcgccgggacgcgccacguggcugucgaaccggagguugccaaccucgauauuaucggacagagaauugaaaauaucaagcaugagcacaaaagcaccuggcauuacgacgaggauaacccuuauaagacaugggcuuaccacggcucuuaugaagugaagcccuccgggagcgccuccagcauggugaauggagucgugaaacugcuuaccaagcccugggacguuauuccuauggugacacagaucgcgaugaccgauacaacccccuucggccaacagcgggucuuuaaagagaagguggacacgcgcacaccuaaagccaagagaggcaccgcucagaucauggaaguuaccgccaaguggcuguggggguuccucucucggaacaaaaagccgagaauuuguacacgggaggaauuuacgcgcaaagugagaagcaaugcugccaucggagccgucuucguggacgagaaccaauggaacuccgcgaaggaggcuguugaagaugagcgguuuugggaccuggugcaucgcgaaagagagcuucacaaacagggcaagugcgcgaccugcgucuacaacaugauggggaagcgggagaagaagcugggagaguucggcaaagccaaggggucucgcgcuauuugguacauguggcucggcgccagauuccuggaguuugaagcucugggauucaugaaugaggaucacugguuuagccgggaaaacucccucucuggcguggagggggagggacugcauaaacuuggcuauauccugcgcgacauuagcaagauccccgggggaaauauguacgccgaugacacagcgggcugggauaccagaaucacagaagacgaucuccagaacgaggccaaaauuaccgacaucauggaaccugagcacgcucugcuugccaaguccauuuucaagcugacauaucagaauaaagucgugcggguucaacgccccgcuaagaacgggaccgugauggaugucaucucuagacgggaccagcgcggcagcggacaggugggcacguacgggcucaauaccuuuacaaacauggaagcccagcugauuagacaaauggaguccgagggaaucuucagcccuucugaacuggagacccccaaccucgcgggccgggugcuggauuggcuugaaaaacaugggguugagagacugaagcgcauggccaucuccggagacgacuguguggucaaaccgauugaugaccgguuugcuacagcccucaccgcucugaaugauaugggcaaggugagaaaggacaucccucagugggaacccagcaaaggguggaacgauuggcagcagguuccuuucugcucucaccacuuucaucaacuuauuaugaaggacggccgcgagaucgugguccccugucggaaucaggaugagcuggugggacgggcccgcgucucccagggcgcuggguggagccuccgggaaacggccugccugggaaaauccuaugcgcagauguggcaacugauguacuuccacagacgcgaccuccggcuggccgcuaacgccauuuguucugccgugccuguugauugggugcccacaagcagaaccacaugguccauccaugcucaccaucaguggaugaccacggaggacaugcuuagcgucuggaaucgcguguggauugaagagaacccguggauggaagauaagacccacaucucuuccuggggcgacguuccuuaucuggggaaacgggaggaccaguggugcggaagccucaucggccugacagccagagcgaccugggcuacaaauauucaaguggccaucaaccagguccggagacuuauugggaaugagaacuaccuggauuacaugaccucuaugaagcgcuuuaagaaugaaagcgaccccgagggcgcccucugguga

SEQ ID NO: 18989 - RNA, 9879 nt, Artificial Sequence
  derived and/or modified CDS sequence (opt5) from DENV-1__FJ882527__SS-prME
agcgugaccaugcugcugaugcugaugcccacagcccuugcuuuccaccugacgaccagaggcggggaaccucauaugauugucuccaagcaggaacggggaaaaucucuccuguuuaagacaagcgccggcguuaauaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuaugcuggcugucggacuccuguucagacggcucacgucccgcgaggugcugcuucugaccauuggccucucucugguggccagcgucgaacugcccaacucccuugaggaacugggggauggacucgccaugggcaucaugauccugaaacuccugacagacuuucagagccaucaacuuugggcuacccugcucucucugacauucauuaagaccacguuuucccugcacuaugccuggaagacaauggcuaugguucuuagcaucgugucucuguucccccucugucuguccaccaccagccagaaaacaaccuggcucccugugcugcuugggucucugggaugcaagccgcuggccauguuucucauugcggagaauaaaaucuggggcagaaaguccuggccccugaacgaaggcauuauggccgucgggaucgugagcauccuucuguccagccuccugaaaaacgauguuccucucgcuggaccccugauugccggcgggaugcuuaucgcuuguuacgugauuucuggaagcuccgccgaccugucucuggagaaggccgcugaggucagcugggaagaggaagcggagcauuccggcgccucucacaauauccucguggaaguucaggaugacgggacaaugaaaauuaaggaugaggagcgggacgauacgcugaccauccuucugaaggcuacacuccuggccgugagcggagucuauccucucuccauccccgccacccuguucgugugguacuucuggcagaaaaagaaacaacgcucuggcguccuuugggacacaccuuccccucccgaaguggagagagcuguucuggaugacggcauuuaucggaucaugcagcgcgggcugcucggaagaucccaggugggcgucgggguguuucaggaaaacguuuuccauaccauguggcacgugacgcggggagccguccugauguaccaaggcaagcgccuugagcccagcugggcgucugugaaaaaggaccugauuuccuacgggggaggcuggagacuccagggcagcuggaauaccggggaggaagugcagguuaucgcugucgagcccggaaagaacccuaaaaaugugcagacagcccccggcaccuuuaagacaucugaaggggaggugggagccauugcucuggauuucaaaccgggcaccuccgggagcccuaucgucaaccgggaaggaaagauugugggccucuauggcaaugggguugugacaacguccggaaccuacgucucugccaucgcgcaagcuaaagccagccaggagggcccccugccugagaucgaagacgagguguuuagaaagcgcaaccuuacaauuauggaucugcaccccggguccggaaagacccggagauaucugcccgccaucguucgcgaagcuauuaaacggaagcucagaacccugauccuugccccuacacgcguggucgcuagcgagauggccgaagcgcugaaaggcaugccgauucgguaccagacgaccgccgugaagucugagcauacagggaaagagaucguugaccucaugugccacgcuaccuucacaaugagacugcugucccccgugcgcgucccuaauuauaacaugaucauuauggaugaagcccauuuuaccgaccccagcucuaucgcugcccggggcuacauuagcacgagagugggaaugggcgaggccgcugcgaucuucaugacagccaccccucccggguccguggaggcuuuuccucaaucuaaugccgucauucaggaugaagaacgggacaucccggagcgcagcuggaacuccggauaugaguggaucaccgauuuccccggcaagacaguuugguuugugccuucuauuaagagcgggaaugacaucgccaacugucuccgcaagaauggaaagcgggugauucagcuuucccgcaaaaccuucgauacagaauaccagaagaccaaaaacaacgacugggacuacgucgugacgacagauaucagcgagaugggcgcuaauuucagagccgaccggguuauugaucccagacgcugccugaagccugugauccugaaggacgggcccgaacgggucauucucgcgggcccgaugccugugaccguugcuucugccgcccaaagacgcggacggaucggcagaaaccacaauaaagagggggaucaguauaucuacaugggacagccccugaacaaugacgaggaucaugcucacuggacagaagccaagaugcuucuggacaacauuaauacccccgagggcaucauuccugcgcucuuugaacccgagcgcgaaaaauccgccgcuaucgauggggaguaucggcugagaggagaggcccgcaagacguucguggaacugaugagacggggcgaccucccugucuggcuuagcuacaaaguggcuuccgagggguuucaguauucugaucgcagauggugcuucgacggcgaacggaacaaucaaguccuggaggaaaacauggauguggagauuuggaccaaggagggagaacgcaaaaagcugagaccgcgguggcucgacgccagaacauacagcgacccccuggcucuuagagaguuuaaggaguucgccgcgggccggagauccguuucuggggaucugauccucgagaucggaaaacugccucagcaccugacccagcgcgcccagaaugcucucgacaaccuugugaugcugcauaauagcgaacaaggcgggcgggccuauagacacgcuauggaggagcugcccgauacaauugaaacccucaugcugcuugcccugaucgccgugcucacaggaggcgucacccuguuuuuccuguccggccgggggcucggaaagacgagcauuggccuucuguguguuauggcuucuuccgugcugcucuggauggcgagcguggagccucauuggaucgccgcuucuauuauccuggaauuuuuccuuaugguccugcucauccccgagccggaccgccagagaacaccucaggauaaccagcuggccuacgugguuauugggcugcucuuuaugauccuuaccguggccgcuaaugagaugggacugcuggaaaccaccaagaaggaccucggcauugggcacgucgccguggagaaccaccaucacgcggccaugcuggaugucgaccuucaucccgcuuccgccuggacccuguacgcuguggccacaacgaucauuaccccuaugaugcggcacacaaucgaaaacaccacagcgaauauuagccucaccgccaucgcuaaccaagccgcuauccugaugggacuggauaaaggcuggcccauuucuaagauggacaucggcguuccucuccuugcccuggggugcuauagccaggugaauccccugacgcucaccgcugccguccugaugcuuguggcgcauuacgccauuaucggaccgggccugcaggcuaaggccacacgcgaggcucagaagagaaccgccgccgggauuaugaagaacccuacaguugauggaaucguggcgaucgaccucgaucccgucguguaugacgcuaaauucgaaaagcagcugggccagauuaugcugcucauccuuuguaccucccagauucugcugaugcggacgacaugggcccucugcgagucuaucacccuggcuacagggccccuuaccacccugugggagggaagcccuggcaaauuuuggaauacaacgauugccguguccauggccaacaucuuccgcggcagcuaccucgcuggggccggacuggcguucucccugaugaagucucucggcgggggaagacggggcaccggggcccaaggagaaacacuuggcgagaaguggaaacgccagcugaaucagcugagcaaguccgaauuuaacaccuauaaaagaucuggcaucauggagguugaccggagcgaagcuaaggaggggcucaaaagaggagagacaaccaagcacgccgucucccgcggcacggcuaagcugcggugguucguggaaagaaaucuugugaaaccggaggggaaggucauugaucugggauguggccgcgggggauggucuuacuauugcgccggccucaaaaagguuacagaagugaaaggcuacaccaaagggggacccggccacgaggaaccuauccccauggcgaccuacggguggaaccuggugaaacugcauagcggaaaggacgucuuuuucauuccucccgagaagugugauacacuccuuugcgacaucggcgaguccagcccuaauccgaccauugaagaggggcggacacugagagugcugaaaaugguugaacccuggcuccgcggaaaccaguuuuguaucaagauucugaauccuuauaugcccucuguggucgagacgcuugagcaaaugcagcggaaacacggcggcaugcuggugagaaacccucucucccgcaauagcacccaugaaauguacuggguuucuugcgggacaggaaacaucguguccgccgucaauaugaccagccggaugcugcugaacagauucacaauggcucaccgcaagcccaccuaugagcgggauguggaccucggcgccgggacgagacacguggcugucgaaccggagguugccaaccuggauaucauuggacagcgcaucgaaaauauuaaacaugagcacaagucuaccuggcauuacgacgaggauaacccuuauaagacaugggcuuaccacggcuccuaugaagugaaacccagcggguccgccagcucuauggugaauggagucgugaaacuucugaccaaacccugggacguuaucccuauggugacacagauugcgaugaccgauacaacccccuuuggccaacagagagucuucaaggagaaaguggacacgcggacaccuaaggccaagcgcggcaccgcucagaucauggaaguuaccgccaaauggcucuggggguuucugagcagaaacaagaaaccgcggaucuguacaagagaggaguucacgcggaaggugcgcuccaaugcugccauuggagccgucuuuguggacgagaaccaauggaacucugcgaaagaggcuguugaagaugagagauucugggaccuugugcaucgggaacgcgagcugcacaagcagggcaagugcgcuaccugcgucuacaacaugauggggaaaagagaaaagaaacucggagaguuuggcaaggccaaagggagccgggcuaucugguacauguggcugggcgcccgcuuccuggaguucgaagcucucggauuuaugaaugaggaucacugguucuccagagaaaacucucugagcggcguggagggggagggacuucauaagcugggcuauauucuccgggacaucuccaaaauucccgggggaaauauguacgccgaugacacagcgggcugggauacccgcaucacagaagacgaucugcagaacgaggccaagaucaccgacauuauggaaccugagcacgcccuucuggccaagucuaucuuuaaacucacauaucagaauaaggucgugagaguucaacggcccgcuaaaaacgggaccgugauggaugucauuagccgcagagaccagcggggcuccggacaggugggcacguacgggcugaauaccuucacaaacauggaagcccagcugauccgccaaauggagagcgagggaaucuuuucuccuuccgaacucgagacccccaaccuggcgggcagagugcuugauuggcuggaaaagcaugggguugagcggcucaaaagaauggccaucagcggagacgacuguguggucaagccgaucgaugaccgcuucgcuacagcccugaccgcucuuaaugauaugggcaaggugcggaaagacauuccucagugggaacccucuaagggguggaacgauuggcagcagguuccuuuuugcucccaccacuuccaucaacugaucaugaaagacggcagagagauugugguccccugucgcaaucaggaugagcucgugggacgggccagagucagccagggcgcuggguggucccugcgcgaaacggccugccugggaaagucuuaugcgcagauguggcaacucauguacuuucaccggagagaccugcgccuugccgcuaacgccaucuguagcgccgugccuguugauugggugcccacaucccggaccacauggagcauucaugcucaccaucaguggaugaccacggaggacaugcugucugucuggaauagaguguggaucgaagagaacccguggauggaagauaaaacccacauuuccagcuggggcgacguuccuuaucucgggaagcgcgaggaccaguggugcggaucucugaucggccuuacagcccgggcgaccugggcuacaaauauccaaguggccauuaaccaggucagacggcugaucgggaaugagaacuaccucgauuacaugaccagcaugaagagauucaaaaaugaauccgaccccgagggcgcccugugguga

SEQ ID NO: 18990 - RNA, 9879 nt, Artificial Sequence
  derived and/or modified CDS sequence (opt5) from DENV-1__FJ882529__SS-prME
agcgugaccaugcugcugaugcugaugcccacggcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugcccgcgcaucacagaagcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacguuaaguuuacgguggucgugggagauguggcuggcauucuggcccaggggaaaaagaugauccggccgcaacccauggaguacaaauauagcuggaaguccuggggaaaggccaaaauuaucggcgcugacguccagaauacaaccuucaucauugaugggccuaacacccccgaauguccugacgaucagagagcguggaauaucugggagguugaggacuacggauuuggcauuuucacaaccaacaucuggcucaagcugcgcgauagcuauacacaggugugcgaccaccggcugaugucugccgcuauuaaagauuccaaggccgugcacgccgacaugggcuacuggaucgaaagcgagaaaaaugaaacauggaaacuugcuagagccucuuucaucgaggucaagaccuguauuuggcccaaaucccauacacucuggagcaacggggugcuggaaucugagaugaucauuccgaagaucuauggaggcccuauuagccaacacaauuaccgccccggguacuuuacccagacagcgggaccuuggcaucugggcaaacucgagcuggauuucgaccuuugcgaagggaccacgguuguggucgaugagcacugcggaaaccggggccccucccugagaaccacaaccgugacaggcaagaucauccacgaaugguguugccggagcuguacccucccuccccugcgcuuuaaaggggaggacggaugcugguauggcauggagauuagaccgguuaaggaaaaggaggaaaaucuggugaaaucuauggucuccgcugggagcggagagguggacuccuucucucuuggccuccuguguaucagcauuaugaucgaagagguuaugcgguccagauggucucgcaagaugcugaugacggggacacucgccguguuuuuccugcuuauuaugggacagcugaccuggaacgaucucauccggcugugcauuauggucggcgccaaugcuagcgacagaaugggcauggggacaaccuaccuggcccuuauggcgaccuuuaaaaugcgcccuauguucgcugugggacugcucuuuagacggcugacaucccgcgaggugcuccugcuuacgaucggccugucucucgucgccagcguugaacugcccaacucccuggaggaacuuggggauggacuggccaugggcaucaugauucucaagcugcucaccgacuuccaaagccaucagcugugggcuacacuucugucucucaccuuuaucaaaacaaccuucucccugcacuaugccuggaagacgauggcuauggugcugagcauugugucucuuuuuccccugugucucuccacaaccagccagaagaccacauggcugccuguccuccuggggucucuuggaugcaaaccgcugaccauguuccugaucgccgagaauaagauuuggggcagaaaauccuggccccucaacgaaggcaucauggcgguggggaucguuagcauucugcuuuccagccugcucaagaacgaugugccucuggccggaccccucaucgcuggcgggaugcugauugccuguuacgucaucucuggaagcuccgcugaccuuucucuggagaaagccgccgaggugagcugggaagaggaagcugagcauuccggcgcgucucacaauauucugguugaagugcaggaugacgggacaaugaagaucaaagaugaggagcgggacgauacgcucaccauccugcuuaaggccacacugcucgcugucagcggaguguauccucuguccauucccgccacccucuucgucugguacuuuuggcaaaagaaaaagcagcgcucuggcgugcugugggacacaccuuccccucccgaaguugagagagccgugcuugaugacggcaucuaucggauuaugcagcgcgggcugcugggaagaucccaggucggcguggggguuuuccaagaaaacguguuucauaccauguggcacgucacgcggggagcugugcucauguaccagggcaaacgccuggagcccagcugggccucugugaagaaagaccuuaucuccuacgggggaggcuggagacugcagggcagcuggaauaccggggaggaaguucaggucauugcgguggagcccggaaagaacccuaagaaugugcaaacagcucccggcaccuucaaaacaucugaaggggaggucggagccaucgcccucgauuuuaagccgggcaccuccgggagcccuauugugaaccgggaaggaaaaaucguuggccuguauggcaaugggguggucacaacguccggaaccuacgugucugcuaucgcccaggcgaaggcuagccaggagggcccccucccugagauugaagacgagguuuucagaaaacgcaaccugacaaucauggaucuucaccccggguccggaaagacccggagauaucugcccgccauugugcgcgaagccaucaagcggaaacugagaacccucauucuggcuccuacacgcgucguggccagcgagauggcugaagcccuuaagggcaugccgauccgguaccaaacgaccgcgguuaaaucugagcauacagggaaggagaucguggaccugaugugccacgccaccuuuacaaugagacuccugucccccguccgcgugccuaauuauaacaugauuaucauggaugaagcucauuucaccgaccccagcucuauugccgcucggggcuacaucagcacgagagugggaaugggcgaggccgccgcuauuuuuaugacagcgaccccucccggguccgucgaagccuucccucagucuaaugcuguuauccaggaugaggaacgggacaucccggagcgcagcuggaacuccggauaugaguggauuaccgauuuucccggcaaaacagugugguucgugccuucuaucaagagcgggaaugacauugccaacugucugagaaagaauggaaaacgggucauccagcucucccgcaagaccuucgauacagaauaccagaagaccaagaacaacgacugggacuacgugguuacgacagauauuagcgagaugggcgccaauuuuagagcugaccgggugaucgaucccagacgcugccuuaaaccugucauucugaaggacgggcccgaacgggugauccuggccggcccgaugccuguuaccguggcgucugcugcccagagacgcggacggaucggcagaaaccacaauaaggagggggaucaguauauuuacaugggacagccccucaacaaugacgaggaucaugcccacuggacagaagcuaaaaugcugcuugacaacaucaauacccccgagggcauuaucccugcccuguucgaacccgagcgcgaaaaguccgcggccauugauggggaguaucggcucagaggagaggcucgcaaaacguuugucgaacugaugagacggggcgaccugccuguguggcucagcuacaaggucgccuccgagggguuccaauauucugaucgcagauggugcuuugacggcgaacggaacaaucaggugcuugaggaaaacauggauguugagaucuggaccaaagagggagaacgcaagaaacugagaccgcgguggcuggacgcuagaacauacagcgacccccucgcccugcgcgaguucaaggaauuugcugccggccggagauccgugucuggggaucuuauccuggagauuggaaagcucccucagcaccugacccagcgcgcgcaaaaugcccuggacaaccucgugaugcuucauaauagcgaacagggcgggcgggcuuauagacacgccauggaggagcugcccgauacaaucgaaacccugaugcuccuggcucuuauugccguccugacaggaggcguuacccucuucuuucuguccggccgggggcugggaaaaacgagcaucggccuccuuugugugauggccucuuccgugcugcuguggauggcuagcgucgagccucauuggauugcggccucuaucauccucgaguucuuucugauggugcuucugauucccgagccggaccgccagagaacaccucaggauaaccaacucgcuuacguugugaucgggcugcuguucaugauucucaccgucgccgccaaugagaugggacuucuggaaaccacaaagaaagaccugggcaucgggcacguggcugucgagaaccaccaucacgccgcgaugcucgauguggaccugcaucccgccuccgcuuggacccuuuacgccguugcuacaacgauuaucaccccuaugaugcggcacacaauugaaaacaccacagccaauaucagccugaccgcgaucgccaaccaggcugccauucucaugggacuggauaagggcuggcccaucucuaaaauggacauuggcgugccucugcucgcucuugggugcuauagccaggucaauccccugacgcugaccgccgcugugcucaugcugguugcccauuacgcgaucauuggaccgggccuucaagccaaggcuacacgcgaggcccagaagagaaccgcugccgggaucaugaaaaacccuacaguggauggaaucgucgccauugaccuggaucccgugguguaugacgcgaaguuugaaaaacagcucggccagaucaugcugcugauucucuguaccucccaaauccuucugaugcggacgacaugggcucugugcgagucuauuacccucgccacagggccccugaccacccuuugggagggaagcccuggcaaguucuggaauacaacgaucgcuguuuccauggccaacaucuuccgcggcagcuaccuggccggggcuggacucgccuuuucccugaugaaaucucugggcgggggaagacggggcaccggggcgcagggagaaacacucggcgagaaguggaagcgccagcuuaaucagcugagcaaauccgaguucaacaccuauaagagaucuggcauuauggaggucgaccggagcgaagccaaagaggggcugaagagaggagagacaaccaaacacgcugugucccgcggcacggccaagcuccggugguuuguggaaagaaaucuggucaagccggaggggaaaguuaucgaucuuggauguggccgcgggggauggucuuacuauugcgcuggccugaagaaagugacagaagugaagggcuacaccaaagggggacccggccacgaggaaccuauucccauggccaccuacggguggaaccucgucaagcugcauagcggaaaagacguguucuuuaucccucccgagaagugugauacacugcucugcgacauuggcgaguccagcccuaauccgaccaucgaagaggggcggacacuuagaguucugaagaugguggaacccuggcugcgcggaaaccaauucuguauuaaaauccucaauccuuauaugcccucugucguggagacgcuggagcagaugcagcggaagcacggcggcaugcuuguuagaaacccucugucccgcaauagcacccaugaaauguacugggugucuugcgggacaggaaacaucgucuccgcggugaauaugaccagccggaugcuccugaacagauuuacaauggugcaccgcaaacccaccuaugagcgggaugucgaccugggcgccgggacgagacacguugcuguggaaccggagguggccaaccucgauauuaucggacagcgcauugaaaauaucaagcaugagcacaaaucuaccuggcauuacgacgaggauaacccuuauaagacaugggcuuaccacggcuccuaugaagucaagcccagcggguccgccagcucuauggugaauggaguugugaaacugcuuaccaagcccugggacgucauuccuauggugacacaaaucgcuaugaccgauacaacccccuucggccagcagagaguuuuuaaagagaagguggacacgcggacaccuaaagccaagcgcggcaccgcgcaaaucauggaagucaccgccaaguggcuguggggguuccucagcagaaacaaaaagccgcggauuuguacaagagaggaauuuacgcggaaagugcgcuccaaugcugccaucggagcuguuuucguggacgagaaccaguggaacucugccaaggaggccgucgaagaugagagauuuugggaccuggugcaucgggaacgcgagcuucacaaacagggcaagugcgcgaccugcgucuacaacaugauggggaagagagagaagaagcugggagaguucggcaaagcuaaggggagccgggccauuugguacauguggcucggcgcccgcuuccuggaguuugaagcucugggauucaugaaugaggaucacugguuuuccagagaaaacucucucagcggcguggagggggagggacugcauaaacuuggcuauauccugcgggacauuuccaagauccccgggggaaauauguacgccgaugacacagcuggcugggauacccgcaucacagaagacgaucuccagaacgaggccaaaauuaccgacaucauggaaccugagcacgcgcugcuugccaagucuauuuucaagcugacauaucaaaauaaaguugugagaguccagcggcccgcuaagaacgggaccgugauggaugugaucagccgcagagaccagcggggcuccggacagguuggcacguacgggcucaauaccuuuacaaacauggaagcccaacugauucgccagauggagagcgagggaaucuucucuccuuccgaacuggagacccccaaccucgcuggcagagugcuggauuggcuugaaaaacauggggucgagcggcugaagagaauggccaucagcggagacgacugugugguuaaaccgauugaugaccgcuuugcgacagcccucaccgcucugaaugauaugggcaaggugcggaaggacaucccucagugggaacccucuaaaggguggaacgauuggcagcaagucccuuucugcucccaccacuuucaucagcuuauuaugaaggacggcagagagaucgugguccccugucgcaaucaggaugagcuggugggacgggccagaguuagccagggcgcuggguggucccuccgcgaaacggccugccugggaaaaucuuaugcucaaauguggcagcugauguacuuccaccggagagaccuccgccuggccgcgaacgccauuuguagcgcugugccugucgauugggugcccacaucccggaccacauggagcauccaugcccaccaucaguggaugaccacggaggacaugcuuucuguuuggaauagaguguggauugaagagaacccguggauggaagauaagacccacaucuccagcuggggcgacgucccuuaucuggggaaacgcgaggaccaauggugcggaucucucaucggccugacagcccgggcuaccugggccacaaauauucagguggcgaucaaccaggugagacggcuuauugggaaugagaacuaccuggauuacaugaccagcaugaagagauuuaagaaugaauccgaccccgagggcgcucucugguga

SEQ ID NO: 18991 - RNA, 9879 nt, Artificial Sequence
  derived and/or modified CDS sequence (opt5) from DENV-1__FJ882530__SS-prME
agcgugaccaugcugcucaugcugaugcccaccgcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagccacacacagguuugcgaccaccggcugaugucugccgcuaucaaggauuccaaagccgugcaugccgacaugggcuauuggauugaaagcgagaagaaugaaaccuggaaacuugcuagagccucuuucaucgaggugaaaacauguaucuggcccaagucccacacccucuggagcaacgggguccuggaaucugagaugauuaucccgaaaauuuacggaggcccuaucagccagcauaauuaucgccccggguacuuuacacaaaccgcgggaccuuggcaccugggcaagcucgagcuggauuucgaccuuugcgaagggacgaccgugguuguggaugagcacugcggaaaccggggccccucccugagaacaaccacagucaccggcaaaauuauccaugaaugguguugccggagcuguacgcucccuccccugcgcuuuaagggggaggacggaugcugguacggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaucuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaccaacugugggcuacccuucugucucucacauuuauuaagaccacguucucccugcauuacgccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuaugugauuucuggaagcuccgcugaccuuucucuggagaaggccgccgaggucagcugggaagaggaagcugagcacuccggcgcgucucauaauauccugguggaaguucaggaugacgggacgaugaaaauuaaggaugaggagcgggacgauacccucacaauccugcuuaaggccacccugcucgcugugagcggagucuacccucuguccauccccgccacacucuucgugugguauuuuuggcagaaaaagaaacaacgcucuggcguccugugggacaccccuuccccucccgaaguggagagagccguucuugaugacggcauuuaccggaucaugcagcgcgggcugcugggaagaucccaggugggcgucgggguguuccaggaaaacguuuuucacacgauguggcacgugacccggggagcuguccucauguaucaaggcaagcgccuggagcccagcugggccucugugaaaaaggaccuuauuuccuacgggggaggcuggagacugcagggcagcuggaauacaggggaggaagugcagguuaucgcggucgagcccggaaagaacccuaaaaaugugcagaccgcucccggcacauucaagaccucugaaggggaggugggagccauugcccucgauuuuaaaccgggcacauccgggagcccuaucgucaaccgggaaggaaagauugugggccuguacggcaaugggguugugacgaccuccggaacauaugucucugcuaucgcccaagcgaaagcuagccaggagggcccccucccugagaucgaagacgagguguucagaaagcgcaaccugaccauuauggaucuucaucccggguccggaaagacccggagauaccugcccgccaucguucgcgaagccauuaaacggaagcugagaacacucauccuggcuccuacgcgcguggucgccagcgagauggcugaagcccuuaaaggcaugccgauucgguaucagaccacagcggugaagucugagcacaccgggaaagagaucguugaccugaugugccaugccacauuuaccaugagacuccugucccccgugcgcgucccuaauuacaacaugaucauuauggaugaagcucacuucacggaccccagcucuaucgccgcucggggcuauauuagcacaagagugggaaugggcgaggccgccgcuaucuuuaugaccgcgaccccucccggguccguggaagccuucccucaaucuaaugcugucauucaggaugaggaacgggacaucccggagcgcagcuggaacuccggauacgaguggaucacagauuuucccggcaagaccguuugguucgugccuucuauuaagagcgggaaugacaucgccaacugucugcgcaagaauggaaagcgggugauucagcucucccgcaaaacauucgauaccgaauaucagaagacgaaaaacaacgacugggacuacgucgugacaaccgauaucagcgagaugggcgccaauuuuagagcugaccggguuauugaucccagacgcugccuuaagccugugauccugaaggacgggcccgaacgggucauucuggccggcccgaugccugugacaguugcgucugcugcccaaagacgcggacggaucggcagaaaccauaauaaagagggggaucaguacaucuauaugggacagccccucaacaaugacgaggaucacgcccacuggaccgaagcuaagaugcugcuugacaacauuaauacgcccgagggcaucauuccugcccuguucgaacccgagcgcgaaaaauccgcggccaucgauggggaguaccggcucagaggagaggcucgcaagaccuuuguggaacugaugagacggggcgaccugccugucuggcucagcuauaaaguggccuccgagggguuccaguacucugaucgcagauggugcuuugacggcgaacggaacaaucaaguccuugaggaaaacauggauguggagauuuggacaaaggagggagaacgcaaaaagcugagaccgcgguggcuggacgcuagaaccuauagcgacccccucgcccugcgcgaguucaaggaauuugcugccggccggagauccguuucuggggaucuuauccuggagaucggaaaacucccucagcaucugacacagcgcgcgcagaaugcccuggacaaccucgugaugcuucacaauagcgaacaaggcgggcgggcuuacagacaugccauggaggagcugcccgauaccauugaaacacugaugcuccuggcucuuaucgccgugcugaccggaggcgucacgcuguucuuucuguccggccgggggcugggaaagacaagcauuggccuccuuuguguuauggccucuuccgugcugcuguggauggcuagcguggagccucacuggaucgcggccucuauuauccucgaguucuuucugaugguccuucugauccccgagccggaccgccagagaaccccucaggauaaccagcucgcuuaugugguuauugggcugcuguucaugauccucaccguggccgccaaugagaugggacuucuggaaacaaccaaaaaggaccugggcauugggcacgucgcuguggagaaccaucaccaugccgcgaugcucgaugucgaccugcaccccgccuccgcuuggacacuuuacgccguggcuacgaccaucauuacaccuaugaugcggcauaccaucgaaaacacaaccgccaauauuagccugacggcgaucgccaaccaagcugccauccucaugggacuggauaaaggcuggcccauuucuaagauggacaucggcguuccucugcucgcucuugggugcuacagccaggugaauccccugacccugacagccgcuguccucaugcugguggcccacuaugcgauuaucggaccgggccuucaggccaaggcuacccgcgaggcccagaagagaacagcugccgggauuaugaagaacccuaccguugauggaaucguggccaucgaccuggaucccgucguguacgacgcgaaauuugaaaagcagcucggccagauuaugcugcugauccucuguacgucccagauucuucugaugcggacaaccugggcucugugcgagucuaucacacucgccaccgggccccugaccacacuuugggagggaagcccuggcaaauucuggaauacgaccauugcuguguccauggccaacaucuuccgcggcagcuaucuggccggggcuggacucgccuuuucccugaugaagucucugggcgggggaagacggggcacaggggcgcaaggagaaacccucggcgagaaguggaaacgccagcuuaaucagcugagcaaguccgaguucaacacauacaaaagaucuggcaucauggagguugaccggagcgaagccaaggaggggcugaaaagaggagagaccacgaagcacgcugucucccgcggcacagccaagcuccggugguuuguggaaagaaaucuggugaaaccggaggggaaggucauugaucuuggauguggccgcgggggauggucuuauuacugcgcuggccugaaaaagguuaccgaagugaaaggcuauaccaaagggggacccggccaugaggaaccuauccccauggccacauacggguggaaccucgugaaacugcacagcggaaaggacgucuucuuuauuccucccgagaagugugauacccugcucugcgacaucggcgaguccagcccuaauccgacaauugaagaggggcggacgcuuagagugcugaaaaugguugaacccuggcugcgcggaaaccaguucuguaucaagauucucaauccuuacaugcccucuguggucgagacccuggagcaaaugcagcggaaacauggcggcaugcuugugagaaacccucugucccgcaauagcacacacgaaauguauuggguuucuugcgggaccggaaacaucguguccgcggucaauaugacaagccggaugcuccugaacagauuuaccauggcccaccgcaagcccacguacgagcgggauguggaccugggcgcugggaccagacauguggccgucgaaccggagguugcuaaccucgauaucauuggacagcgcaucgaaaauauuaaacacgagcauaagucuacauggcacuaugacgaggauaacccuuacaagaccugggccuaucauggcuccuacgaagugaaacccagcggguccgcuagcucuauggugaauggagucgugaagcugcuuacaaaacccugggacguuaucccuauggugacccagauugccaugacagauaccacgcccuucggccaacagagagucuuuaaggagaaaguggacacacggaccccuaaggcgaagcgcggcaccgcccagaucauggaaguuacagcuaaauggcuguggggguuccucagcagaaacaagaaaccgcggaucuguacgagagaggaauuuacccggaaggugcgcuccaaugccgcuauuggagccgucuucguggacgagaaccaauggaacucugccaaagaggcgguugaagaugagagauuuugggaccuggugcaccgggaacgcgagcuucacaagcagggcaagugcgcuacaugcgucuauaacaugauggggaaaagagaaaagaaacugggagaguucggcaaggccaaagggagccgggccaucugguacauguggcucggcgcucgcuuccuggaguuugaagcccugggauucaugaaugaggaucauugguuuuccagagaaaacucucucagcggcguggagggggagggacugcacaaacuuggcuacauucugcgggacaucuccaaaauucccgggggaaauauguaugcugaugacaccgccggcugggauacacgcaucaccgaagacgaucuccagaacgaggcgaagaucacagacauuauggaaccugagcaugcccugcuugcuaagucuaucuucaaacugaccuaccagaauaaggucgugagaguucaacggcccgccaaaaacgggacggugauggaugucauuagccgcagagaccagcggggcuccggacaggugggcaccuaugggcucaauacauuuaccaacauggaagcucagcugauccgccaaauggagagcgagggaauuuucucuccuuccgaacuggagacacccaaccucgccggcagagugcuggauuggcuugaaaagcacgggguugagcggcugaaaagaauggcgaucagcggagacgacuguguggucaagccgaucgaugaccgcuuugccaccgcucucacggcccugaaugauaugggcaaggugcggaaagacauuccucagugggaacccucuaagggguggaacgauuggcagcagguuccuuucugcucccaccauuuucaccaacuuaucaugaaagacggcagagagauugugguccccugucgcaaucaggaugagcuggugggacgggcuagagucagccagggcgccggguggucccuccgcgaaacagcuugccugggaaagucuuacgcccagauguggcaacugauguauuuccaucggagagaccuccgccuggcggccaacgcuaucuguagcgccgugccuguugauugggugcccaccucccggacaaccuggagcauucacgcccaucaccaguggaugacgaccgaggacaugcuuucugucuggaauagaguguggaucgaagagaacccguggauggaagauaaaacacacauuuccagcuggggcgacguuccuuaccuggggaagcgcgaggaccaguggugcggaucucucaucggccugaccgcucgggccacaugggcgaccaauauccaaguggcuauuaaccaggucagacggcuuaucgggaaugagaacuaucuggauuacaugacaagcaugaagagauuuaaaaaugaauccgaccccgagggcgcccucugguga

SEQ ID NO: 18992 - RNA, 9879 nt, Artificial Sequence
  derived and/or modified CDS sequence (opt5) from DENV-1__GQ868605__SS-prME
agcgugaccaugcugcucaugcugaugcccacagcccuugcuuuccaccugacgaccagaggcggggagccucauaugaucgucaccaagcaggaacgggggaaaucccuccuguuuaagaccucuguuggcgugaacaugugcacacuuauugccauggaccugggggagcucugugaagauaccaugacauacaaaugcccgcgcaucaccgaggcggaacccgacgauguggacuguuggugcaaugcuacggauaccugggucacauauggaaccuguagccaaacaggcgagcacagacgggacaagcgcuccguggcccuggccccucauguugggcugggacucgagaccagaacggaaacauggaugucuagcgagggcgcuuggaaacagauucagcggguggaaaccugggcccugcgccaccccggcuucacagucaucgcucuuuuucuggcccaugcgauugggaccuccaucacccagaagggaaucauuuucauccuccugaugcuugugacaccuucuauggccaugagaugcguuggcauugggagccgggauuuuguggagggacuguccggcgcuacgugggucgacguggugcucgagcacgggagcugugucaccacaauggccaaggauaaacccacccuggacaucgaacugcucaagacagagguuaccaacccugcugugcugcgcaaacuuugcauugaagccaagaucucuaauacgacaaccgauuccagauguccgacccaaggagaggcgacacugauggaagaacaagacgccaacuucgugugccggcgcaccuuugucgauagaggcuggggcaauggguguggacucuucggcaaagggagccugauuacaugcgcuaaguuuaagugcgugacgaaacuugagggaaagaucguucaguacgaaaaccugaaauauucugugaucgucaccgugcacacaggcgaccagcaucaaguugggaaugaguccaccgaacacggaacaaccgccacgauuacaccccaggcuccuacaagcgagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggccuccaccucucaagagacauggaaucgccaggaccugcucgugaccuucaaaaccgcucacgcgaagaagcaggaagucgugguucugggaagccaagagggcgccaugcacacagcucugacgggggccaccgaaauucagacauccggaaccacaaccaucuuugccggccaucucaaaugcagacugaagauggauaaacuuacgcugaaggggaugagcuaugugauguguacaggcucuuucaaacucgagaaggaagucgcugagacccagcacggaaccgugcugguucagauuaaguacgagggcacagacgccccgugcaaaaucccuuucuccacccaagaugaaaagggggugacacagaacggacggcugaucacggcgaaucccauugucaccgacaaagagaagccugugaacaucgaagcugagccgcccuuuggcgagagcuauauugugaucgggguuggagaaaaagcccuuaagcucucuugguucaagaaaggcagcuccauugggaagauguuugaggccacagcuagaggcgcccgccggauggcuauccugggagauaccgccugggacuucggcucuaucgggggagucuuuacaagcgugggcaaacuggugcaucagauuuucgggaccgcguacggaguccucuuuuccggcgugagcuggacgaugaagaucgggauuggcguucugcuuaccuggcugggacucaauucuagauccacaagccugucuaugaccuguaucgccgugggccuggucacacuuuaccucggggugaugguucaggcugauuccggaugcgugauuaacuggaaaggccgcgaacugaagugugggagcggaaucuucgucaccaaugaggugcacacauggaccgaacaauauaaguuucaggccgacuccccuaaacggcugucugcugccauuggcaaggcgugggaggaggggguuugcggcaucagaagcgccacgcgccucgaaaacaucauguggaaacagauuuccaacgagcugaaucauauccuucuggaaaacgacaugaaguucacaguggucgugggagauguggucggcauucucgcucaggggaaaaagaugauccggccgcaacccauggagcacaaauacucuuggaaaagcuggggaaaggccaagauuaucggcgcugacguucagaauaccaccuuuaucauugaugggccuaacacacccgaauguccugacgaucagagagccuggaauaucugggagguggaggacuauggauucggcauuuuuaccacgaacaucuggcugaagcugcgcgauuccuacacacaggugugcgaccaccggcuuaugagcgccgcuauuaaagauucuaaggcgguccaugccgacaugggcuauuggaucgaauccgagaaaaaugauaccuggaagcucgcuagagccagcuucaucgaagugaagacauguauuuggcccaaaucucacacccugugguccaacgggguucuggagagcgaaaugaucauuccgaagaucuacggaggcccuauuucucaacauaauuaucgccccggguacuucacacagaccgccggaccuuggcaccucggcaaacuggagcuugacuuugaucugugcgaggggacgaccguggucguggacgaacacugcggaaaccggggccccagccucagaacaaccacaguuaccggcaagaucauccaugagugguguugccgguccuguacgcugccuccccugcgcuucaaaggggaagacggaugcugguacggcauggagauuagaccggugaaggagaaggaagagaaucuugucaaaagcauggugucugcuggguccggagaaguugauagcuuuucccucggccugcugucuaucagcauuaugaucgaggaagugaugcgguccagauggucucgcaagaugcucaugacagggacccuggccgucuuccuucugcucauugugggacagcugacauggaacgaccugauccggcuuuguauuauggugggcgcgaaugcuagcgauagaaugggcauggggaccaccuaucuggcccucauggccacauuuaaaaugcgcccuauguucgcugucggacugcucuuuagacggcugacgucccgcgagguucuucugcucaccaucggccugucucugguggccagcguggagcuucccaacucccuggaagaacucggggacggacuggcgaugggcaucaugauucucaagcugcuuacagauuuccaaagccaccagcugugggcuacccuccugucucugacauuuaucaaaaccgcccuuucccugcauuacgccuggaagacgauggcuaugguccucagcauugugucucuguucccccucugccuguccacaaccagccagaagaccacauggcuuccuguucugcuggggucucucggauguaaaccgcugaccauguuucuuaucgccgaaaauaagauuuggggcagaaaauccuggccccugaacgagggcaucauggcugugggggucgugagcauccuccuguccagccuccugaagaacgacguuccucuugccggaccccugauugcgggcgggaugcugaucgccugcuaugugauuucuggaagcuccgcugaucucucucuggaaaaagccgcugaggucagcugggaggaagaggccgaacacuccggcgccucucauaauauccuuguggagguccaggacgaugggacaaugaagauuaaagacgaagaacgggaugacacgcugaccauccuccugaaggcuacacuccuggcggugagcggaguuuacccucuuuccauccccgccacccuguucgugugguauuuuuggcaaaagaaaaagcagcgcucuggcguccugugggauacaccuagcccucccgagguggaaagagcuguucucgacgacggcauuuaccggaucaugcagcgcgggcugcuuggaagaucccaggugggcgucgggguguuccaagagaacguguuccacaccauguggcacguuacgcggggagccguccugauguaucagggcaaacgccucgaacccagcugggccucugugaagaaagaucugauuuccuacgggggaggcuggagacuccagggcagcuggaauaccggggaggaggugcaggucaucgcuguggaacccggaaagaacccuaagaauguucaaacagcccccggcaccuuuaaaacaccggagggggaagugggagcgauugcucuggacuucaagccuggcaccucugggucccccaucgucaaccgggagggaaaaauugugggccuuuacggcaaugggguugugacaacgagcggaaccuaugucuccgccaucgcccaggcuaaggccucucaggaaggcccucugcccgagaucgaggaugaaguguuuagaaaacgcaaccugacaauuauggaccuccaucccgggagcggaaagacccggagauaccugccugcgaucguucgcgaggcuauuaagcggaaacuuagaacccugauccucgccccgacacgcguggucgccuccgaaauggcugaggcccugaagggcaugcccauucgguaucaaacgaccgcugugaaaagcgaacacacagggaaggagaucguggaucugaugugucaugccaccuucacaaugagacuccuuucuccuguccgcguucccaauuacaacaugaucauuauggacgaggcgcacuuuaccgauccuuccagcaucgccgcucggggcuauauuucuacgagagugggaaugggcgaagccgcugccaucuucaugacagccacacccccugggagcguggaggcuuuuccgcaguccaaugcggucauucaggacgaagaacgggauauccccgaacgcucuuggaacagcggauacgaguggaucaccgacuucccuggcaaaacagugugguuuguucccuccauuaagucugggaaugauaucgccaacugccugagaaagaauggaaaacgggugauucagcugagccgcaagaccuucgagacagaauaucagaagaccaagaacaacgacugggacuacgucgugacgacagauaucuccgagaugggcgcuaauuuuagagccgaccggguuauugauccuagacgcugucucaaacccgugauccugaaggacgggagcgaacgggucauucuugccggcccgaugccugugaccgucgcuucugccgcgcagagacgcggacggaucggcagaaaccauaauaaggagggggaucaguacaucuauaugggacagccccugaacaaugacgaggaucacgcucacuggacagaagccaaaaugcuccuggacaacauuaauacccccgagggcaucauuccugcccuguucgaacccgagcgcgaaaaguccgcugccaucgauggggaguaccggcucagaggagaggcgcgcaaaacguucguggaacuuaugagacggggcgaccugccuguuuggcugagcuauaagguggccuccgagggguuucaauacucugaucgcagauggugcuucgacggcgaacggaacaaucaggugcucgaggaaaacauggaugucgagauuuggaccaaagagggagaacgcaagaaacugagaccgcgguggcuugacgcuagaacauauagcgacccccuggcccuccgcgaguuuaaggaguucgcugccggccggagauccguuucuggggaucugaucaucgagauuggaaagcugccucagcaucucacccagaaagcucaaaaugcccuugacaaccuggugaugcugcacaauagcgaacagggcgggcgcgcguaccggcaugccauggaggagcuccccgauacaaucgaaacccugaugcuucuggcucucauugccgugcugacaggaggcgucacccuguuuuuccucuccggcagagggcuuggaaagacgagcaucggccugcugugcgugauggcuucuuccguucuccuguggauggccagcguggagccucacuggauugccgcuucuaucauccuugaauuuuuccugaugguccuccugauucccgagccggaccggcagcgcacaccucaggauaaccaacuggcguauguggucaucgggcuccuuuuuaugauucugaccguggccgcuaaugagaugggacugcucgaaaccaccaaaaaggaccugggcaucgggcacguugccguggagaaccaucaccaugccaccaugcuugaugucgaccugcaccccgcuuccgccuggacacucuacgcgguggccacgaccauuaucacaccuaugaugagacauaccauugaaaacacaaccgcuaauaucagccugacggccaucgcuaaccaggccgcgauucugaugggacucgauaaaggcuggcccaucucuaagauggacauuggcguuccucuucuggcccugggguguuacagccaggugaauccccucacccugacagcugccguccuuaugcugguggcucacuaugccaucauuggaccgggccuccaagcuaaggccacccgggaggcgcagaaacgcacagccgcugggaucaugaagaacccuaccguggauggaaucguugccauugaccuggaucccgucguguacgacgcuaaauucgaaaagcagcugggccagaucaugcuccuuauucugugcacgucccaaauccugcucaugagaacaaccugggcccugugugagucuauuacacuugccaccgggccccugaccacacucugggagggaagcccuggcaaauuuuggaauacgaccaucgcgguguccauggcuaacaucuuccggggcagcuaucuggccggggcuggacuggccuuuucccucaugaagucucuuggcgggggacgcagaggcacaggggcccagggagaaacccugggcgagaaguggaaacggcagcugaaucagcucagcaaguccgaguucaacauuuacaaacgcucuggcaucauggaggucgacagaagcgaagcuaaggaggggcugaaacggggagagacaaccagacacgccguuucccgcggcacggcgaaacuucggugguucguggaaagaaaucuggugaagccggaggggaaagucauugaucucggaugcggccgcgggggauggucuuauuacugugccggccugaagaaagugacagaaguuaagggcuauaccaaagggggacccggccaugaggaaccuauccccauggcuaccuacggguggaaccuggugaagcuccacagcggaaaagacgucuuuuucacaccucccgagaagugcgauacccuucugugugacauuggcgaguccagcccuaauccgacaaucgaagaggggcggacgcugagagugcucaagaugguugaacccuggcugcgcggaaaccaauuuugcauuaaaauccuuaauccuuacaugcccucuguggucgagacccuggagcagaugcagcggaagcauggcggcaugcucgugagaaacccucugucccgcaauagcacacacgaaauguauugggugucuugugggaccggaaacaucgucuccgccguuaauaugacaagccggaugcugcucaacagauucaccauggcucaccgcaaacccacguacgagcgggauguggaccugggcgccgggaccagacauguggcggucgaaccggagguggccaaccuugauauuaucggacagcgcauugaaaauaucaagcacgagcauaaaucuacauggcacuaugacgaggauaacccuuacaagaccugggcuuaucauggcuccuacgaaguuaagcccagcggguccgccagcucuauggugaauggagucgugaaacugcucacaaagcccugggacguuauuccuauggugacccaaaucgcuaugacagauaccacgcccuuuggccagcagagagucuucaaagagaagguggacacacggaccccuaaagccaagcgcggcaccgcucaaaucauggaaguuacagccagauggcuguggagcuuucuuucccggaacaagaaaccgagaauuugcacgcgggaggaguucacccgcaaggugagaucuaaugcggccaucggggcugucuuuguggacgagaaccaguggaauagcgccaaagaggcugucgaagaugagcgguucugggaccuggugcagaaggaacgcgagcuccacaaacagggaaagugugccacaugcguuuauaacaugaugggcaagagagagaaaaagcugggggaguuuggaaaagccaagggcucccgggcgauuugguacauguggcugggggcucgcuuccucgaguuugaagcccugggcuucaugaaugaggaucacugguucucuagagaaaacagccuuuccggaguggagggcgaggggcugcauaaacucggauacauccugcgggacauuucuaagauccccggcgggaauauguaugccgaugacaccgcuggaugggauacacgcaucaccgaagacgaucuucaaaacgaggccaaaauuacagacaucauggaaccugagcacgcucugcucgccaccagcauuuuuaagcugacguaccagaauaaggucgugagagugcagcggcccgcgaaaaacggcaccguuauggaugugaucucccgcagagaccagcgggggagcggccaagucggaacauauggccugaauaccuucacaaacauggaagcccagcucauucgccagauggagucugaggggaucuuucugccuuccgaacuugagacccccaaccuggcugaaagagugcucgauuggcuggagaagcauggaguugaacggcuuaaaagaauggccaucagcggcgacgacugcguggucaagccgauugaugaccgcuucgcuacggcccugacagcgcucaaugauauggggaaagugcggaaggacaucccucagugggagcccucuaagggauggaacgauuggcaacaggucccuuuuuguucccaccacuuccaucagcugauuaugaaagacggcagagagaucgugguucccugccgcaaucaggaugaacugguggggcgggccagagucagccaaggcgcuggauggucccuccgcgagaccgccugucugggcaagucuuacgcucagauguggcagcuuauguauuuucaccggagagaccugcgccucgccgcuaacgccauuugcagcgcggugccuguugauugggugcccacaucccggaccacguggagcauccaugcccaccaucaauggaugaccacagaagacaugcugucugucuggaauagaguguggauugaggaaaacccguggauggaggauaaaacccacguguccagcuggggagacguuccuuaccuuggaaagcgcgaggaccagugguguggcucucugaucgggcucacagcucgggccaccugggccagcaauauccaggucgcuauuaaccaggugagacggcugaucggaaaugaaaacuaucuggauuacaugacauccaugaaaagauucaagaaugagggcgaccccgaaggggcccucugguga

SEQ ID NO: 18993 - RNA, 9879 nt, Artificial Sequence
  derived and/or modified CDS sequence (opt5) from DENV-1__FJ882534__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagagcaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaccgcaagagggcgcuaugcacacagcccugacgggggccaccgaaauucagacaagcggaaccacaaccaucuuugcuggccaucucaaaugcagacugaagauggauaaacuuacgcugaaggggauguccuaugugauguguacaggcagcuucaaacucgagaaggaagucgccgagacccagcacggaaccgugcugguucagauuaaguacgagggcacagacgcgccuugcaaaauccccuucucuacccaagaugaaaagggggugacacagaacggacggcugaucacggcuaauccuauugucaccgacaaagagaagcccgugaacaucgaagccgagcccccuuuuggcgaguccuauauugugaucggggccggagaaaaagcucuuaagcucagcugguucaagaaaggcucuagcauugggaagauguuugaggccacagcuagaggcgcccgccggauggcgauccugggagauaccgccugggacuucggcuccaucgggggaguuuuuacaucugucggcaaacuggugcaucagauuuucgggaccgcuuacggagugcucuuuagcggcgucuccuggacgaugaagaucgggauuggcgugcugcuuaccuggcugggacucaauagcagaucuacaucccugagcaugaccuguaucgccguuggccuggugacacuuuaccucggggucauggugcaggcugauucuggaugcguuauuaacuggaaaggccgcgaacugaaguguggguccggaaucuucgugaccaaugagguccacacauggaccgaacaauauaaguuucaggccgacagcccgaaacggcuguccgcggccauuggcaaggcuugggaggagggggugugcggcaucagaucugccacgcgccucgaaaacaucauguggaaacagauuagcaacgagcugaaucauauccuucuggaaaacgacaugaagcucacaguuguggucggagauguggcuggcauucuggggcagggaaaaaagaugauccggccccaaccuauggaguacaaauauuccuggaagucuuggggcaaggccaaaauuaucggggccgacgcucagaauaccaccuucaucauugauggacccaacacaccugaaugucccgacgaucagagagcguggaauaucugggagguggaggacuacggcuuuggcauuuucaccacgaacaucuggcugaagcuucgcgauagcuauacacaggucugcgaccaccggcucauguccgccgcuauuaaagauagcaaggccguucacgccgacaugggguacuggaucgaaucugagaaaaaugaaaccuggaagcuggcuagagccuccuuuaucgaggugaagacauguauuuggccgaaaagccauacccuguggucuaacggagugcucgaauccgagaugaucauuccuaagaucuauggcgggcccauuagccaacacaauuaccgcccuggauacuucacacagaccgcgggccccuggcaucuggggaaacuugagcuggauuucgaccucugcgaaggaacgaccgucgugguugaugagcacugcggcaaccggggcccuucucugagaacaaccacagugaccgggaagaucauccacgaaugguguugccggagcuguacgcugcccccgcuucgcuuuagaggagaggacggcugcugguaugggauggagauucggccugucaaagaaaaggaggaaaaucucgugaaguccaugguuagcgcuggaucuggcgagguggacuccuucagccuggggcugcucuguaucuccauuaugaucgaagaggucaugagaucucgcuggagccggaaaaugcugaugacaggaacccuugccguguuuuuccugcucauuaugggccagcugacauggaacgaucugaucagacuuugcauuaugguuggcgccaaugcuuccgaccgcauggggaugggaaccaccuaccuggcccucauggcgacauuuaagaugagacccauguucgcugugggccugcucuuucggcgccugacgucuagagagguccuucugcucaccaucgggcugagccugguggccuccguggaacuucccaacucucuggaggaacucggagauggccuggccauggggaucaugauucucaaacugcuuacagacuuccaaagccaucagcugugggcuacccuccugucccugacauuuaucaagaccacguucagccuucacuaugccuggaaaacaauggcuaugguccugucuauuguuucccucuuuccucugugucucagcaccaccucucagaagacaaccuggcugccggugcuucugggaucccugggcugcaagccccucacaauguuccugaucguggagaauaaaauuuggggccggaagagcuggccucuuaacgaagggaucauggccgucggaaucgugucuauucugcucuccagccugcucaaaaacgauguuccccuggcgggcccucuuaucgccgggggaaugcugauugcuuguuacgugaucuccggcagcucugccgaccugagccucgagaaggcugccgaggucuccugggaagaggaagccgagcauucuggggcuagccacaauauucugguggaaguucaggaugacggaacgaugaaaaucaaggaugaggagcgcgacgauacccuuacaauccugcucaaagcgacccugcucgccguguccggcgucuauccccugucuauuccugcuacacuuuuugugugguacuucuggcaaaagaagaaacagagaagcggcguccugugggacacccccuccccgccugaaguggagcgggccguucuggaugacgggaucuaucgcauuaugcagagaggacuccugggccggucucaggugggggucggaguguuccaagaaaacguuuuucauacgauguggcacgugacccgcggcgccguccuuauguaccaggggaagagacuggagcccagcugggcuuccgugaaaaaggaccucaucagcuacggaggcggcuggcggcugagagggucuuggaauacaggagaggaagugcagguuauugccgucgagccuggcaaaaaccccaagaaugugcagaccgcgccggggacauucaagaccccugaaggagaggugggcgcuaucgcccucgauuuuaaacccgggacauccggaagcccuauugucaaccgcgaaggcaagaucgugggccuguaugggaauggaguugugacgaccucuggcacauacgucuccgccaucgcucaagccaaagcgagccaggaggggccccuucccgagauugaagacgagguguuccggaagagaaaccugaccaucauggaucugcacccuggauccggcaaaacccgccgguaucucccggcuauuguuagagaagccaucaagcgcaagcugcggacacuuauucuggcccccacgagaguggucgcuucugagauggccgaagcucucaaagggaugccuauccgcuaccagaccacagccgugaagagcgagcauaccggcaaagagaucguugaccugaugugccacgcgacauuuaccaugcggcugcucucccccgugagagucccuaauuauaacaugauuaucauggaugaagcccauuucacggaccccagcucuauugcugcccggggauacaucuccacacgcgugggcaugggggaggcugccgccauuuuuaugaccgcuaccccuccgggaagcguggaagcguucccccaaucuaaugccgucauccaggaugaggaaagagacaucccugagcggagcuggaacuccggcuaugaguggauuacagauuuucccgggaagaccguuugguucgugccuucuaucaaaagcggaaaugacauugcuaacugucuucgcaagaauggcaagagagugauccagcugucccggaaaacauuugauaccgaauaccagaagacgaaaaacaacgacugggacuacgucgugacaaccgauauuucugagaugggggccaauuucagagccgaccgcguuaucgauccccggagaugccugaagccggugauucucaaagacggcccugaacgcgucauccuggcuggacccaugcccgugacaguugccagcgcggcucaacggagaggccgcaucgggcggaaccacaauaaggagggagaucaguauauuuacaugggccagccucuuaacaaugacgaggaucaugcccacuggaccgaagccaagaugcugcucgacaacaucaauacgcccgaggggauuaucccugcucuguucgaaccggagagagaaaaauccgccgcgguggauggagaguaucgccugagaggcgaggcccggaagaccuuugucgaacucaugcgcagaggggaccuucccguguggcugagcuacaaagucgcuucugagggcuuccaguauuccgaucggcgcuggugcuuugacggagaaagaaacaaucaagugcuggaggaaaacauggauguugagauuuggacaaaggagggcgaacggaaaaagcucagaccucgcuggcuggacgcccggaccuacagcgacccccuugcucugagagaguucaaagaauuugccgcugggcgccgguccgugucuggagaucucauccuggagaucggcaagcugccucagcaccucacacagagagcccagaaugcgcuugacaaccuggugaugcugcauaauagcgaacaagggggacgggccuaucgccacgcuauggaggagcuccccgauaccauugaaacacugaugcuucuggcccucaucgcuguccugaccggcggcguuacgcuguucuuucucuccgggagaggacuuggcaagacaucuauugggcugcugugugugauggccagcuccgugcuccuguggauggccagcgucgagccgcauuggaucgcugcgucuauuauccuugaauucuuucugauggugcuccugaucccugagcccgaccggcagcgcaccccucaggauaaccagcuggccuacguugugauuggacuccuuuucaugauccugaccgucgcugccaaugagaugggccugcucgaaacaaccaaaaaggaccuggggauuggacacguggccgucgagaaccaccaucacgcugccaugcuugauguggaccugcaucccgcguccgccuggacacucuacgcuguugccacgaccaucauuacaccuaugaugagacacaccaucgaaaacacaaccgcuaauauuagccugacggccaucgcgaaccaagccgcuauccugaugggccucgauaaaggcuggcccauuucuaagauggacaucggggugccgcuucuggcccugggaugcuauucccaggucaauccucucacccugacagcugccgugcuuaugcugguugcucauuacgccauuaucggccccgggcuccaggcgaaagccacccgggaggcucaaaagcgcacagccgcuggaauuaugaagaaccccaccguggauggcaucgucgccaucgaccuggauccugugguguaugacgccaaauuugaaaagcagcuggggcagauuaugcuccuuauccuguguacgagccagauucugcucaugagaacaaccugggcgcugugcgagucuaucacacuugcuaccggaccgcugaccacacucugggagggcagccccggcaaauucuggaauacgaccauugccguuuccauggcuaacaucuuucgggggucuuaccuggccggagccggccuggcuuucagccucaugaagucccuugggggaggccgcagagggacaggagcccaaggcgaaacccugggcgagaaauggaagcggcagcugaaucagcucagcaaguccgaauucaacacauauaaaagaucugggaucauggaggucgaccgcagcgaagcgaaggagggacugaaacggggcgagaccacgaagcacgccguguccagagggacagcuaaacuucgcugguuuguggaacggaaucuggucaagccugagggaaagguuauugaucucggcugugggagaggaggcuggucuuacuauugcgccggccugaaaaaggugaccgaagugaaaggguacaccaagggaggccccgggcacgaggaaccuauccccauggcuacauacggauggaaccuggucaaacuccauagcggcaaggacguguucuuuauuccuccggagaaaugugauacccuucugugcgacaucggggaguccucucccaauccuacaauugaagagggacgcacgcugcggguucucaagaugguggaacccuggcugagaggcaaccaguucuguaucaagauucuuaauccuuauaugcccagcgucguggagacccuggagcaaaugcagcgcaaacacggcgggaugcucguucggaacccgcuguccagaaauagcacacaugaaauguacugggugucuugcggaaccggcaacaucgucuccgccgugaauaugacaagccgcaugcugcucaaccgguuuaccauggcgcacagaaagccuacguaugagcgcgauguggaccuggggaccggaacaagacacgucgccguugaacccgagguggcuaaccuugauaucauuggccagcggaucgaaaauauuaaacaugagcacaagucuaccuggcauuacgacgaggauaaccccuauaaaacaugggccuaccacggguccuaugaagugaagccuagcggaucugcuuccagcauggucaauggcgugguuaagcugcucaccaaacccugggacgugaucccuauggucacacagauugccaugaccgauacgacaccguucggccaacagcgcguguuuaaggagaaaguugacaccagaacccccaaggcuaaacgggggacagcccagaucauggaagugacggcgagauggcuguggggauuccuuucccggaacaagaagccucgcaucuguaccagagaggaauuuacacggaaaguccgcagcaaugccgcuauuggcgccguguucguugacgagaaccaauggaauucugcuaaggaggccguggaagaugagagauuuugggaccugguccaucgggaacgcgagcuccacaaacaggggaagugcgccaccugcguguacaacaugaugggaaaaagagaaaagaagcugggcgaguucgggaaagcgaagggcagccgggcuaucugguacauguggcugggagcccgcuuucucgaguucgaagcccugggcuucaugaaugaggaucacugguuuuccagagaaaacucucuuagcggggucgagggagagggccugcauaaacucggguauauucugcgggacaucuccaagauucccggaggcaauauguacgcugaugacacagccgggugggauacccgcaucacagaagacgaucuucagaacgaggcuaaaaucaccgacauuauggaaccugagcacgcccugcucgcgaaggccaucuucaaacugacguaucagaauaaggugguuagagugcaacggcccgcuaagaacggcaccgucauggaugugauuucucgcagagaccagcggggaagcggccagguggggacauacggacugaauaccuuuacaaacauggaagcccagcucaucagacaaauggaguccgagggcauuuucucuccgagcgaacuggagaccccuaaccuugcugaacgcgcccuggauuggcucgagaaauaugggguugaacggcugaagagaauggcgaucuccggagacgacuguguggucaaacccaucgaugaccgcuuugccacggcucuuacagcccugaaugauaugggcaaggugcggaaagacauuccucagugggagcccagcaagggguggaacgauuggcagcagguuccuuucugcucucaucacuuucaccaacucaucaugaaggacggcagagagauugugguccccugucgcaaucaggaugaacuggugggacgggcuagagucucccagggcgccggguggagccugcgcgagaccgcuugccucggaaaaucuuacgcccagauguggcaacugauguauuuccaucggagagaccuucgccuggcggccaacgcuaucuguuccgccgugccgguugauugggugccuacaagccggaccacgugguccauucacgcccaucaccaguggaugaccacagaagacaugcucucugucuggaauagaguguggaucgaggaaaaccccuggauggaggauaagacccauauuagcuccugggaggacguucccuaccugggcaaacgggaagaccaguggugcgggagccuuaucggacugacagcuagagccaccugggcgacaaauauccaaguggcuauuaaccagguccgccggcucaucggcaaugagaacuaccuggauuauaugaccucuaugaagagauuuaaaaaugaauccgacccugagggggcccugugguga

SEQ ID NO: 18994 - RNA, 9879 nt, Artificial Sequence
  derived and/or modified CDS sequence (opt5) from DENV-1__FJ882536__SS-prME
agcgugaccaugcugcucaugcugaugcccaccgcccuugcuuuccaccugacgaccagaggaggggaaccucauaugaucguguccaagcaggaacggggaaaaucucuccuguuuaagaccagcgccggcguuaacaugugcacccuuauugcgauggaccugggggaacucugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaagcucacaguuguggucggagauguggcuggcauucuggggcagggcaagaaaaugauccggccgcaacccauggaguacaaauauucuuggaaaagcuggggcaaggccaagauuaucggggccgacgcucagaauaccaccuucaucauugauggaccuaacacacccgaauguccugacgaucagagagcguggaauaucugggagguggaggacuacggcuuuggcauuuucaccacgaacaucuggcugaaacuucgcgauuccuauacacaggucugcgaccaccggcucaugagcgccgcuauuaaagauucuaaggccguucacgccgacaugggguacuggaucgaauccgagaaaaaugaaaccuggaagcuggcuagagccagcuuuaucgaggugaagacauguauuuggcccaaaucucauacccugugguccaacggagugcucgaaagcgagaugaucauuccgaagaucuauggcgggccuauuucucaacacaauuaccgccccggauacuucacacagaccgcgggcccuuggcaucuggggaaacuugagcuggauuucgaccucugcgaaggaacgaccgucgugguugaugagcacugcggcaaccggggccccagccugagaacaaccacagugaccgggaagaucauccacgaaugguguugccgguccuguacgcugccuccccuucgcuuuagaggagaggacggcugcugguaugggauggagauucggccggucaaagaaaaggaggaaaaucucgucaagagcaugguuucugcuggauccggcgagguggacagcuucucccuggggcugcucuguaucucuauuaugaucgaagaggucaugagaagccgcuggucccggaaaaugcugaugacaggaacccuugccguguuuuuccugcucauuaugggccagcugacauggaacgaucugaucagacuuugcauuaugguuggcgccaaugcuucugaccgcauggggaugggaaccaccuaccuggcccucauggcgacauuuaagaugagaccuauguucgcugugggccugcucuuucggcgccugacgagcagagagguccuucugcucaccaucgggcugucccugguggccucuguggaacuucccaacagccuggaggaacucggagauggccuggccauggggaucaugauucucaaacugcuuacagacuuccaaucccaucagcugugggcuacccuccugagccugacauuuaucaagaccacguucucucuucacuaugccuggaaaacaauggcuaugguccuguccauuguuagccucuuuccccugugucucucuaccaccucccagaagacaaccuggcugccugugcuucugggaagccugggcugcaagccgcucacaauguuccugaucgccgagaauaaaauuuggggccggaagucuuggccccuuaacgaagggaucauggcggugggaaucgucuccauucugcucagcucccugcucaaaaacgaugugccucuggccggcccccuuaucgcugggggaaugcugauugccuguuacguuaucagcggcucuagcgcugaccugucccucgagaaggccgccgaggugucuugggaagaggaagcugagcauagcggggcgucccacaauauucuggucgaagugcaggaugacggaacgaugaaaaucaaggaugaggagcgcgacgauacccuuacaauccugcucaaagccacccugcucgcuguuucuggcguguauccucugagcauucccgccacacuuuuugucugguacuucuggcaaaagaagaaacagagauccggcgugcugugggacaccccuucucccccggaagucgagcgggccgugcuggaugacgggaucuaucgcauuaugcagagaggacuccugggccggagccagguuggggugggagucuuccaagaaaacguguuucauacgauguggcacguuacccgcggcgcugugcuuauguaccaggggaagagacuggagccuuccugggccagcgucaaaaaggaccucaucucuuacggaggcggcuggcggcugagaggguccuggaauacaggagaggaaguccaggugauugcgguugagcccggcaaaaacccuaagaauguccagaccgcucccgggacauucaagaccccggaaggagaggugggcgccaucgcccucgauuuuaaaccugggacaagcggaucucccauugugaaccgcgaaggcaagaucgucggccuguaugggaauggagugguuacgaccuccggcacauacgugagcgcuaucgcccaagcgaaggcuucccaggaggggccucuucccgagauugaagacgaggucuuccggaagagaaaccugaccaucauggaucugcaccccggaucuggcaaaacccgccgguaucucccugccauugugagagaagccaucaagcgcaagcugcggacacuuauucuggcuccgacgagaguuguggccagcgagauggcugaagcccucaaagggaugcccauccgcuaccagaccacagcggucaaguccgagcauaccggcaaagagaucguggaccugaugugccacgccacauuuaccaugcggcugcucagcccuguuagagugcccaauuauaacaugauuaucauggaugaagcucauuucacggacccuucuuccauugccgcucggggauacaucagcacacgcgucggcaugggggaggccgccgcuauuuuuaugaccgcgacacccccuggaucuguggaagccuucccgcaaagcaaugcugugauccaggaugaggaaagagacauccccgagcgguccuggaacucuggcuaugaguggauuacagauuuuccugggaagaccgucugguucguucccagcaucaaauccggaaaugacauugccaacugucuucgcaagaauggcaagagagugauccagcugucucggaaaacauuugauaccgaauaccagaagacgaaaaacaacgacugggacuacguggucacaaccgauauuagcgagaugggggccaauuucagagcugaccgcgugaucgauccucggagaugccugaagcccguuauucucaaagacggcccggaacgcgugauccuggccggaccuaugcccgucacaguggcguccgcugcccaacggagaggccgcaucgggcggaaccacaauaaggagggagaucaguauauuuacaugggccagccccuuaacaaugacgaggaucaugcccacuggaccgaagcuaagaugcugcucgacaacaucaauacgccugaggggauuauccccgcccuguucgaaccugagagagaaaagagcgcggccguugauggagaguaucgccugagaggcgaggcucggaagaccuuuguggagcucaugcgcagaggggaccuuccggucuggcugucuuacaaaguggccuccgagggcuuccaguauagcgaucggcgcuggugcuuugacggagaaagaaacaaucaaguccuggaggaaaacauggauguggagauuuggacaaaggagggcgaacggaaaaagcucagaccccgcuggcuggacgcucggaccuacuccgacccucuugcccugagagaguucaaagaauuugcugccgggcgccggucuguuagcggagaucucauccuggagaucggcaagcugccccagcaccucacacagagagcgcagaaugcccuugacaaccuggugaugcugcauaauuccgaacaagggggacgggcuuaucgccacgccauggaggagcucccugauaccauugaaacacugaugcuucuggcucucaucgccgugcugaccggcggcgucacgcuguucuuucucucugggagaggacuuggcaagacaagcauugggcugcuguguguuauggccuccagcgugcuccuguggauggcuucuguggagccccauuggaucgcggccuccauuauccuugaguucuuucugaugguccuccugaucccggagccugaccggcagcgcacaccccaggauaaccagcuggcuuacgugguuauuggacuccuuuucaugauccugaccguggccgccaaugagaugggccugcucgaaacaaccaaaaaggaccuggggauuggacacgucgcuguggagaaccaccaucacgccgcgaugcuugaugucgaccugcauccugccagcgcuuggacacucuacgccguggcuacgaccaucauuacacccaugaugagacacaccaucgaaaacacaaccgccaauauuucucugacggcgaucgccaaccaagcugccauccugaugggccucgauaaaggcuggccuauuuccaagauggacaucgggguuccccuucuggcucugggaugcuauagccaggugaauccgcucacccugacagccgcuguccuuaugcugguggcccauuacgcgauuaucggcccugggcuccaggccaaagcuacccgggaggcccaaaagcgcacagcugccggaauuaugaagaaccccaccguugauggcaucguggccaucgaccuggaucccgucguguaugacgcgaaauuugaaaagcagcuggggcagauuaugcuccuuauccuguguacgucucagauucugcucaugagaacaaccugggcucugugcgagagcaucacacuugccaccggaccucugaccacacucugggagggcuccccgggcaaauucuggaauacgaccauugcugugucuauggccaacaucuuucgggggagcuaccuggccggagcuggccuggccuucucccucaugaaaagccuugggggaggccgcagagggacaggagcgcaaggcgaaacccugggcgagaaauggaagcggcagcugaaucagcucuccaagucugaguucaacacauauaaaagaagcgggaucauggagguugaccgcuccgaagccaaggagggacugaaacggggcgagaccacgaagcacgcugucucuagagggacagccaaacuucgcugguuuguggaacggaaucuggugaagcccgagggaaaggucauugaucucggcugugggagaggaggcuggagcuacuauugcgcuggccugaaaaagguuaccgaagugaaaggguacaccaagggaggcccugggcacgaggaacccaucccuauggccacauacggauggaaccuggugaaacuccauuccggcaaggacgucuucuuuauucccccugagaaaugugauacccuucugugcgacaucggggagucuagcccgaaucccacaauugaagagggacgcacgcugcgggugcucaagaugguugaaccuuggcugagaggcaaccaguucuguaucaagauucuuaaucccuauaugccuuccguggucgagacccuggagcaaaugcagcgcaaacacggcgggaugcucgugcggaacccccugagcagaaauucuacacaugaaauguacuggguuuccugcggaaccggcaacaucgugagcgcggucaauaugacaucucgcaugcugcucaaccgguuuaccauggcccacagaaagccgacguaugagcgcgauguggaccuggggaccggaacaagacacguggcugucgaaccugagguugccaaccuugauaucauuggccagcggaucgaaaauauuaaacaugagcacaaguccaccuggcauuacgacgaggauaaccccuauaaaacaugggcuuaccacgggagcuaugaagugaagcccucuggauccgccagcuccauggugaauggcgucgugaagcugcucaccaaaccuugggacguuauccccauggugacacagauugcuaugaccgauacgacaccuuucggccaacagcgcgucuuuaaggagaaaguggacaccagaaccccgaaggccaaacgggggacagcgcagaucauggaaguuacggccagauggcuguggggauuccuuagccggaacaagaagccccgcaucuguaccagagaggaauuuacacggaaagugcgcucuaaugcugccauuggcgcugucuucguggacgagaaccaauggaauagcgccaaggaggccguugaagaugagagauuuugggaccuggugcaucgggaacgcgagcuccacaaacaggggaagugcgcgaccugcgucuacaacaugaugggaaaaagagaaaagaagcugggcgaguucgggaaagcuaagggcucccgggccaucugguacauguggcugggagcccgcuuucucgaguucgaagcucugggcuucaugaaugaggaucacugguuuucuagagaaaacagccuuuccgggguggagggagagggccugcauaaacucggguauauucugcgggacaucucuaagauuccuggaggcaauauguacgccgaugacacagcugggugggauacccgcaucacagaagacgaucuucagaacgaggccaaaaucaccgacauuauggaacccgagcacgcgcugcucgccaaggcuaucuucaaacugacguaucagaauaaggucgugagaguucaacggccugccaagaacggcaccgugauggaugucauuagccgcagagaccagcggggauccggccagguggggacauacggacugaauaccuuuacaaacauggaagcucagcucaucagacaaauggagucugagggcauuuucagccccuccgaacuggagaccccgaaccuugccgaacgcgcgcuggauuggcucgagaaauaugggguggaacggcugaagagaauggccaucagcggagacgacuguguugugaaaccuaucgaugaccgcuuugcuacggcccuuacagcucugaaugauaugggcaagguccggaaagacauuccccagugggagccuucuaagggguggaacgauuggcaacaggugcccuucugcucccaucacuuucaccaacucaucaugaaggacggcagagagauuguugugccuugucgcaaucaggaugaacuggucggacgggccagagugagccagggcgcuggguggucucugcgcgagaccgccugccucggaaaauccuacgcgcagauguggcaacugauguauuuccaucggagagaccuucgccuggccgcuaacgccaucuguagcgccguccccguggauuggguuccgacaucccggaccacguggucuauucacgcucaucaccaguggaugaccacagaagacaugcucagcguguggaauagagucuggaucgaggaaaacccuuggauggaggauaagacccauauuuccagcugggaggacgugcccuaccugggcaaacgggaagaccaguggugcgggucucuuaucggacugacagccagagcgaccugggcuacaaauauccaaguugccauuaaccaggugcgccggcucaucggcaaugagaacuaccuggauuauaugaccuccaugaagagauuuaaaaaugaaagcgaccccgagggggcccugugguga

SEQ ID NO: 18995 - RNA, 9879 nt, Artificial Sequence
  derived and/or modified CDS sequence (opt5) from DENV-1__FJ882537__SS-prME
agcgugaccaugcugcucaugcugaugcccacggcccuugcuuuccaccugacgaccagaggcggggaaccucauaugaucgucuccaagcaggaacggggaaagucucuccuguuuaagaccagcgccggcguuaauaugugcacccuuauugcgauggaccugggggaacucugugaagauacaaugaccuacaaaugcccgagaaucacagagguggaacccgacgauguggacuguuggugcaauaccacggauaccugggucacauauggaaccuguucccagacaggcgagcacagacgggacaagcgcucuguggcucuggccccucauguugggcugggacucgagaccagagccgaaacguggaugagcuccgagggcgcuuggaaacagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaagauaagcccacacuggacaucgaacugcucaaaaccgagguuacaaacccugcugugcugcggaaacuuugcauugaagccaaaaucuccaauaccacgacagauagccgcuguccgacccaaggagaggcgacccugguggaagaacaggacgccaacuucgucugcagacggacauuuguggaucgcggcuggggcaauggguguggacucuucggcaaggggucucugauuaccugcgcuaaguuuaaaugcguuacaaaacuugagggaaaaaucgugcaguacgaaaaccugaaguauuccgucaucgugacgguucacaccggcgaccagcaucaaguggggaaugagagcacagaacacggaaccauugccacaaucacaccccaggcuccuacgucugagauucagcucaccgacuacggcgcccugacacuggauuguucccccagaaccggccucgacuucaacgaaaugguccugcuuacaaugaaagaaaagagcuggcuggugcauaaacagugguuucucgaucugccucuucccuggaccuccggggccucuacgagccaagagacauggaaucggcaggaccugcucgucaccuucaagacagcucacgcgaagaaacaggaagugguugugcugggaucccaagagggcgccaugcacaccgcucugaccggggccacagaaauccagacgaccggaacaaccacaauuuuugccggccaucucaagugccgccugaaaauggauaaacuuacccugaaagggaugagcuaugucauguguacgggcucuuucaagcucgagaaggaaguggcugagacacagcacggaaccguucuggugcagaucaaauacgagggcaccgacgccccgugcaagaucccuuucuccacacaagaugaaaaaggggucacccagaacggaagacugauuacagcgaaucccaucgugacggacaaggagaaaccugugaacauugaagcugagccgcccuuuggcgagagcuauaucguuauuggggccggagaaaaggcccuuaagcucucuugguucaaaaagggcagcuccaucgggaaaauguuugaggcuaccgcccggggcgcuagacgcauggccauccugggagauacagcgugggacuucggcucuauugggggagucuuuaccagcgugggcaagcuggugcaucagaucuucgggacagccuacggaguccucuuuuccggcgugagcuggaccaugaaaauugggaucggcguucugcuuacguggcugggacucaauucucgguccaccagccugucuaugacauguauugcugugggccugaucacccuuuaccucggggucauggugcaggccgauuccggaugcguuauuaacuggaagggcagagaacugaagugugggagcggaaucuucgugacaaaugagguccacaccuggacagaacaauauaaauuucaggcugacuccccuaagcgccugucugccgcgaucggcaaagccugggaggagggggugugcggcauucggagcgcuaccagacucgaaaacaucauguggcgccagauuuccaacgagcugaaucauauccuucuggaaaacgacaugaaguucacgguuguggucggagauguggugggcauucucgcccaggggaaaaagaugguccggccgcaacccauggagcacaaauacucuuggaaaagcuggggaaaggcuaagaucaucggcgccgacguucagaauacaaccuuuauuaucgaugggccuaacacccccgaauguccugacgaucagagagccuggaauauuugggagguggaggacuauggauucggcaucuuuacaaccaacauuuggcugaagcugcgcgauuccuacacacaggugugcgaccaccggcuuaugagcgcugcgaucaaagauucuaaggccguccaugcugacaugggcuauuggaucgaauccgagaaaaaugaaacauggaagcucgccagagccagcuucauugaggugaagaccuguaucuggcccaaaucucacacacugugguccaacgggguucuggaaagcgagaugauuaucccgaagauuuacggaggcccuaucucucaacauaauuaucgccccggguacuucacccagacagcuggaccuuggcaccucggcaaacuggagcuugauuuugaccugugcgaagggaccacgguggucguggaugagcacugcggaaaccggggccccagccucagaaccacaaccguuacaggcaagaucauucaugaaugguguugccgguccuguacccugccuccccugcgcuucaaaggggaggacggaugcugguacggcauggagaucagaccggugaaggaaaaggaggaaaaucuugucaaaagcauggugucugccggguccggagagguugacagcuuuucccucggccugcuguguauuucuaucaugauugaagaggugaugcggagcagauggucccgcaagaugcucaugacggggacacuggcggucuucuuucuucugaucaugggacagcucaccuggaacgaucugauucggucuugcaucauggugggcgcuaaugccagcgacagaaugggcauggggacaaccuaucuggcccuuauggcuaccuucaaaaugcgcccuauguuugccgugggacuccuguucagacggcugacaucccgcgagguccuccugcuuacgaucggccugucucucguugcgagcguggaacugcccaacucccuggaggaacuuggggauggacuggcuaugggcauuaugauccucaagcugcucaccgacuuucaaagcuaccagcugugggccacacuucugucucucaccuucauuaaaacaaccuuuucccugcacuaugccuggaagacgauggcuauggugcugagcaucgucucucuucugccccucugucuguccacaaccagccagaagaccacauggcucccugugcugcuugggucucugggaugcaaaccgcugaccauguuccucauugccgagaauaagaucuggggcagaaaauccuggccccugaacgaaggcaucauggcuguugggauugugagcauccuucuguccagccuccugaagaacgaugucccucucgccggaccccugauugcgggcgggaugcuuaucgccuguuacgugauuucuggaagcuccgcugaccugucucuggagaaagccgcugagguuagcugggaagaggaagccgagcauuccggcgccucucacaauauccucguggaaguccaggaugacgggacaaugaagaucaaagaugaggagcgggacgauacgcugaccauucuucugaaggcuacacuccuggcggugagcggagucuauccucucuccauccccgccacccuguuugugugguacuucuggcaaaagaaaaagcagcgcucuggcguucuuugggacacaccuagcccucccgaaguggagagagcuguccuggaugacggcauuuaucggaucaugcagcgcgggcugcucggaagaucccaggugggcguugggguguuccaagaaaacgucuuucauaccauguggcacgugacgcggggagccgugcugauguaccagggcaaacgccuugagcccagcugggccucuguuaagaaagaccugauuuccuacgggggaggcuggagacuccagggcagcuggaauaccggggaggaaguccaggugaucgcuguggagcccggaaagaacccuaagaauguccaaacagcccccggcaccuucaaaacaccggaaggggaggugggagcgauugcucuggauuuuaagccuggcaccucugggucccccaucguuaaccgggaaggaaaaaucgugggccucuauggcaauggggucgugacaacgagcggaaccuacguuuccgccauugcccaggcuaaggccucucaggagggcccucugcccgagaucgaagacgagguguucagaaaacgcaaccuuacaauuauggaucugcaccccgggagcggaaagacccggagauaucugccugcgaucguccgcgaagcuauuaagcggaaacucagaacccugauccuugccccgacacgcgugguugccuccgagauggcugaagcccugaagggcaugcccauccgguaccaaacgaccgcugugaaaagcgagcauacagggagagagauugucgaccucaugugccacgccaccuuuacaaugcgccugcugucuccugugcgggugcccaauuauaacaugaucauuauggaugaagcgcauuucaccgacccuuccagcaucgccgcuagaggcuacauuucuacgcgggucggaaugggcgaggccgcugccaucuuuaugacagccacacccccugggagcguugaggcuuucccgcaguccaaugcggugauccaggaugaggaacgcgacauucccgagagaucuuggaacagcggauaugaguggaucaccgauuuuccuggcaagacagugugguucguccccuccauuaaaucugggaaugacaucgccaacugucuccggaagaauggaaagcgcgugauucagcuuagcagaaaaaccuuugauacagaauaccaaaagaccaaaaacaacgacugggacuacguugugacgacagauaucuccgagaugggcgcuaauuuccgggccgacagagucauugauccucgccggugccugaagcccgugauccugaaagacgggccggaaagaguuauccucgccggcccuaugcccgugaccgucgcuagcgccgcgcagcgccggggaagaauuggccgcaaccacaauaaggagggggaucaguauaucuacaugggacagccccugaacaaugacgaggaucaugcucacuggacagaagccaagaugcuucuggacaacauuaauaccccugagggcaucauucccgcccucuucgaaccugagcgggaaaaaucugcugccaucgauggggaguauagacugcgcggagaggcgagaaagacguuuguggaacugaugcggcgcggcgaccucccggucuggcuuuccuacaaaguggccagcgagggguuccaauauuccgauagacgguggugcuuugacggcgaacgcaacaaucagguucuggaggaaaacauggauguggagaucuggaccaaggagggagaacgcaagaagcugcggcccagauggcucgacgcucgcacauacucugacccucuggcccuucgggaguucaaagaauuugcugccggcagacgcagcguguccggggaucugauucucgagaucggaaagcugccccagcaccugacccagcgggcucaaaaugcccucgacaaccuugucaugcugcauaauucugaacagggcgggagagcguaucggcacgccauggaggagcugccugauacaauugaaacccucaugcugcuugcucugaucgccguucucacaggaggcgugacccuguucuuucugagcggccgcgggcucggaaagacguccauuggccuucugugugugauggcuagcucugcccugcucuggauggccuccgucgagccccauuggaucgcugcgagcaucauucuggaguucuuucuuauggugcugcucaucccggagccugacagacagcggacaccccaggauaaccaacuggccuacguugugauugggcuccuguucaugauccuuaccgucgcugccaaugagaugggacugcuggaaaccaccaagaaggaccucggcauugggcacguggccgucgagaaccaccaucacgcuaccaugcuggauguggaccuucauccugccucugcguggacacuguacgccguugcuacgaccaucauuacacccaugaugcgccacaccaucgaaaacacaaccgccaauaucucccucacggcuauugccaaccaggcggccauccugaugggacuggauaaaggcuggccuauuagcaagauggacaucggcgugccccuccuugcucuggggugcuauucucaggucaauccgcugacccucacagccgcugugcugaugcuuguugcccauuacgcuauuaucggaccuggccugcaagccaaagcgaccagagaggcccagaagcggacagcugccgggaucaugaagaaccccaccguggauggaauugucgcuaucgaccucgaucccgugguguaugacgccaaauuugaaaagcagcugggccagauuaugcugcucauccuuuguacgagccaaauucugcugaugcgcacaaccugggcccucugcgaguccaucacacuggcgaccgggccucuuaccacacugugggagggaucuccgggcaaauucuggaauacgaccaucgcuguuagcauggccaacauuuuuagaggcuccuaccucgcuggggccggacuggccuucagccugaugaagucccucggcgggggacggcgcggcacaggggcucagggagaaacccuuggcgagaaauggaagagacagcugaaucagcugucuaagagcgaguucaacacauauaaacgguccggcaucauggaggucgacagaucugaagccaaggaggggcuccgccggggagagaccacgaaacacgcggugagcagaggcacagccaagcugcgcugguuuguggaacggaaucuugucaaacccgaggggaagguuauugaucugggauguggcagagggggaugguccuacuauugcgcuggccucaagaaagugaccgaagugaagggcuacaccaaagggggaccuggccacgaggaacccaucccuauggccacauacggguggaaccuggucaagcugcauucuggaaaagacguguucuuuauucccccugagaagugugauacccuccuuugcgacaucggcgagagcuccccgaaucccacaauugaagaggggcgcacgcugcggguucugaaaaugguggaaccuuggcucagaggaaaccaauucuguaucaagauccugaaucccuauaugccuagcgucguggagacccuugagcacaugcagcgcaagcauggcggcaugcugguucggaacccccucucuagaaauuccacacacgaaauguacugggugagcugcgggaccggaaacauugucucugcugugaauaugacaucccgcaugcugcugaaccgguuuaccauggcccacagaaaaccgacguaugagcgcgauguggaccucggcgcggggaccagacaugucgccguugaaccugagguggcuaaccuggauaucauuggacagcggaucgaaaauauuaagcacgagcauaaaagcacauggcacuacgacgaggauaaccccuauaagaccugggccuaccauggcucuuaugaagugaaacccuccgggagcgcuuccagcauggucaauggagugguuaaacuucugacaaagccuugggacgugauccccauggucacccagaucgccaugacagauaccacgccuuucggccaacagcgcguguuuaaagagaagguugacacaagaaccccgaaagcuaagcggggcaccgcccagauuauggaagugacagcgagauggcucuggggguuccugucucggaacaaaaagccccgcaucuguacgagagaggaauuuacccggaagguccgcagcaaugccgcuauuggagccguguucguugacgagaaccaauggaacuccgcuaaagaggccguggaagaugagagauuuugggaccuuguccaccgggaacgcgagcugcacaagcagggcaaaugcgccacaugcguguacaacaugauggggaagagagagaagaagcucggagaguucggcaaggcgaaagggucucgggcuaucugguacauguggcugggcgcccgcuuucuggaguucgaagcccucggauucaugaaugaggaucauugguuuagcagagaaaacucccugucuggcgucgagggggagggacuucacaagcugggcuauauucuccgggacaucagcaaaaucccugggggaaauauguacgcugaugacaccgccggcugggauacacgcauuaccgaagacgaucugcagaacgaggcuaagaucacagacauuauggaacccgagcaugcccuucuggcgaccuccaucuucaaacucacguaucagaauaaggugguuagagugcaacggccugccaaaaacgggaccgucauggaugugauuucucgcagagaccagcggggcagcggacaggugggcacauacgggcugaauaccuuuacaaacauggaagcucagcugaucagacaaauggaguccgagggaaucuucagccccucugaacucgagaccccgaaccuggccgaacgcguucuugauuggcuggagaaguauggcguggaacggcucaagagaauggcuauuuccggggacgacugugucgugaaaccuaucgaugaccgcuuugccacggcgcugacagcccuuaaugauaugggaaagguucggaaagacauuccccagugggagccuagcaagggcuggaacgauuggcaacaggugcccuucugcucucaccacuuucaucaacugaucaugaaagacgggagagagauugucgugccuugucgcaaucaggaugaacucgucggccgggcuagagugucccagggagccggcuggagccugcgcgagaccgcuugccuggggaaguccuacgcccagauguggcaacucauguauuuccaccggagagaccugcgccuugcugccaacgcgaucuguucugccguucccguggauugggucccgacaagccggaccacgugguccauucaugcucaccaucaguggaugaccacagaagacaugcugagcguguggaauagaguuuggaucgaggaaaacccuuggauggaggauaagacccacaucucuuccuggggagacgugcccuaccucggcaaacgggaggaccaguggugcgggagccugauuggacuuacagccagagccaccugggcuacaaauauccaagucgccauuaaccaggugcgccggcugaucggcaaugaaaacuaccucgauuauaugaccucuaugaagagauuuaaaaaugagagcgaccccgaaggggcgcugugguga

SEQ ID NO: 18996 - RNA, 9879 nt, Artificial Sequence
  derived and/or modified CDS sequence (opt5) from DENV-1__GQ868606__SS-prME
agcgugaccaugcugcucaugcugaugcccaccgcccuugcuuuccaccugacgaccagaggaggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaaucaucgccccggguacuuuacacaaaccgcgggaccuuggcaccugggcaagcucgagcuggauuucgaccuuugcgaagggacgaccgugguuguggaugagcacugcggaaaccggggccccucccugagaacaaccacagucaccggcaaaauuauccaugaaugguguugccggagcuguacgcucccuccccugcgcuuuaagggggaggacggaugcugguacggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaucuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaccaacugugggcuacccuucugucucucacauuuauuaagaccacguucucccugcauuacgccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuaugugauuucuggaagcuccgcugaccuuucucuggagaaggccgccgaggucagcugggaagaggaagcugagcacuccggcgcgucucauaauauccugguggaaguucaggaugacgggacgaugaaaauuaaggaugaggagcgggacgauacccucacaauccugcuuaaggccacccugcucgcugugagcggagucuacccucuguccauccccgccacacucuucgugugguauuuuuggcagaaaaagaaacaacgcucuggcguccugugggacaccccuuccccucccgaaguggagagagccguucuugaugacggcauuuaccggaucaugcagcgcgggcugcugggaagaucccaggugggcgucgggguguuccaggaaaacguuuuucacacgauguggcacgugacccggggagcuguccucauguaucaaggcaagcgccuggagcccagcugggccucugugaaaaaggaccuuauuuccuacgggggaggcuggagacugcagggcagcuggaauacaggggaggaagugcagguuaucgcggucgagcccggaaagaacccuaaaaaugugcagaccgcucccggcacauucaagaccucugaaggggaggugggagccauugcccucgauuuuaaaccgggcacauccgggagcccuaucgucaaccgggaaggaaagauugugggccuguacggcaaugggguugugacgaccuccggaacauaugucucugcuaucgcccaagcgaaagcuagccaggagggcccccucccugagaucgaagacgagguguucagaaagcgcaaccugaccauuauggaucuucaucccggguccggaaagacccggagauaccugcccgccaucguucgcgaagccauuaaacggaagcugagaacacucauccuggcuccuacgcgcguggucgccagcgagauggcugaagcccuuaaaggcaugccgauucgguaucagaccacagcggugaagucugagcacaccgggaaagagaucguugaccugaugugccaugccacauuuaccaugagacuccugucccccgugcgcgucccuaauuacaacaugaucauuauggaugaagcucacuucacggaccccagcucuaucgccgcucggggcuauauuagcacaagagugggaaugggcgaggccgccgcuaucuuuaugaccgcgaccccucccggguccguggaagccuucccucaaucuaaugcugucauucaggaugaggaacgggacaucccggagcgcagcuggaacuccggauacgaguggaucacagauuuucccggcaagaccguuugguucgugccuucuauuaagagcgggaaugacaucgccaacugucugcgcaagaauggaaagcgggugauucagcucucccgcaaaacauucgauaccgaauaucagaagacgaaaaacaacgacugggacuacgucgugacaaccgauaucagcgagaugggcgccaauuuuagagcugaccggguuauugaucccagacgcugccuuaagccugugauccugaaggacgggcccgaacgggucauucuggccggcccgaugccugugacaguugcgucugcugcccaaagacgcggacggaucggcagaaaccauaauaaagagggggaucaguacaucuauaugggacagccccucaacaaugacgaggaucacgcccacuggaccgaagcuaagaugcugcuugacaacauuaauacgcccgagggcaucauuccugcccuguucgaacccgagcgcgaaaaauccgcggccaucgauggggaguaccggcucagaggagaggcucgcaagaccuuuguggaacugaugagacggggcgaccugccugucuggcucagcuauaaaguggccuccgagggguuccaguacucugaucgcagauggugcuuugacggcgaacggaacaaucaaguccuugaggaaaacauggauguggagauuuggacaaaggagggagaacgcaaaaagcugagaccgcgguggcuggacgcuagaaccuauagcgacccccucgcccugcgcgaguucaaggaauuugcugccggccggagauccguuucuggggaucuuauccuggagaucggaaaacucccucagcaucugacacagcgcgcgcagaaugcccuggacaaccucgugaugcuucacaauagcgaacaaggcgggcgggcuuacagacaugccauggaggagcugcccgauaccauugaaacacugaugcuccuggcucuuaucgccgugcugaccggaggcgucacgcuguucuuucuguccggccgggggcugggaaagacaagcauuggccuccuuuguguuauggccucuuccgugcugcuguggauggcuagcguggagccucacuggaucgcggccucuauuauccucgaguucuuucugaugguccuucugauccccgagccggaccgccagagaaccccucaggauaaccagcucgcuuaugugguuauugggcugcuguucaugauccucaccguggccgccaaugagaugggacuucuggaaacaaccaaaaaggaccugggcauugggcacgucgcuguggagaaccaucaccaugccgcgaugcucgaugucgaccugcaccccgccuccgcuuggacacuuuacgccguggcuacgaccaucauuacaccuaugaugcggcauaccaucgaaaacacaaccgccaauauuagccugacggcgaucgccaaccaagcugccauccucaugggacuggauaaaggcuggcccauuucuaagauggacaucggcguuccucugcucgcucuugggugcuacagccaggugaauccccugacccugacagccgcuguccucaugcugguggcccacuaugcgauuaucggaccgggccuucaggccaaggcuacccgcgaggcccagaagagaacagcugccgggauuaugaagaacccuaccguugauggaaucguggccaucgaccuggaucccgucguguacgacgcgaaauuugaaaagcagcucggccagauuaugcugcugauccucuguacgucccagauucuucugaugcggacaaccugggcucugugcgagucuaucacacucgccaccgggccccugaccacacuuugggagggaagcccuggcaaauucuggaauacgaccauugcuguguccauggccaacaucuuccgcggcagcuaucuggccggggcuggacucgccuuuucccugaugaagucucugggcgggggaagacggggcacaggggcgcaaggagaaacccucggcgagaaguggaaacgccagcuuaaucagcugagcaaguccgaguucaacacauacaaaagaucuggcaucauggagguugaccggagcgaagccaaggaggggcugaaaagaggagagaccacgaagcacgcugucucccgcggcacagccaagcuccggugguuuguggaaagaaaucuggugaaaccggaggggaaggucauugaucuuggauguggccgcgggggauggucuuauuacugcgcuggccugaaaaagguuaccgaagugaaaggcuauaccaaagggggacccggccaugaggaaccuauccccauggccacauacggguggaaccucgugaaacugcacagcggaaaggacgucuucuuuauuccucccgagaagugugauacccugcucugcgacaucggcgaguccagcccuaauccgacaauugaagaggggcggacgcuuagagugcugaaaaugguugaacccuggcugcgcggaaaccaguucuguaucaagauucucaauccuuacaugcccucuguggucgagacccuggagcaaaugcagcggaaacauggcggcaugcuugugagaaacccucugucccgcaauagcacacacgaaauguauuggguuucuugcgggaccggaaacaucguguccgcggucaauaugacaagccggaugcuccugaacagauuuaccauggcccaccgcaagcccacguacgagcgggauguggaccugggcgcugggaccagacauguggccgucgaaccggagguugcuaaccucgauaucauuggacagcgcaucgaaaauauuaaacacgagcauaagucuacauggcacuaugacgaggauaacccuuacaagaccugggccuaucauggcuccuacgaagugaaacccagcggguccgcuagcucuauggugaauggagucgugaagcugcuuacaaaacccugggacguuaucccuauggugacccagauugccaugacagauaccacgcccuucggccaacagagagucuuuaaggagaaaguggacacacggaccccuaaggcgaagcgcggcaccgcccagaucauggaaguuacagcuaaauggcuguggggguuccucagcagaaacaagaaaccgcggaucuguacgagagaggaauuuacccggaaggugcgcuccaaugccgcuauuggagccgucuucguggacgagaaccaauggaacucugccaaagaggcgguugaagaugagagauuuugggaccuggugcaccgggaacgcgagcuucacaagcagggcaagugcgcuacaugcgucuauaacaugauggggaaaagagaaaagaaacugggagaguucggcaaggccaaagggagccgggccaucugguacauguggcucggcgcucgcuuccuggaguuugaagcccugggauucaugaaugaggaucauugguuuuccagagaaaacucucucagcggcguggagggggagggacugcacaaacuuggcuacauucugcgggacaucuccaaaauucccgggggaaauauguaugcugaugacaccgccggcugggauacacgcaucaccgaagacgaucuccagaacgaggcgaagaucacagacauuauggaaccugagcaugcccugcuugcuaagucuaucuucaaacugaccuaccagaauaaggucgugagaguucaacggcccgcccgcaacgggacggugauggaugucauuagcagacgggaccagcgcggcuccggacaggugggcaccuaugggcucaauacauuuaccaacauggaagcucagcugaucagacaaauggagagcgagggaauuuucucuccuuccgaacuggagacacccaaccucgccggccgggugcuggauuggcuugaaaaacacgggguugagagacugaagcgcauggcgaucagcggagacgacuguguggucaaaccgaucgaugaccgguuugccaccgcucucacggcccugaaugauaugggcaaggugagaaaggacauuccucagugggaacccucuaaaggguggaacgauuggcagcagguuccuuucugcucccaccauuuucaccaacuuaucaugaaggacggccgcgagauugugguccccugucggaaucaggaugagcuggugggcagagcucgcgucagccagggcgccggguggucccuccgggaaacagcuugccugggaaaaucuuacgcccagauguggcaacugauguauuuccauagacgcgaccuccggcuggcggccaacgcuaucuguagcgccgugccuguugauugggugcccaccuccagaacaaccuggagcauucacgcccaucaccaguggaugacgaccgaggacaugcuuucugucuggaaucgcguguggaucgaagagaacccguggauggaagauaagacacacauuuccagcuggggcgacguuccuuaccuggggaaacgggaggaccaguggugcggaucucucaucggccugaccgcuagagccacaugggcgaccaauauccaaguggcuauuaaccagguccggagacuuaucgggaaugagaacuaucuggauuacaugacaagcaugaagcgcuuuaagaaugaauccgaccccgagggcgcccucugguga

SEQ ID NO: 18997 - RNA, 9879 nt, Artificial Sequence
  derived and/or modified CDS sequence (opt5) from DENV-1__FJ882539__SS-prME
agcgugaccaugcugcucaugcugaugcccacagcccuugcuuuccaccugacgaccagaggcggggaaccucauaugaucguguccaagcaggaacggggaaaaucucuccuguucaagacaagcgccggcguuaauaugugcacccuuauugcgauggaccugggggaguucugugaagauacaaugaccuacaaaugcccccgcaucacagaagcugaacccgacgauguggacuguuggugcaaugccaccgauacgugggugaccuauggaacauguucccagaccggcgagcacagacgggacaagcgcucuguggcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcucuugcgucucaagagaccuggaaucgcaaagaccugcucgugacauuuaagaccgcccacgcuaagaaacaggaagucgugguucugggaagccaggagggcgccaugcacaccgcccugacaggggcuacggaaauccaaaccuccggaacaaccacaauuuucgccggccaucucaagugcagacugaaaauggauaaacuuacccugaaagggaugagcuaugugauguguacgggcucuuucaagcucgagaaggaagucgcggagacacagcacggaaccgugcugguucagaucaaauacgagggcaccgacgcuccgugcaagauuccuuuuuccacacaggaugaaaaagggaucacccaaaacggacggcugaucacagccaaucccauugugacggacaaggagaaaccugucaacaucgaagccgagccgcccuucggcgagagcuauauugugaucggggcuggagaaaaggcccuuaagcucucuugguuuaaaaagggcagcuccauugggaaaauguucgaggcuaccgccagaggcgcgcgccggauggccauccugggagauacagcuugggacuuuggcucuaucgggggaguguucaccagcguuggcaagcugguccaucagauuuuugggacagccuacggaguccuguucuccggcgugagcuggaccaugaaaaucgggauuggcguccugcuuacguggcugggacucaauucuagauccaccagccugucuaugacauguaucgcugugggccugguuacccuuuaccucggggugaugguccaggccgauuccggaugcgugauuaacuggaagggccgcgaacugaagugugggagcggaaucuuuguuacaaaugaggugcacaccuggacagaacaguauaaauuccaagcggacuccccuaagcggcugucugccgcuauuggcaaagccugggaggagggggucugcggcaucagaagcgcuacccgccucgaaaacaucauguggaagcagauuuccaacgagcugaaucauauccuucuggaaaacgacaugaaauuuacggugguugugggagaugucgccggcauucucgcccaggggaagaaaaugauccggccgcagcccauggaguacaaguauucuuggaaaagcuggggaaaggcuaagauuaucggcgcggacgugcaaaauacaaccuucaucauugaugggccuaacacccccgaauguccugacgaucagagagccuggaauaucugggagguggaggacuacggauuuggcauuuucacaaccaacaucuggcugaaacugcgcgauuccuauacgcaggucugcgaccaccggcuuaugagcgcugccauuaaggauucuaaagccguucacgcugacaugggcuacuggaucgaauccgagaagaaugaaacauggaagcucgccagagcgagcuucaucgaggugaaaaccuguauuuggcccaagucucauacacugugguccaacggggugcuggaaagcgagaugaucauuccgaaaaucuauggaggcccuauuucucagcacaaucaucgccccggguacuuuacccaaacagcuggaccuuggcaccucggcaagcuggagcuugauuucgaccugugcgaagggaccacggucgugguugaugagcacugcggaaaccggggccccagccucagaaccacaaccgugacaggcaaaaucauccaugaaugguguugccgguccuguacccugccuccccugcgcuuuaagggggaggacggaugcugguacggcauggagauuagaccggucaaggaaaaagaggaaaaucuugugaaguccaugguuucugccggguccggagagguggacagcuucucccucggccugcuguguaucucuauuaugaucgaagaggucaugcggagcagauggucccgcaaaaugcucaugacggggacacuggccguguuuuuccuucugauuaugggacagcucaccuggaacgaucugauccggcugugcauuaugguuggcgcuaaugccucugacagaaugggcauggggacaaccuaucuugcgcugauggcuaccuuuaagaugcgcccuauguucgccgugggacuccuguuuagacggcucacaagccgcgagguccugcuucugacgaucggccucucccugguggccucuguggaacugcccaacagccuugaggaacugggggauggacucgcuaugggcaucaugauucugaaacuccugaccgacuuccagucccaccaacuuugggccacacugcucagccugaccuuuaucaagacaaccuucucucugcauuacgcuuggaagacgauggccaugguccuuuccauuguuagccuguuuccccucugucugucuacaaccucccagaaaaccacauggcucccugugcugcuugggagccugggaugcaagccgcugaccauguuccucaucgcggagaauaaaauuuggggcagaaagucuuggccccugaacgaaggcaucauggccguggggaucgucuccauucuucugagcucccuccugaaaaacgaugugccucucgcuggaccccugaucgccggcgggaugcuuauugcuuguuauguuaucagcggaucuagcgccgaccugucccuggagaaggccgcugaggugucuugggaagaggaagcggagcacagcggcgccucccauaauauucucgucgaagugcaggaugacgggacaaugaaaaucaaggaugaggagcgggacgauacgcugaccauccuucugaaggcuacacuccuggccguuucuggaguguacccucucagcauucccgccacccuguucgucugguauuuuuggcagaaaaagaaacaacgcuccggcgugcuuugggacacaccuucucccccggaagucgagagagcugugcuggaugacggcaucuaccggauuaugcagcgcgggcugcucggaagaagccagguuggcgugggggucuuccaggaaaacguguuucacaccauguggcacguuacgcggggagccgugcugauguaucaaggcaagcgccuugagccuuccugggcgagcgucaaaaaggaccugaucucuuacgggggaggcuggagacuccagggcuccuggaauaccggggaggaaguccaggugauugcuguugagcccggaaagaacccuaaaaauguccagacagcccccggcaccuucaagacaagcgaaggggaggugggagccaucgcucuggauuuuaaaccgggcaccucuggguccccuauugugaaccgggaaggaaagaucgucggccucuacggcaauggggugguuacaacgagcggaaccuauguguccgccaucgcgcaagcuaaagccucucaggagggcccccugccugagauugaagacgaggucuucagaaagcgcaaccuuacaaucauggaucugcaucccgggagcggaaagacccggagauaccugcccgccauugugcgcgaagcuaucaaacggaagcucagaacccugauucuugccccuacacgcguuguggcuuccgagauggccgaagcgcugaaaggcaugccgauccgguaucagacgaccgccgucaagagcgagcacacagggaaagagaucguggaccucaugugccaugcuaccuuuacaaugagacugcugucucccguucgcgugccuaauuacaacaugauuaucauggaugaagcccacuucaccgaccccuccagcauugcugcccggggcuauaucucuacgagagucggaaugggcgaggccgcugcgauuuuuaugacagccaccccucccgggagcguggaggcuuucccucaauccaaugccgugauccaggaugaggaacgggacaucccggagcgcucuuggaacagcggauacgaguggauuaccgauuuucccggcaagacagucugguucguuccuuccaucaagucugggaaugacauugccaacugucuccgcaagaauggaaagcgggugauccagcuuagccgcaaaaccuucgauacagaauaucagaagaccaaaaacaacgacugggacuacguggucacgacagauauuuccgagaugggcgcuaauuuuagagccgaccgggugaucgaucccagacgcugccugaagccuguuauucugaaggacgggcccgaacgggugauccucgcgggcccgaugccugucaccguggcuagcgccgcccaaagacgcggacggaucggcagaaaccauaauaaagagggggaucaguacauuuauaugggacagccccugaacaaugacgaggaucacgcucacuggacagaagccaagaugcuucuggacaacaucaauacccccgagggcauuaucccugcgcucuuugaacccgagcgcgaaaaaucugccgcuauugauggggaguaccggcugagaggagaggcccgcaagacguuuguugaacugaugagacggggcgaccucccuguguggcuuuccuauaaagucgcuagcgagggguuccaguacuccgaucgcagauggugcuuugacggcgaacggaacaaucaagugcuggaggaaaacauggaugucgagaucuggaccaaggagggagaacgcaaaaagcugagaccgcgguggcucgacgccagaacauauucugacccccuggcucuuagagaguucaaggaauuugccgcgggccggagaagcguguccggggaucugauccucgagauuggaaaacugccucagcaucugacccagcgcgcccagaaugcucucgacaaccuuguuaugcugcacaauucugaacaaggcgggcgggccuacagacaugcuauggaggagcugcccgauacaaucgaaacccucaugcugcuugcccugauugccgugcucacaggaggcgugacccuguucuuucugagcggccgggggcucggaaagacguccaucggccuucugugugucauggcuagcucuguucugcucuggauggcguccguggagccucacuggauugccgcuagcaucauccuggaguucuuucuuauggugcugcucauucccgagccggaccgccagagaacaccucaggauaaccagcuggccuaugucgugaucgggcuccucuucaugauucuuaccguugccgcuaaugagaugggacugcuggaaaccaccaagaaggaccucggcaucgggcacguggccgucgagaaccaucaccaugcggccaugcuggauguggaccuucaccccgcuucugccuggacccuguacgcugucgccacaacgauuaucaccccuaugaugcggcauacaauugaaaacaccacagcgaauaucucccucaccgccaucgcuaaccaagccgcuauucugaugggacuggauaaaggcuggcccaucagcaagauggacauuggcgugccucuccuugcccuggggugcuacucucagguuaauccccugacgcucaccgcugccgugcugaugcuugucgcgcacuaugccaucauuggaccgggccugcaggcuaaggccacacgcgaggcucagaagagaaccgccgccgggaucaugaagaacccuacaguggauggaaucguugcgauugaccucgaucccguggucuacgacgcuaaauuugaaaagcagcugggccagaucaugcugcucauucuuuguaccagccagauccugcugaugcggacgacaugggcccucugcgaguccauuacccuggcuacagggccccuuaccacccugugggagggaucuccuggcaaauucuggaauacaacgaucgccgugagcauggccaacaucuuccgcggcuccuaucucgcuggggccggacuggcguuuagccugaugaagucccucggcgggggaagacggggcaccggggcccaaggagaaacacuuggcgagaaguggaaacgccagcugaaucagcugucuaagagcgaguucaacaccuacaaaagauccggcauuauggagguggaccggucugaagcuaaggaggggcucaaaagaggagagacaaccaagcacgccguuagccgcggcacggcuaagcugcggugguuugucgaaagaaaucuugugaaaccggaggggaaggugaucgaucugggauguggccgcgggggaugguccuauuacugcgccggccucaaaaaggucacagaaguuaaaggcuauaccaaagggggacccggccaugaggaaccuauucccauggcgaccuacggguggaaccuggugaaacugcacucuggaaaggacguguucuuuaucccucccgagaagugugauacacuccuuugcgacauuggcgagagcuccccuaauccgaccaucgaagaggggcggacacugagaguccugaaaaugguggaacccuggcuccgcggaaaccaguucuguauuaagauccugaauccuuacaugcccagcguuguggagacgcuugagcaaaugcagcggaaacauggcggcaugcuggucagaaacccucucucucgcaauuccacccacgaaauguauugggugagcugcgggacaggaaacaucguuucugccgugaauaugaccucccggaugcugcugaacagauuuacaauggcucaccgcaagcccaccuacgagcgggaugucgaccucggcgccgggacgagacauguggcuguggaaccggaggucgccaaccuggauauuaucggacagcgcauugaaaauaucaaacacgagcauaagagcaccuggcacuaugacgaggauaacccuuacaagacaugggcuuaucauggcucuuacgaaguuaaacccuccgggagcgccuccagcauggugaauggaguggucaaacuucugaccaaacccugggacgugauuccuaugguuacacagaucgcgaugaccgauacaacccccuucggccaacagagaguguuuaaggagaaagucgacacgcggacaccuaaggccaagcgcggcaccgcucagaucauggaagugaccgccaaauggcucuggggguuccugucuagaaacaagaaaccgcggauuuguacaagagaggaauuuacgcggaagguucgcagcaaugcugccaucggagccguguucgucgacgagaaccaauggaacuccgcgaaagaggcuguggaagaugagagauuuugggaccuuguucaccgggaacgcgagcugcacaagcagggcaagugcgcuaccugcguguauaacaugauggggaaaagagaaaagaaacucggagaguucggcaaggccaaagggucucgggcuauuugguacauguggcugggcgcccgcuuccuggaguuugaagcucucggauucaugaaugaggaucauugguuuagcagagaaaacucccugucuggcgucgagggggagggacuucacaagcugggcuacauccuccgggacauuagcaaaauccccgggggaaauauguaugccgaugacacagcgggcugggauacccgcaucacagaagacgaucugcagaacgaggccaagauuaccgacaucauggaaccugagcaugcccuucuggccaaguccauuuucaaacucacauaccagaauaagguggucagagugcaacggcccgcuaaaaacgggaccguuauggaugugaucucucgcagagaccagcggggcagcggacaggucggcacguaugggcugaauaccuuuacaaacauggaagcccagcugauucgccaaauggaguccgagggaaucuucagcccuucugaacucgagacccccaaccuggcgggcagagugcuugauuggcuggaaaagcacgggguggagcggcucaaaagaauggccaucuccggagacgacuguguugugaagccgauugaugaccgcuuugcuacagcccugaccgcucuuaaugauaugggcaagguccggaaagacaucccucagugggaacccagcaagggguggaacgauuggcaacaggugccuuucugcucucaccauuuucaccaacugauuaugaaagacggcagagagaucguugugcccugucgcaaucaggaugagcucgucggacgggccagagugucccagggcgcuggguggagccugcgcgaaacggccugccugggaaaguccuacgcgcagauguggcaacucauguauuuccaucggagagaccugcgccuugccgcuaacgccauuuguucugccgucccuguggauuggguucccacaagccggaccacaugguccauccacgcucaucaccaguggaugaccacggaggacaugcugagcguguggaauagagucuggauugaagagaacccguggauggaagauaaaacccacaucucuuccuggggcgacgugccuuaccucgggaagcgcgaggaccaguggugcggaagccugaucggccuuacagcccgggcgaccugggcuacaaauauucaaguugccaucaaccaggugagacggcugauugggaaugagaacuaucucgauuacaugaccucuaugaagagauuuaaaaaugaaagcgaccccgagggcgcccugugguga

SEQ ID NO: 18998 - RNA, 9879 nt, Artificial Sequence
  derived and/or modified CDS sequence (opt5) from DENV-1__FJ882541__SS-prME
agcgugaccaugcugcucaugcugauccccacggcgcuugcuuuccaccugacgaccagaggaggggagccucauaugauugucuccaagcaggaacggggaaagucucuccuguuuaagaccagcgccggaguuaauaugugcacccuuaucgcgauggaccugggggagcucugugaagauacaaugaccuacaaaugcccgcgcauuacagagguggaacccgacgauguggacuguuggugcaauaccacggauaccugggucacauauggaaccuguucccagacaggagagcacagacgggacaagcgcucuguggcucuggccccucauguugggcugggacucgagaccagagccgaaacguggaugagcuccgagggcgcuuggaaacagauccagaagguggaaacaugggcccugcggcaccccggcuucaccgucauugcucuuuuucuggcccaugcgaucgggacaucuaucacccagaagggaauuaucuucauucuccugaugcuugugaccccuagcauggccaugcgcugcguuggcaucggguccagagauuuuguggagggacugagcggcgcuacaugggucgacguggugcucgagcacgggucuugugucacgaccauggccaaagauaagcccacacuggacauugaacugcucaaaaccgagguuacaaacccugcugugcugcggaaacuuugcaucgaagccaaaauuuccaauaccacgacagauagccgcuguccgacccaaggagaggcgacccugguggaagaacaggacgccaacuucgucugcagacggacauuuguggaucgcggcuggggcaauggguguggacucuucggcaaggggucucugaucacaugcgcuaaguuuaaaugcguuacaaaacuugagggaaaaaucgugcaguacgaaaaccugaaguauuccgucauugugacgguucacaccggcgaccagcaucaaguggggaaugagagcacagaacacggaaccacagccaccaucacgccccaggcuccuaccucugagauucagcucacagacuacggcgcccugacccuggauuguucccccagaacaggccucgacuucaacgaaaugguccugcuuaccaugaaagggaaguccuggcuggugcauaaacagugguuucucgaucugccucuucccuggacguccggagccucuacaagccaagagaccuggaaucggcaggaccugcucgucacauucaagaccgcucacgcgaagaaacaggaggugguugugcugggcucccaagaaggggccaugcacaccgcucugacaggagccacggagauccagaccagcggcacaaccacaauuuuugccgggcaucucaagugccgccugaaaauggauaaacuuacccugaaaggcaugucuuaugucauguguacgggauccuucaagcucgaaaaggagguggcugaaacacagcacggcaccguucuggugcagaucaaauacgaggggaccgacgccccgugcaagaucccuuucagcacacaagaugagaaaggagucacccagaacggcagacugauuacagcgaaucccaucgugacggacaaggaaaaaccugugaacauugaggcugaaccgcccuuuggggagucuuauaucguuauuggagccggcgagaaggcccuuaagcucagcugguucaaaaagggguccucuaucggcaaaauguuugaagcuaccgcccggggagcuagacgcauggccauccugggcgauacagcgugggacuucgggagcauuggaggcgucuuuaccuccguggggaagcuggugcaucagaucuucggaacagccuacggcguccucuuuagcggggugucuuggaccaugaaaauuggcaucggaguucugcuuacguggcugggccucaauucccggagcaccucucuguccaugacauguauugcuguggggcuggucacccuuuaccucggagugaugguucaggccgauagcggcugcgugaucaacuggaaggggagagagcugaaguguggauccggcauuuucgucacaaaugaagugcacaccuggacagagcaauauaaauuucaggcugacucuccuaagcgccugagcgccgcgaucgggaaagccugggaagagggcguuugcggaauccgguccgcuaccagacucgagaacauuauguggcgccagaucucuaacgaacugaaucauauucuucuggagaacgacaugaaguucacgguggucgugggcgauguggucgggauccucgcccagggcaagaagaugauucggccgcaacccauggaacacaaauacagcuggaaguccuggggcaaggcuaaaaucaucggggccgacguucagaauacaaccuuuauuaucgauggaccuaacacccccgaguguccugacgaucagagagccuggaauauuugggaaguggaggacuauggcuucggcaucuuuacaaccaacauuuggcugaagcugcgcgauagcuacacacaggugugcgaccaccggcuuaugucugcugcgaucaaagauuccaaggccguccaugcugacaugggguauuggaucgagagcgagaaaaaugagacauggaagcucgccagagccucuuucauugaagugaagaccuguaucuggcccaaaucccacacacuguggagcaacggaguucuggagucugaaaugauuaucccgaagauuuacggcgggccuaucagccaacauaauuaucgccccggauacuucacccagacagcuggcccuuggcaccucgggaaacuggagcuugauuuugaccugugcgagggaaccacgguggucguggaugaacacugcggcaaccggggccccucccucagaaccacaaccguuacagggaagaucauucaugagugguguugccggagcuguacccugccuccccugcgcuucaaaggagaagacggcugcugguacgggauggagaucagaccggugaaggagaaggaagagaaucuugucaaaucuaugguguccgccggaagcggcgaaguugacuccuuuucucucgggcugcuguguauuagcaucaugauugaggaagugaugcgguccagauggucucgcaagaugcucaugacgggaacacuggcggucuucuuucuucugaucaugggccagcucaccuggaacgaucugauucggagcugcaucauggugggcgcuaaugccuccgacagaauggggaugggaacaaccuaucuggcccuuauggcuaccuucaaaaugcgcccuauguuugccgugggccuccuguucagacggcugacaucucgcgagguccuccugcuuacgaucgggcugagccucguugcguccguggagcugcccaacagccuggaagaacuuggagauggccuggcuauggggauuaugauccucaagcugcucaccgacuuucaaucuuaccagcugugggccacacuucugucccucaccuucauuaaaacaaccuuuagccugcacuaugccuggaagacgauggcuauggugcugucuaucgucucccuucugccccucugucugagcacaaccucucagaagaccacauggcucccugugcugcuuggaucccugggcugcaaaccgcugaccauguuccucauugccgaaaauaagaucuggggcagaaaaagcuggccccugaacgaggggaucauggcuguuggaauuguguccauccuucugagcucucuccugaagaacgaugucccucucgccggcccccugauugccgggggaaugcuuaucgccuguuacgugauuagcggcuccucugcugaccugagccuggaaaaagccgcugagguuuccugggaggaagaggccgaacauucuggggccagccacaauauccucguggagguccaggaugacggaacaaugaagaucaaagaugaagaacgggacgauacgcugaccauucuucugaaggcuacacuccuggcgguguccggcgucuauccucucucuauccccgccacccuguuugugugguacuucuggcaaaagaaaaagcagcgcagcggcguucuuugggacacaccuagcccucccgagguggaaagagcuguccuggaugacgggauuuaucggaucaugcagcgcggacugcucggcagaagccagguggggguuggaguguuccaagagaacgucuuucauaccauguggcacgugacgcggggcgccgugcugauguaccaggggaaacgccuugaacccucuugggccuccguuaagaaagaccugauuagcuacggaggcggcuggagacuccaggggucuuggaauaccggagaggagguccaggugaucgcuguggaacccggcaagaacccuaagaauguccaaacagcccccgggaccuucaaaacaccggagggagaagugggcgcgauugcucuggauuuuaagccugggaccuccggaagccccaucguuaaccgggagggcaaaaucgugggccucuaugggaauggagucgugacaacguccggcaccuacguuucugccauugcccaggcuaaggccagccaggaagggccucugcccgagaucgaggacgaaguguucagaaaacgcaaccuuacaauuauggaucugcaccccggauccggcaagacccggagauaucugccugcgaucguccgcgaggcuauuaagcggaaacucagaacccugauccuugccccgacacgcgugguugccagcgaaauggcugaggcccugaaggggaugcccauccgguaccaaacgaccgcugugaaaucugaacauacaggcagagagauugucgaccucaugugccacgccaccuuuacaaugcgccugcuguccccugugcgggugcccaauuauaacaugaucauuauggaugaggcgcauuucaccgacccuagcucuaucgccgcuagaggauacauuagcacgcgggucggcaugggggaagccgcugccaucuuuaugacagccacacccccuggauccguugaggcuuucccgcagucuaaugcggugauccaggaugaagaaagagacauucccgaaagaagcuggaacuccggcuaugaguggaucaccgauuuuccugggaagacagugugguucguccccucuauuaaaagcggaaaugacaucgccaacugucuccggaagaauggcaagcgcgugauucagcuuuccagaaaaaccuuugauacagaguaccaaaagaccaaaaacaacgacugggacuacguugugacgacagauaucagcgaaaugggggcuaauuuccgggccgacagagucauugauccucgccggugccugaagcccgugauccugaaagacggcccggagagaguuauccucgccggaccuaugcccgugaccgucgcuucugccgcgcagcgccggggcagaauugggcgcaaccacaauaaggaaggagaucaguauaucuacaugggccagccccugaacaaugacgaggaucaugcucacuggacagaggccaagaugcuucuggacaacauuaauaccccugaagggaucauucccgcccucuucgagccugaacgggagaaauccgcugccaucgauggagaauauagacugcgcggcgaggcgagaaagacguuuguggagcugaugcggcgcggggaccucccggucuggcuuagcuacaaaguggccuccgaaggcuuccaauauucugauagacgguggugcuuugacggagagcgcaacaaucagguucuggaagagaacauggauguggaaaucuggaccaaggagggcgagcgcaagaagcugcggcccagauggcucgacgcucgcacauacagcgacccucuggcccuucgggaguucaaagaguuugcugccgggagacgcuccgugucuggagaucugauucucgaaaucggcaagcugccccagcaccugacccagcgggcucaaaaugcccucgacaaccuugucaugcugcauaauagcgagcaagggggcagagcguaucggcacgccauggaggaacugccugauacaauugagacccucaugcugcuugcucugaucgccguucucacaggcggcgugacccuguucuuucuguccgggcgcggacucggcaagacgagcauugggcuucugugugugauggcuucuuccgcccugcucuggauggccagcgucgaaccccauuggaucgcugcgucuaucauucuggaguucuuucuuauggugcugcucaucccggaaccugacagacagcggacaccccaggauaaccaacuggccuacguugugauuggacuccuguucaugauccuuaccgucgcugccaaugagaugggccugcuggagaccaccaagaaggaccucgggauuggacacguggccgucgaaaaccaccaucacgcuaccaugcuggauguggaccuucauccugccuccgcguggacacuguacgccguugcuacgaccaucauuacacccaugaugcgccacaccaucgagaacacaaccgccaauaucagccucacggcuauugccaaccaggcggccauccugaugggccuggauaaaggcuggccuauuucuaagauggacaucggggugccccuccuugcucugggaugcuauagccaggucaauccgcugacccucacagccgcugugcugaugcuuguugcccauuacgcuauuaucggcccugggcugcaagccaaagcgaccagagaagcccagaagcggacagcugccggaaucaugaagaaccccaccguggauggcauugucgcuaucgaccucgaucccgugguguaugacgccaaauuugagaagcagcuggggcagauuaugcugcucauccuuuguacgucccaaauucugcugaugcgcacaaccugggcccucugcgaaucuaucacacuggcgaccggaccucuuaccacacugugggagggcagcccgggcaaauucuggaauacgaccaucgcuguuuccauggccaacauuuuuagagggagcuaccucgcuggagccggccuggccuucucccugaugaagucucucgggggaggccggcgcgggacaggagcucagggcgagacccuuggcgaaaaauggaagagacagcugaaucagcugagcaaguccgaguucaacacauauaaacggucugggaucauggaagucgacagaagcgaggccaaggaaggacuccgccggggcgagaccacgaaacacgcgguguccagagggacagccaagcugcgcugguuuguggagcggaaucuugucaaacccgaaggaaagguuauugaucugggcugugggagaggaggcuggucuuacuauugcgcuggccucaagaaagugaccgaggugaagggguacaccaaaggaggcccugggcacgaggagcccaucccuauggccacauacggauggaaccuggucaagcugcauagcggcaaagacguguucuuuauucccccugaaaagugugauacccuccuuugcgacaucggggaguccagcccgaaucccacaauugaggaaggacgcacgcugcggguucugaaaaugguggagccuuggcucagaggcaaccaauucuguaucaagauccugaaucccuauaugccuucugucguggaaacccuugagcagaugcagcgcaagcacggcgggaugcugguucggaacccccucuccagaaauagcacacaugagauguacugggugucuugcggaaccggcaacauugucuccgcugugaauaugacaagccgcaugcugcugaaccgguuuaccauggcccacagaaaaccgacguaugaacgcgauguggaccucggggcgggaaccagacacgucgccguugagccugaaguggcuaaccuggauaucauuggccagcggaucgagaauauuaagcaugaacacaaaucuacauggcauuacgacgaggauaaccccuauaagaccugggccuaccacggguccuaugaggugaaacccagcggauccgcuagcucuauggucaauggcgugguuaaacuucugacaaagccuugggacgugauccccauggucacccaaaucgccaugacagauaccacgccuuucggccagcagcgcguguuuaaagaaaagguugacacaagaaccccgaaagcuaagcgggggaccgcccaaauuauggaggugacagcgagauggcucuggggauuccugagccggaacaaaaagccccgcaucuguacgagagaagaguuuacccggaagguccgcuccaaugccgcuauuggcgccguguucguugacgaaaaccaguggaacucugcuaaagaggccguggaggaugaaagauuuugggaccuuguccaucgggagcgcgaacugcacaagcaggggaaaugcgccacaugcguguacaacaugaugggaaagagagagaaaaagcucggcgaguucgggaaggcgaaaggcagccgggcuaucugguacauguggcugggagcccgcuuucuggaguucgaggcccucggcuucaugaaugaagaucacugguuuuccagagagaacucucugagcggggucgaaggagagggccuucauaagcugggguauauucuccgggacaucuccaaaaucccuggaggcaauauguacgcugaugacaccgccgggugggauacacgcauuaccgaggacgaucugcagaacgaagcuaagaucacagacauuauggagcccgaacacgcccuucuggcgaccucuaucuucaaacucacguaucaaaauaaggugguuagagugcagcggccugcccgcaacggcaccgucauggaugugauuagcagacgggaccagagaggauccggccagguggggacauacggacugaauaccuuuacaaacauggaggcucaacugauccgccagauggaaagcgagggcaucuucucucccuccgagcucgaaaccccgaaccuggccgagcggguucuugauuggcuggaaaaacaugggguggagagacucaagcgcauggcuauuagcggagacgacugugucgugaagccuaucgaugaccgguuugccacggcgcugucugcccuuaaugauaugggcaaaguuagaaaggacauuccccagugggaaccuuccaaaggguggaacgauuggcagcaagugcccuucugcagccaccacuuucaucagcugaucaugaaggacggccgcgagauugucgugccuugucggaaucaggaugagcucgucggcagagcucgcgugucccagggcgccggguggucucugcgggaaacagcuugccugggaaaaagcuaugcccaaauguggcagcucauguacuuccacagacgcgaccugcggcuugcugccaacgcgaucuguuccgccguucccguggauugggucccgaccagcagaacaaccuggucuauucaugcucaccaucaguggaugacgaccgaggacaugcuguccguguggaaucggguuuggaucgaagagaacccuuggauggaagauaagacacacaucagcucuuggggcgacgugcccuaucucgggaagagagaggaccaauggugcggaagccugauuggccuuaccgcccgcgccacaugggcuaccaauauccaggucgccauuaaccaggugcggagacugaucgggaaugagaacuaccucgauuacaugacauccaugaaacgcuuuaagaaugaaucugaccccgagggcgcgcugugguga

SEQ ID NO: 18999 - RNA, 9879 nt, Artificial Sequence
  derived and/or modified CDS sequence (opt5) from DENV-1__FJ882542__SS-prME
agcgugaccaugcugcucaugcugaugcccaccgcccuugcuuuccaccugacgacccggggcggggagccucauaugaucgugacaaagcaggaacggggaaaaucccuccuguuuaagaccucugccggcguuaauaugugcacccuuauugccauggaccugggggagcucugugaagauaccaugacauacaaaugcccgcgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacguccagaauaccaccuuuaucaucgaugggccuuccacacccgaauguccugacgaucagagagcuuggaacauuugggagguugaggacuauggauucggcaucuuuaccacgaauauuuggcugaagcugcgcgauagcuacacacaggugugcgaccaccggcuuaugucugcggccaucaaagauuccaaggcugugcaugccgacaugggcuauuggauugaaagcgagaaaaacgaaaccuggaagcucgccagagcuucuuucaucgaggucaagacauguaucuggcccaaaucccacacccuguggagcaauggggugcuggaaucugagaugauuaucccgaagauuuacggaggcccuaucagccaacauaacuaucgccccggguacuucacacagaccgccggaccuuggcaccucggcaaacuggagcuugauuuugaccugugcgaagggacgaccguuguggucgaugagcacugcggaaaucggggccccucccucagaacaaccacagugaccggcaagauuauccaugaaugguguugccggagcuguacgcugccuccccugcgcuucaaaggggaggacggaugcugguacggcauggagaucagaccgguuaaggaaaaggaggaaaaccuugugaaaucuauggucuccgcggggagcggagagguggacuccuuuucucucggccugcuguguauuagcaucaugauugaagagguuaugcgguccagauggucucgcaagaugcucaugacagggacccuggcuguguuccuucugcucaucaugggacagcugacauggaaugaucugauucggcuuugcaucauggucggcgccaacgccagcgacagaaugggcauggggaccaccuaucuggcucucauggccacauuuaaaaugcgcccuauguucgcggugggacugcucuuuagacggcugacgucccgcgaggugcuucugcucaccauuggccugucucuggucgcuagcguugaacuucccaauucccuggaggaacucggggauggacuggccaugggcaucaugauccucaagcugcuuacagacuuccaaagccaccagcugugggccacccuccugucucugacauuuauuaaaaccacgcuuucccugcauuacgcuuggaagacaauggccauggugcucagcaucgcuucucuguucccccucugucuguccaccaccagccagaagacaaccuggcuuccugugcugcuggggucucucggaugcaaaccgcugacaauguuucuuauuacggagaccaagaucuggggcagaaaauccuggccccugaacgaaggcauuauggccgucggggugguuagcauccuccuguccagccuccugaagaaugaugugccucuugcgggaccccugaucgccggcgggaugcugauugcuuguuaugucaucucuggaagcuccgccgaccucucucuggagaaagcugccgaggugagcugggaagaggaagccgagcacuccggcgcuucucauaacauucuuguugugguccaggaugacgggacaaugaagaucaaagaugaggaacgggacgauacccugacaauucuccugaaggcgacccuccuggccgugagcggagucuacccucuuuccauccccgcuacgcuguucgugugguauuuuuggcaaaagaaaaagcagcgcucuggcguucugugggacaccccuagcccucccgagguggaaagagccguccucgaugacggcaucuaccggauuaugcagcgcgggcugcuuggaagaucccaggugggcguugggguguuccaagagaacgucuuccacacaauguggcacgugacccggggagccgugcugauguaucagggcaaacgccucgaacccagcugggcuucuguuaagaaagaccugaucuccuacgggggaggcuggagacuccagggcagcuggaauacaggggaggagguccaggugauugccguggaacccggaaagaacccuaagaauguccaaaccgcgcccggcacauuuaaaacgccggagggggaagugggagcuaucgcccuggauuucaagccuggcaccucugggucccccauuguuaaccgggagggaaaaaucgugggccuuuacggcaauggggucgugacaaccagcggaaccuauguuuccgccauugcucaggccaaggcgucucaggaaggcccucugcccgagaucgaggacgaaguguuuagaaaacgcaaccugacaaucauggaucuccaucccgggagcggaaagacgcggagauaccugccugcuauuguccgcgaggccaucaagcggaaacuuagaacccugauucucgccccgacacgcgugguugcuuccgaaauggccgaggcucugaagggcaugcccauccgguaucaaaccacagccgugaaaagcgaacacaccgggaaggagauugucgaccugaugugccaugcgacguucacaaugagacuccuuucuccugugcgcgugcccaauuacaacaugaucaucauggaugaggcccacuuuaccgacccuuccagcauugcugcccggggcuauaucucuaccagagucggaaugggcgaagcugccgccauuuucaugacagcuacacccccugggagcguugaggcguuuccgcaguccaaugccgugauccaggaugaggaacgggacauucccgaacgcucuuggaacagcggauacgaguggaucacagauuucccuggcaaaaccgugugguuuguccccuccaucaagucugggaaugacauugcuaacugucugagaaagaauggaaaacgggugauccagcugagccgcaagacguucgauacagaguaucagaagaccaagaacaaugacugggacuacguugugacaaccgauauuuccgaaaugggcgccaacuuuagagccgaccgggucaucgauccuagacgcugccucaaacccgugauucugaaggacgggccggagcggguuauccuugcuggcccuaugcccgugacggucgccagcgcggcucagagacgcggacggauuggcagaaaccauaauaaggaaggggaucaguacaucuauaugggacagccccugaacaaugacgaggaucacgcccacuggaccgaggccaaaaugcuccuggacaacaucaauacaccugaaggcauuauccccgcucuguucgagccugaacgcgagaagucugccgcgauugauggggaauaccggcucagaggagaggcccgcaaaaccuucguggagcuuaugagacggggcgaccugccggucuggcuguccuauaagguggcuagcgaaggguuucaauacuccgaucgcagauggugcuucgacggcgagcggaacaaucagguucucgaagagaacauggauguggaaaucuggacaaaagagggagagcgcaagaaacugagaccccgguggcuugacgccagaaccuauucugacccucuggcucuccgcgaauuuaaggaguucgccgcuggccggagaagcguguccggggaucugauucuggaaaucggaaagcucccccagcaucuuacacagcgcgcccaaaaugcgcuggacaaccuggucaugcuccacaauucugagcagggcgggcgggccuacagacaugcuauggaggaacugccugauaccaucgagacgcuuaugcugcucgcccugauugcuguucugacaggaggcaugacccucuuuuuccuuagcggccgggggcugggaaaaaccuccaucggccugcucugugugauggccagcucugugcugcuuuggauggccuccgucgaaccccacuggauugcugcgagcaucauucuggaguuuuuccucauggugcugcugaucccggaaccugaccgccagagaacaccccaggauaaccaacucgccuauguugugaucgggcuucuguuuaugauucugaccgucgcugccaaugagaugggacuccuggagacaacgaagaaagaccuuggcaucgggcacguggccgucgaaaaccaucaccaugcuaccaugcuggauguggaccuccacccugccucugcguggacacuguacgccguugcuaccacaauuaucacccccaugaugcggcauacgauugagaauaccacagccaacaucucccugaccgcuauugccaaccaggcggccauccucaugggacuugauaagggcuggccuaucagcaaaauggacauuggcgugccccugcuggcucucgggugcuacucucaggucaauccgcugacacuuaccgccgcugugcugaugcucguugcccacuaugcuaucauuggaccuggccugcaagccaaggcgacgcgcgaagcccagaagagaacagcugccgggaucaugaaaaaccccaccguggauggaauugucgcuaucgaccuggaucccgugguguacgacgccaaguucgagaaacagcucggccagaucaugcuucugauucuguguacaagccaaauccuccugaugcggaccaccugggcccuuugcgaauccauuacacuggcgacggggccucucaccacacugugggagggaucuccgggcaaguuuuggaauaccacaaucgcuguuagcauggccaacauuuuccgcggcuccuaucuggcuggggccggacucgccuuuagccuuaugaaaucccugggcgggggaagacggggcaccggggcucagggagagacgcugggcgaaaaguggaagcgccagcucaaucagcugucuaaaagcgaguucaacaucuacaagagauccggcaucauggaagucgaccggucugaggccaaagaagggcuuaagagaggagagacaacccgccacgcggugagccggggcaccgccaaacugagaugguucguggagcgcaaucucgucaagcccgaagggaagguuauugaucugggauguggcagagggggaugguccuauuacugcgcuggccugaaaaaggugacagaggugaaaggcuauaccaaagggggaccuggccaugaggagcccaucccuauggccacauacggguggaaccucgucaaacuucacucuggaaaggacguguuuuucacgcccccugaaaaaugugauacccugcugugcgacauuggcgagagcuccccgaaucccacaaucgaggaagggagaacccuccgcguucugaagaugguggagccuuggcuucggggaaaccaauuuuguauuaagauccugaaucccuacaugccuagcgucguggaaacacucgagcagaugcagagaaaacauggcggcaugcugguucgcaacccccugucuagaaauuccacccacgagauguauugggugagcugcgggacgggaaacauugucucugcugugaauaugaccuccagaaugcuccugaaccgcuucacaauggcccaccggaagccgaccuacgaaagagauguggaccuuggcgcggggacacgccaugucgccguugagccugaaguggcuaaucuggauaucaucggacagagaauugagaacaucaaacacgaacauaagagcaccuggcacuaugacgaggauaaccccuacaaaacaugggccuaucauggcucuuacgaggugaagcccuccgggagcgcuuccagcauggucaauggagugguuaagcuccugaccaaaccuugggacgugauucccauggucacgcaaaucgccaugacagauaccaccccuuuuggccagcagcggguguucaaggaaaaaguugacacacgcacgccgaaggcuaaaagaggcaccgcccaaauuauggaggugacagcgcgguggcuuuggggguuucugucuagaaacaagaagccccggaucuguacccgcgaagaguucacaagaaaaguccggagcaaugccgcuaucggagccguguuuguugacgaaaaccaguggaacuccgcuaaggaggccguggaggaugaacgcuucugggaccucguccagaaagagagagaacugcacaagcagggcaaaugcgcgaccugcguguauaacaugauggggaagcgggagaagaaacugggagaauuuggcaaggcgaaagggucucgcgcuauuugguacauguggcucggcgccagauuccuggaguuugaggcccuuggauucaugaaugaagaucacugguucagccgggagaacucccugucuggcgucgaaggggagggacuccauaagcugggcuacauccuucgcgacauuagcaaaaucccugggggaaauauguaugcugaugacacagccggcugggauaccagaauuacggaggacgaucugcaaaacgaagcuaagaucaccgacaucauggagcccgaacacgcccuccuggcgacauccauuuuuaaacugaccuaccagaauaaggugguucgggugcagcgcccugccaagaacgggacagucauggaugugaucucuagacgggaccagcgcggcagcggacaagugggcaccuaugggcucaauacguucacaaacauggaggcucagcugauuagacagauggaauccgagggaaucuuucuucccagcgagcuggaaaccccgaaucucgccgagcggguucuggauuggcuugaaaaauacggcguggagagacugaagcgcauggcuauuucuggggacgacugugucgugaaaccuaucgaugaccgguucgccacagcgcucaccgcccugaacgauaugggaaagguuagaaaagacaucccccagugggaaccuuccaagggcuggaacgauuggcaacaggugcccuuuugcagccaucacuuccaccagcugauuaugaaggacgggcgcgagaucgucgugccuugucggaaucaggaugagcucgucggcagagcucgcgugucucaaggagccggcuggucccugcgggaaacggcuugccuugggaaaagcuaugcccagauguggcagcugauguacuuucauagacgcgaccuccggcuggcugccaacgcgauuuguuccgccguucccguggauugggucccgaccucuagaacaaccuggagcauccacgcucaucaccaauggaugacaaccgaggacaugcuuuccguguggaaucgcguuuggauugaagagaacccuuggauggaagauaagacacaugugagcucuuggggagacguccccuaucugggcaaacgggaggaccaguggugcgggucccucaucggacugaccgccagagccacgugggcuagcaauauucagguggccaucaaccaggugcggagacugaucggcaaugagaacuaccucgauuacaugacaucuaugaagcgcuucaaaaaugaaggggaccccgagggcgcgcugugguga

SEQ ID NO: 19000 - RNA, 9879 nt, Artificial Sequence
  derived and/or modified CDS sequence (opt5) from DENV-1__FJ882543__SS-prME
agcgugaccaugcugcucaugcugaugcccaccgcccuugcuuuccaccugacgacccggggcggggagccucauaugaucgucacaaagcaggaacggggaaagucccuccuguuuaagaccucugccggcguuaacaugugcacccuuauugcgauggaccugggggagcucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcauuggcaaacugguucaucagaucuucgggaccgcuuacggaguccucuuuuccggcgugagcuggacgaugaagauugggaucggcgugcugcuuaccuggcugggacucaauucuagauccacaagccugucuaugaccuguauugccgucggccuggugacacuuuaccucgggguuauggugcaggcugauuccggaugcgucaucaacuggaaaggccgcgaacugaagugugggagcggaauuuucgugaccaaugagguucacacauggaccgaacaauauaaguuucaggccgacuccccuaaacggcugucugcggccaucggcaaggcuugggaggagggggugugcggcaucagaagcgccacgcgccucgaaaacauuauguggaaacagaucuccaacgagcugaaucauauucuucuggaaaacgacaugaaguucacagucgugguuggagauguggucggcauccucgcucaggggaaaaagaugauucggccgcaacccauggagcacaaauacucuuggaaaagcuggggaaaggccaagaucaucggcgccgacgugcagaauaccaccuuuauuaucgaugggccuaacacacccgaauguccugacgaucagagagcuuggaauauuugggagguggaggacuauggauucggcaucuuuaccacgaacauuuggcugaagaugcgcgauuccuacacacaggucugcgaccaccggcugaugagcgcggccaucaaagauucuaaggcuguucaugccgacaugggcuauuggaucgaauccgagaaaaaugaaaccuggaaacuugccagagcuagcuucauugaggugaagacauguaucuggcccaaaucucacacccucugguccaacggggugcuggaaagcgagaugauuaucccgaagauuuacggaggcccuaucucucaacauaaucaccgccccggguauuucacacagaccgccggaccuuggcaccugggcaaacucgagcuggauuuugaccuuugcgaagggacgaccgucgugguugaugagcauugcggaaaccggggccccagccugagaacaaccacagugaccggcaagaucauucacgaaugguguugccgguccuguacgcucccuccccugcgcuucaaaggggaggacggaugcugguacggcauggagaucagaccggucaaggaaaaggaggaaaaucuggugaaaagcaugguuucugcgggguccggagagguggacagcuuuucccuuggccuccuguguauuucuaucaugauugaagaggucaugcggagcagauggucccgcaagaugcugaugacagggacccucgcuguguuccugcuucugaucaugggacagcucacauggaacgaucugauucggcugugcaucaugguuggcgccaaugccucugacagaaugggcauggggaccaccuaccuugcucugauggccacauuuaaaaugcgcccuauguucgcggugggacuccuguuuagacggcucacgagccgcgagguccugcuucugaccaucggccucucccugguggcuucuguggaacugcccaacagccuugaggaacugggggauggacucgccaugggcauuaugauccugaagcuccugacagacuuccaaucccaucagcuuugggccgcucugcucagccugaccuuuauuaaaacaacccugucucuucacuaugccuggaagacgauggcuaugguccuguccaucguuagccucauuccccugugucucucuacaaccucccagaagaccacauggcugccugugcuucuggggagccugggaugcaaaccgcucaccauguuccugaucgccgagaauaagaucuggggcagaaaaucuuggccccuuaacgaaggcauuauggcggugggggucguguccauccugcucagcucccugcucaagaacgauguuccucuggccggaccccuuauugcuggcgggaugcugaucgccuguuacgugauuagcggaucuagcgcugaccugucccucgagaaagccgccgaggucucuugggaagaggaagcugagcauagcggcgcgucccacaauauccugguggaaguucaggaugacgggacaaugaagaucaaagaugaggagcgggacgauacgcuuaccauucugcucaaggccacacugcucgcugugucuggagucuauccucugagcauccccgccacccuuuuugugugguacuucuggcaaaagaaaaagcagcgcuccggcguccugugggacacaccuucucccccggaaguggagagagccguucuggaugacggcauuuaucggaucaugcagcgcgggcuccugggaagaagccaggugggcgucgggguguuucaagaaaacguuuuccacaccauguggcaugugacgcggggagcuguccuuauguaccagggcaaacgccuggagccuuccugggccagcgugaagaaagaccucauuucuuaugggggaggcuggagacugcagggcuccuggaauaccggggaggaagugcagguuaucgcggucgagcccggaaagaacccuaagaaugugcaaacagcucccggcaccuucaaaacaccggaaggggaggugggagccauugcccucgauuuuaagccuggcaccagcgggucucccaucgucaaccgggaaggaaaaaucgugggccuguacggcaaugggguugugacaacguccggaaccuacgucagcgcuauugcccaggcgaaggcuucccaggagggcccucuucccgagaucgaagacgagguguucagaaaacgcaaccugacaauuauggaucugcaccccgggucuggaaagacccggagauaucucccugccaucguucgcgaagccauuaagcggaaacugagaacccuuauccuggcuccgacacgcguggucgccagcgagauggcugaagcccucaagggcaugcccauccgguaccaaacgaccgcggugaaauccgagcauacagggaaggagauuguugaccugaugugccacgccaccuuuacaaugagacugcucagcccugugcgcguccccaauuauaacaugaucauuauggaugaagcucauuucaccgacccuucuuccaucgccgcucggggcuacauuagcacgagagugggaaugggcgaggccgccgcuaucuuuaugacagcgacacccccugggucuguggaagccuucccgcagagcaaugcugucauccaggaugaggaacgggacauucccgagcgcuccuggaacucuggauaugaguggaucaccgauuuucuuggcaaaacaguuugguucgugccuagcauuaaguccgggaaugacaucgccaacugucugagaaagaauggaaaacgggugauucagcugucucgcaagaccuuugauacagaauaccagaagaccaagaacaacgacugggacuaugucgugacgacagauaucagcgagaugggcgccaauuucagagcugaccggguuauugaucccagacgcugccucaaaccugugauccugaaggacgggcccgaacgggucauccuugccggcccgaugccugugaccguugcguccgcugcccagagacgcggacggauuggcagaaaccacaauaaggagggggaucaguacaucuacaugggacagccccugaacaaugacgaggaucacgcccauuggacagaagcuaaaaugcuccuggacaacauuaauacccccgagggcaucauuccugcccuguuugaacccgagcgcgaaaagagcgcggccaucgauggggaguaucggcucagaggagaggcucgcaaaacguucguggaacuuaugagacggggcgaccugccugucuggcugucuuacaagguggccuccgagggguuccaauauagcgaucgcagauggugcuuugacggcgaacggaacaaucagguccucgaggaaaacauggauguggagaucuggaccaaagagggagaacgcaagaaacugagaccgcgguggcuugacgcuagaacauacuccgacccccuggcccuccgcgaguucaaggaauuugcugccggccggagaucuguuagcggggaucugauucuggagaucggaaagcucccucagcaccuuacccagcgcgcgcaaaaugcccuggacaaccuggugaugcuccauaauuccgaacagggcgggcgggcuuauagacacgccauggaggagcugcccgauacaauugaaacccuuaugcugcucgcucugaucgccgugcugacaggaggcgucacccucuucuuucuuucuggccgggggcugggaaaaacgagcauuggccugcucuguguuauggccuccagcgugcugcuuuggauggcuucuguggagccucacuggaucgcggccuccaucauucuggaguucuuucucaugguccugcugauccccgagccggaccgccagagaacaccucaggauaaccaacucgcuuacgugguuauugggcuucuguucaugauccugaccguggccgccaaugagaugggacuccuggaaaccacaaagaaagaccuuggcauugggcaugucgcuguggagaaccaccaucacgccaccaugcuggaugucgaccuccaucccgcgagcgccuggacacuguaugcuguggccacgaccaucauuacaccuaugaugcggcacaccaucgaaaacacaaccgcuaauaucucucugacggccauugcgaaccaggccgcuauccucaugggacuugauaagggcuggcccauuuccaaaauggacaucggcguuccucugcuggcccucgggugcuacagccaggugaauccccugacccuuacagcugccguccugaugcucguggcucacuacgccauuaucggaccgggccugcaagcgaaggccacccgcgaggcucagaagagaacagccgcugggaucaugaaaaacccuaccguugauggaauuguggccaucgaccuggaucccgucguguaugacgccaaguuugaaaaacagcucggccagauuaugcuucugauccuguguacgucucaaauucuccugaugcggacaaccugggcgcuuugcgagagcaucacacuggcuaccgggccccucaccacacugugggagggauccccuggcaaguucuggaauacgaccaucgccgugucuauggcuaacauuuuucgcggcagcuaccuggccggggccggacucgcuuucucccuuaugaaaagccugggcgggggaagacggggcacaggggcccagggagaaacccugggcgagaaguggaagcgccagcucaaucagcuguccaaaucugaauuuaacaucuauaagagaagcggcauuauggagguugaccgguccgaagcgaaagaggggcuuaagagaggagagacaacccgccaugccgucucucggggcacggcuaaacugagaugguucguggaacgcaaucucgugaagccggaggggaaggucaucgaucugggauguggcagagggggauggagcuacuauugcgccggccugaaaaagguuacagaagugaaaggcuacaccaaagggggacccggccacgaggaaccuauucccauggcuaccuauggguggaaccucgugaaacuucauuccggaaaggacgucuucuuuacaccucccgagaaaugugauacccugcugugcgacaucggcgagucuagcccuaauccgacaauugaagaggggagaacgcuccgcgugcugaagaugguugaacccuggcuucggggaaaccaauucuguaucaagauccugaauccuuacaugcccuccguggucgagacccucgagcagaugcagagaaaacacggcggcaugcuggugcgcaacccucugagcagaaauucuacacacgaaauguacuggguuuccugcgggaccggaaacauugugagcgccgucaauaugacaucuagaaugcuccugaaccgcuuuaccauggcgcaucggaagcccacguaugagaaagauguggaccuuggcgccgggaccagacacguggcugucgaaccggagguugccaaccuggauaucauuggacagcgcaucgaaaauauuaagcaugagcacaaauccacauggcauuacgacgaggauaacccuuauaagaccugggcuuaccacggcagcuaugaagugaagcccucuggguccgccagcuccauggugaauggagucgugaaacuccugacaaagcccugggacguuaucccuauggugacccaaaucgcuaugacagauaccacgcccuucggccagcagagagucuuuaaagagaagguggacacacggaccccuaaagccaagcgcggcaccguucaaauuauggaagugacagcgagauggcuuuggggguuccugagccggaacaagaaaccgagaaucuguacgcgggaggaauuuacccgcaaggucagaucuaaugccgcuauuggagccguguucguugacgagaaccaguggaauagcgcuaaagaggccguggaagaugagcgguuuugggaccucgucaagaaagaacgcgagcugcacaagcagggcaagugcgccacaugcguguacaacaugauggggaaaagagaaaagaaacugggagaguucggcaaggcgaaagggucccgggcuaucugguauauguggcucggcgcccgcuuucuggaguucgaagcccuuggauuuaugaaugaggaucauugguucucuagagaaaacagccuguccggcgucgagggggagggacuccacaagcugggcuacauucuucgggacaucucuaaaauccccgggggaaauauguacgcugaugacaccgccggcugggauacacgcauuaccgaagacgaucugcagaacgaggcuaagaucacagacauuauggaaccugagcaugcccuccuggcgaccagcaucuucaagcugacguaucaaaauaaagugguuagagugcagcggcccgccaagaacgggaccgucauggaugugauuucccgcagagaccagcggggcucuggacaggugggcacauacgggcucaauaccuuuacaaacauggaagcucaacugauccgccagauggagagcgagggaaucuuccuuccuuccgaacuggagacccccaaccucgccgaaagaguucuggauuggcuugagaaauauggcguggaacggcugaagagaauggcuauuagcggggacgacugugucgugaaaccgaucgaugaccgcuuugccacggcgcucacagcccugaaugauaugggaaagguucggaaggacauuccucagugggagcccucuaaaggcuggaacgauuggcagcaagugccuuucugcucccaccacuuucaucagcugaucaugaaggacgggagagagauugucgugcccugucgcaaucaggaugaacucgucggccgggcuagagugagccagggagccggcuggucucugcgcgagaccgcuugccuugggaaauccuacgcccaaauguggcagcugauguauuuccaccggagagaccuccgccuggcugccaacgcgaucuguagcgccguuccuguggauuggguccccacaucccggaccacguggucuauucaugcucaccaucaguggaugaccacagaagacaugcuuagcguguggaauagaguuuggaucgaggaaaacccguggauggaggauaagacccacguguccagcugggaggacgucccuuaccugggaaaacgcgaagaccaauggugcggcucucucaucgggcugacagcccgggccaccugggcuuccaauauucagguggccaucaaccaggugagacggcugauuggaaaugagaacuaucucgauuacaugacaagcaugaagagauuuaagaaugaaggcgaccccgagggggcgcugugguga

SEQ ID NO: 19001 - RNA, 9879 nt, Artificial Sequence
  derived and/or modified CDS sequence (opt5) from DENV-1__FJ882544__SS-prME
uccgugaccaugcugcucaugcugaugcccacagcccuugcuuuccaccugacgacccggggaggggaaccucauaugaucgucuccaagcaggaacgggggaaaucucuccuguuuaagacaagcgccggcguuaacaugugcacccuuaucgcgauggaccugggggaacucugugaagauacaaugaccuacaaaugcccgcgcaucacagagaccgaacccgacgauguggacuguuggugcaaugcuacggauaccugggugacauaugggaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggaaccgggauuuuguugagggacuguccggcgcuacguggguggacgucgugcucgagcacgggagcugugugaccacaauggccaaggauaaacccacccuggacaucgaacugcucaagacagaggucaccaauccugcuguucugcgcaaacuuugcauugaagccaagaucucuaacacgacaaccgauuccagauguccgacccaaggagaggcgacacugguggaagaacaagacgccaauuucgugugccggcgcaccuuugucgauagaggcuggggcaacggguguggacucuucggcaaagggagccugauuacaugcgcuaaguuuaagugcgugacgaaacuugagggaaagaucguucaguacgaaaaucugaaauauucugugaucgucaccgugcacacaggcgaccagcaucaaguugggaacgaguccaccgaacacggaacaaccgccacgauuacaccccaagcuccuaccaccgagauccagcucacagacuacggcgcccugacccuggauuguagcccccggacgggccucgacuucaaugaaauggugcugcuuacaaugaaggagaaaucuuggcugguccauaagcagugguuucucgaucugccucuucccuggaccuccggggccagcacaucccaagagaccuggaaccgccaggaccugcucgugaccuucaaaacagcucacgcgaagaagcaggaagucgugguucugggaucucaagagggcgccaugcacacggcucugaccggggccacagaaauucagaccagcggaacaaccacgaucuuugccggccaucucaaaugcagacugaagauggauaaacuuacacugaaggggauguccuaugugauguguaccggcagcuucaaacucgagaaggaagucgcugagacccagcacggaacagugcugguucagauuaaguacgagggcaccgacgccccgugcaaaaucccuuucucuacacaagaugaaaagggggugacgcagaauggacggcugaucaccgcgaaccccauugucacagacaaaggcaagccugugaauaucgaggcugaaccgcccuuuggggaguccuauauugugaucggagccggcgagaaagcccuuaagcucagcugguucaagaaagggucuagcauuggcaagauguuugaagcuaccgccagaggagcucgccggauggccauccugggcgauacagcgugggacuucggguccaucggaggcguuuuuaccucugucgggaaacuggugcaucagauuuucggaacggccuacggcgugcucuuuagcggggucuccuggaccaugaagaucggcauuggagugcugcuuacauggcugggccucaacagcagaucuaccucccugagcaugacauguaucgcuguugggcuggugacccuuuaccucggagucauggugcaggccgauucuggcugcguuauuaauuggaaagggcgcgagcugaaguguggauccggcaucuucgugacaaacgaaguccacaccuggacggagcaauauaaguuucaggcugacagcccuaaacggcuguccgccgcgauugggaaggccugggaagagggcgugugcggaaucagaucugcuacacgccucgagaacaucauguggaaacagauuagcaaugaacugaaccauauccuucuggagaaugacaugaaguucaccguuguggucggcgauguggccgggauucucgcucagggcaagaagaugauccggccgcaacccauggaauacaaauauuccuggaagucuuggggcaaggccaaaauuaucggggccgacgugcagaacaccacauuuaucauugauggaccuaauacccccgaguguccugacgaucagagagcuuggaacaucugggaagucgaggacuacggcuucggcauuuuuacgacaaauaucuggcugaagcugcgcgauagcuauacccagguuugcgaccaccggcuuauguccgcggccauuaaagauagcaaggcugugcacgccgacaugggguacuggaucgagucugagaaaaaugagacauggaagcucgccagagcuuccuucaucgaagugaagaccuguauuuggcccaaaagccauacacuguggucuaauggaguccuggaguccgaaaugaucauuccgaagaucuauggcgggccuauuagccaacacaacuaccgccccggauacuucacccagacggccggcccuuggcaucucgggaaacuggagcuugauuuugaccugugcgagggaaccacagugguuguggaugaacacugcggcaaucggggccccucucucagaaccacaaccgucacggggaagaucauccacgagugguguugccggagcuguacacugccuccccugcgcuucagaggagaagacggcugcugguaugggauggagauucggccggugaaagagaaggaagagaaccuuguuaaguccauggugagcgcgggaucuggcgaagucgacuccuuuagccucgggcugcuguguaucuccauuaugaucgaggaagugaugagaucucgcuggagccggaaaaugcucaugaccggaacacuggcuguuuucuuucuucugauuaugggccagcucaccuggaaugaucugaucagacugugcauuauggugggcgccaacgccuccgaccgcauggggaugggaaccacauaccuugcucugauggccacguucaagaugagaccuauguuugcggucggccuccuguuccggcgccucaccucuagagaggugcugcuucugacaaucgggcucagccugguggcuuccgucgagcugcccaauucucuugaagaacugggagauggccucgccauggggaucaugauucugaaacuccugaccgacuuucaaagccaucagcuuugggccacacugcucucccugaccuucaucaagacgacauuuagccugcacuaugcuuggaaaaccauggccaugguucuuucuauugugucccuguucccccucugucugagcaccacaucucagaagaccacauggcucccugugcugcuuggaucccugggcugcaagccgcugacgauguuucucaucgcugaaaacaaaauuuggggccggcgcagcuggccccugaacgaggggaucauggccgucggaaucgugucuauucuucuguccagccuccugaagaaugauguuccucucgcgggcccccugaucgccgggggaaugcuuauugcuuguuacgugaucuccggcagcucugccgaccugagccuggaaaaagcugccgaggucuccugggaggaagaggccgaacauucuggggcuagccacaacauucucguggagguucaggaugacggaaccaugaagaucaaagaugaagagagagacgauacacugaccauccuucugaaggcgacacuccuggccguguccggcgucuauccucucucuauucccgcuacccuguucgugugguacuucuggcagaaaaagaagcagcggagcggcguccuuugggacacgccuagcccucccgagguggggcgcgccguucuggaugacggaaucuauagaauuaugcagcggggccugcucgggcgcucucaggugggagucggcguguuucaagaaaauguuuuccauaccauguggcacgugacaagaggggccguccugauguaccagggaaaacggcuugagcccagcugggcuuccgugaagaaagaccugaucagcuacggcggcggguggagacuccagggaucuuggaacaccggcgaagaggugcagguuauugccgucgagcccgggaagaauccuaaaaacgugcaaacagcgcccggaaccuuuaagacaccggaaggcgaggugggggcuaucgcccuggauuucaagccuggaacguccggcagccccauugucaaucgcgaaggcaaaaucguggggcucuauggaaacggcguugugaccacaucugggaccuacgucuccgccaucgcucaggccaaggcgagccaggagggaccucugcccgaaauugaggacgagguguuucggaaaagaaaucuuaccaucauggaucugcaccccggcuccgggaagacacgccgguaucugccugcuauuguuagagaagccaucaaacgcaagcuccggacgcugauucuugccccgaccagaguggucgcuucugagauggccgaagcucugaagggcaugcccauccgcuaccaaacaaccgccgugaaaagcgagcauacaggaaaggaaaucguugaccucaugugccacgcgaccuucacgaugcggcugcuguccccugugagaguccccaacuauaauaugauuaucauggaugaggcccauuuuacagacccuagcucuauugcugcccggggcuacaucuccacccgcguggggaugggagaggcugccgccauuuucaugaccgcuacacccccuggcagcguggaagcguuuccgcagucuaacgccgucauccaggaugaggaaagagacauccccgagcggagcuggaacuccggguaugaauggauuaccgauuucccuggaaaaacaguuugguuugugcccucuaucaagagcggcaacgacauugcuaauugucuccgcaaaaacgggaagagagugauccagcuuucccggaagaccuucgauacggaguaccagaaaaccaagaacaaugacugggacuacgucgugaccacagauauuucugagaugggcgccaacuucagagccgaccgcguuaucgauccucggagaugccugaaacccgugauucugaaggacggaccggaacgcgucauccucgcuggcccuaugcccgugaccguugccagcgcggcucagcggagagggcgcaucggacggaaucacaacaaagagggcgaucaguauauuuacauggggcagccccugaauaacgacgaagaucaugcccacuggacggaggccaagaugcuucuggacaauaucaacaccccugagggaauuauccccgcucucuuugaaccugagagagaaaaguccgccgcgauugauggcgaguaucgccugagaggggaagcccggaaaacauucguggagcugaugcgcagaggcgaccucccggucuggcuuagcuacaagguggcuucugagggauuucaauauuccgaucggcgcuggugcuucgacggcgaaagaaauaaccagguccuggaggaaaauauggauguggagaucuggaccaaagaaggggagcggaagaaacugagaccccgcuggcucgacgcccggacauacagcgacccucuggcucuuagagaguuuaaggaguucgccgcuggacgccgguccguuucuggcgaucugauccucgagauugggaaacugccccagcaccugacccagagagcccaaaacgcgcucgacaaucuugugaugcugcauaacagcgaacagggaggccgggccuaucgccacgcuauggaggaacugccugauacaaucgagacccucaugcugcuugcccugauugcugugcucacgggcggggucacacuguuuuuccuguccggaagaggccucgggaagaccucuaucggacuucuguguguuauggccagcuccgugcugcucuggauggccagcguggagccccauuggauugcugcgucuaucauccuggaauuuuuccuuaugguccugcucauuccggagccugaccggcagcgcacaccccaggauaaucaacuggccuacgugguuaucggccugcucuuuaugauucuuacaguggcugccaacgaaauggggcugcuggagaccacaaagaaagaccucggaaucggccacgucgccguggagaaccaccaucacgcugccaugcuggaugucgaccuucauccugcguccgccuggacgcuguacgcuguggccaccacaauuaucacccccaugaugagacacacaauugaaaauaccacggcuaacaucagccucaccgccaucgcgaaucaggccgcuauucugaugggccuggauaagggguggccuaucucuaaaauggacauuggaguuccccuccuugcccugggcugcuauucccaggugaacccgcugacacucaccgcugccguccugaugcuuguggcucauuacgccaucauugggccuggacugcaagcgaaggccacacgggaggcucagaaacgcaccgccgcuggcaucaugaagaaucccacgguugaugggaucguggccauugaccucgaucccgucguguaugacgccaaguucgaaaaacagcugggacagaucaugcugcucauucuuuguacaagccaaauccugcugaugagaaccacaugggcgcucugcgagucuauuacccuggcuaccggcccucuuacaacgcugugggaaggcagcccggggaaguuuuggaacaccacaaucgccguguccauggcuaauaucuuccggggaucuuaccucgccggcgccgggcuggcuuucagccugaugaaaucccucggaggcgggcgcagaggaaccggcgcccagggcgagacacuuggggagaaguggaaacggcagcugaaccagcugagcaaguccgaauuuaauaccuauaagagaucuggaauuauggagguugaccgcagcgaagcgaaagagggccucaagagaggggaaacgacaaaacacgccgucuccagaggaaccgcuaagcugcgcugguucguggagcggaaccuugugaaacccgagggcaaggucaucgaucugggguguggaagaggcggcuggucuuacuauugcgccgggcucaagaaaguuaccgaagugaagggauacacaaaaggcgggccuggacacgaggaacccauuccuauggcuaccuacggcuggaaucuggugaagcugcauagcgggaaagacgucuuuuucauucccccugagaagugugauacacuccuuugcgacauuggagaauccucuccgaaccccacgaucgaggagggccgcacccugcgggugcugaaaaugguugaaccuuggcucagaggcaaucaauuuuguauuaagauccugaaccccuauaugccuagcguggucgagacacuugaacagaugcagcgcaagcacgggggaaugcuggugcggaauccccucuccagaaacagcacccaugagauguacuggguuucuugcggcacagggaauaucguguccgccgucaacaugaccagccgcaugcugcugaaccgguucacgauggcgcacagaaaaccgaccuaugagcgcgauguggaccucggagccggcacaagacacguggcugucgaaccugagguugccaaucuggauauuaucgggcagcggauugaaaacaucaagcaugagcacaaaucuaccuggcauuacgacgaagauaaucccuauaagacaugggcuuaccacggauccuaugaggugaaacccagcggcucugccuccagcauggugaacggcgucgugaaacuucugaccaagccuugggacguuauucccauggugacacaaaucgcuaugaccgauacgacaccuuuugggcagcagcgcgucuucaaagagaagguggacaccagaaccccgaaagccaagcggggaacagcgcaaaucauggaaguuacggccaaauggcucuggggcuuucuguccagaaauaagaagccccggauuuguacccgcgaggaguucacaagaaaagugcggagcaacgcugccaucggggcugucuuuguggacgagaaucaguggaacucugccaaggaagccguugaggaugagcgcuucugggaccuugugcauagagaacgggagcugcacaaacagggaaagugcgcgaccugcgucuacaauaugaugggcaaacgcgaaaagaagcucggggaguuuggcaaagcuaagggaagcagagccauuugguacauguggcugggcgcccgguuccuggaguucgaggcucucggguuuaugaacgaggaucacugguucucccgcgaaaauucucugagcggaguggagggcgaagggcuucauaaacugggauauauccucagagacauuuccaacaucccuggcgggaauauguacgccgaugacacagcuggcugggauacccggaucacagaggacgaucugcagaacgaggcccgcauuaccgacaucauggaacccgagcacgcgcuucuggccaagucuauuuuuaaacucacguaucaaaauaaggucgugagaguucagcggccugcuaaaaacggaaccgugauggaugucaucagccgcagagaccagcggggcuccggacaggugggaacauacggccugaacaccuucacaaauauggaagcccaacugauuagacagauggagucugaagggaucuuuagccccuccgagcucgagaccccgaaccuggcugaacgcgugcuugauuggcuggagaaguauggaguugaacggcucaagagaauggccaucagcggcgacgacuguguggucaaaccuauugaugaccgcuucgcgacggcccugacagcucuuaaugauauggggaaggugcggaaagacaucccccagugggagccuucuaagggcuggaacgauuggcagcaaguucccuuuugcucccaucacuuccaccagcugauuaugaaagacggaagagaaaucguggucccuugucgcaaucaggaugagcucgugggccgggccagagucagccagggggcuggauggucucugcgcgagaccgccugccugggcaaguccuacgcucaaauguggcagcucauguauuuucaucggagagaccugcgccuugccgcgaacgccauuuguagcgcugugcccguugauuggaucccgacaucccggaccacguggucuauucacgcccaucaccaguggaugaccacagaagacaugcugagcguguggaauagagucuggaucgaggaaaacccuuggauggaggauaagacccauaucuccagcuggggagacgugcccuaccucggaaaacgggaagaccaauggugcggcucucugauugggcuuacagccagagcuaccugggccacaaauauccagguugcgauuaaccaggugcgccggcugaucggcaaugagaacuaccucgauuauaugaccuccaugaagagauucaaaaaugagagcgaccccgaaggagcucugugguga

SEQ ID NO: 19002 - RNA, 9879 nt, Artificial Sequence
  derived and/or modified CDS sequence (opt5) from DENV-1__FJ898371__SS-prME
uccgugaccaugcugcucaugcugaugcccaccgcccuugcuuuccaccugacgaccagaggcggggaaccucauaugaucgucaccaagcaggaacggggaaagucccuucuguuuaagaccucugccggcguuaauaugugcacccuuauugccauggaccugggggaacucugugaagauaccaugacauacaagugcccgcgcaucaccgaggcugaacccgacgauguggacuguuggugcaaugccacggauaccugggugacauauggaaccuguagccagacaggcgagcaccggcgggacaagcgcuccgucgcccuggcuccucauguggggcugggacucgagaccagaacggaaacauggaugucuagcgagggcgccuggaagcagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaagcccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuuccugacccaagaugaaaaggggguuacacagaacggacggcuuaucacggcuaaucccauugugaccgacaaagagaagccugucaacaucgaagccgagccgcccuuuggcgaguccuauauugugaucggggccggagaaaaagcucucaagcugagcugguucaagaaaggcucuagcauugggaagauguuugaggccacagcuagaggcgcccgccggauggcgauccugggagauaccgccugggacuucggcuccaucgggggaguguuuacaucuguuggcaaacucguccaucagauuuucgggaccgcuuacggagugcuguuuagcggcguguccuggacgaugaagaucgggauuggcguccuucugaccuggcucggacugaauagcagaucuacaucccugagcaugaccuguaucgccgugggccuuguuacacucuaccugggggugaugguccaggcugauucuggaugcgugauuaacuggaaaggccgcgaacugaaguguggguccggaaucuucguuaccaaugaggugcacacauggaccgaacaauauaaguuucaggccgacagcccuaaacggcucuccgcggccauuggcaaggcuugggaggagggggucugcggcaucagaucugccacgcgccuggaaaacaucauguggaaacagauuagcaacgagcuuaaucauauccugcucgaaaacgacaugaaguucacagugguugugggagaugucgugggcauucuggcucaggggaaaaagaugauccggccgcaacccauggagcacaaauacuccuggaagucuuggggaaaggccaaaauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaaacuucgcgauagccacacacagguuugcgaccaucggcucauguccgcggccauuaaagauagcaaggcugugcacgccgacaugggcuacuggaucgaaucugagaaaaaugaaaccuggaagcuggccagagcuuccuucaucgaggugaagacauguauuuggcccaaaagccauacccuguggucuaacgggguccucgaauccgagaugaucauuccgaagaucuauggaggcccuauuagccaacacaauuaccgccccggguauuucacacagaccgccggaccuuggcaccugggcaaacuugagcuggauuuugaccucugcgaagggacgaccgugguuguggaugagcauugcggaaaccggggccccucucugagaacaaccacagucaccggcaagaucauccacgaaugguguugccggagcuguacgcugccuccccuucgcuucaaaggggaggacggaugcugguacggcauggagauuagaccggugaaggaaaaggaggaaaaucucguuaaauccauggugagcgcggggucuggagaggucgacuccuuuagccugggccugcucuguaucuccauuaugaucgaagaggugaugcggucuagauggagccgcaagaugcugaugacagggacccuugcuguuuuccugcuccugauuaugggacagcugacauggaacgaucuuauccggcugugcauuauggugggcgccaaugccuccgacagaaugggcauggggaccaccuaccucgcucugauggccacauuuaaaaugcgcccuauguucgcggucggacuccuguuuagacggcuuacgucucgcgaggugcugcuccugaccaucggccugagccuuguggcuuccgucgaacugcccaacucucucgaggaacugggggauggacucgccaugggcaucaugauucugaaacuucugacagacuuccaaagccaucagcucugggccacccugcugucccuuacauuuaucaaaaccacgcugagccuccacuaugcuuggaagacaauggccaugguucugucuauugugucccucuucccccugugucuuagcaccaccucucagaagacaaccuggcugccugugcugcucgggucccugggaugcaaaccgcuuacaauguuucugaucgcugagaauaagauuuggggcagaaaaagcuggccccucaacgaaggcaucauggccgucggggugguuucuauccugcucuccagccugcuuaagaacgaugugccucuggcgggaccccugauugccggcgggaugcucaucgcuuguuacgucauuuccggaagcucugccgaccugagccuugagaaagcugccgagguguccugggaagaggaagccgagcauucuggcgcuagccacaauauccugguugaagugcaggaugacgggacgaugaagauuaaagaugaggagcgggacgauacccucacaauccugcucaaggcgacccugcuugccgucuccggaguguauccucugucuauccccgcuacacuguucgucugguacuuuuggcaaaagaaaaagcagcgcagcggcgugcucugggacaccccuagcccucccgaaguugagagagccgugcuggaugacggcauuuaucggaucaugcagcgcgggcuucugggaagaucucaggucggcguggggguuuuccaagaaaacguguuccacacgauguggcaugucacccggggagccgugcucauguaccagggcaaacgccuggagcccagcugggcuuccgugaagaaagaccucauuagcuaugggggaggcuggagacugcagggcucuuggaauacaggggaggaaguucaggucaucgccguggagcccggaaagaacccuaagaaugugcaaaccgcgcccggcacauuuaaaaccccggaaggggaggucggagcuauugcccuugauuucaagccuggcacauccgggagccccaucgugaaccgggaaggaaaaauuguuggccuguacggcaaugggguggucacgaccucuggaacauacguguccgccaucgcucaggccaaggcgagccaggagggcccucugcccgagaucgaagacgagguuuuuagaaaacgcaaccucaccauuauggaucugcaccccggguccggaaagacccggagauaucuuccugcuaucgugcgcgaagccauuaagcggaaacugagaacacucauccuggccccgacgcgcgucguggcuucugagauggccgaagcucugaagggcaugcccauucgguaccaaaccacagccguuaaaagcgagcauaccgggaaggagaucguggaccucaugugccacgcgacauucaccaugagacuucuguccccuguccgcgugcccaauuauaacaugaucauuauggaugaagcccauuuuacggacccuagcucuaucgcugcccggggcuacauuuccacaagagugggaaugggcgaggcugccgccaucuucaugaccgcuacacccccugggagcgucgaagcguuuccgcagucuaaugccguuauucaggaugaggaacgggacauccccgagcgcagcuggaacuccggauaugaguggaucacagauuucccuggcaaaaccgugugguuugugcccucuauuaagagcgggaaugacaucgcuaacugucugagaaagaauggaaaacgggucauucagcucucccgcaagacauucgauaccgaauaccagaagacgaagaacaacgacugggacuaugugguuacaaccgauaucucugagaugggcgccaauuuuagagccgaccgggugauugauccuagacgcugccugaaacccgucauccuuaaggacgggccggaacgggugauucuggcuggcccuaugcccguuacaguggccagcgcggcucagagacgcggacggaucggcagaaaccacaauaaggagggggaucaguacaucuacaugggacagccccucaacaaugacgaggaucacgcccauuggaccgaagccaaaaugcugcuggacaacauuaauacgccugagggcaucauucccgcucucuucgaaccugagcgcgaaaaguccgccgcgaucgauggggaguaucggcuuagaggagaggcccgcaaaaccuucgucgaacugaugagacggggcgaccugccgguguggcucagcuacaaggucgcuucugagggguuucaauauuccgaucgcagauggugcuucgacggcgaacggaacaaucaggugcuggaggaaaacauggauguugagauuuggacaaaagagggagaacgcaagaaacuuagaccccgguggcuggacgccagaaccuacagcgacccucucgcucugcgcgaguuuaaggaguucgccgcuggccggagauccgugucuggggaucugauccucgagaucggaaaacuuccccagcaccugacacagcgcgcccaaaaugcgcuggacaaccucgugaugcugcauaauagcgaacagggcgggcgggccuauagacacgcuauggaggagcuuccugauaccauugaaacacugaugcuccuggcccugaucgcuguccucaccggaggcguuacgcucuuuuuccuguccggccgggggcugggaaaaacaucuauuggccuccugugugugauggccagcuccgugcuucuguggauggccagcgucgagccccacuggaucgcugcgucuauuauccucgaauuuuuccugauggugcugcucaucccggagccugaccgccagagaacaccccaggauaaccaacuugccuacguugugauugggcugcuguuuaugauccucaccgucgcugccaaugagaugggacugcuugaaacaaccaagaaagaccugggcauugggcauguggccgucgagaaccaccaucacgcuacaaugcucgauguggaccugcauccugccuccgcguggacgcuguaugccguugcuaccacaaucauuacccccaugaugcggcacacaaucgaaaacaccacggccaauauuagccucaccgcuaucgccaaccaggcggccauccuuaugggacuggauaagggcuggccuauuucuaaaauggacaucggcgugccccugcucgcucuggggugcuacucccaggucaauccgcuuacacugaccgccgcugugcucaugcugguugcccacuacgcuauuaucggaccuggccugcaagccaaggcgacacgcgaggcccagaagagaaccgcugccgggauuaugaaaaaccccacgguggauggaaucgucgcuaucgaccucgaucccgugguguaugacgccaaguucgaaaaacagcuuggccagauuaugcugcugauccucuguacaagccaaauucugcuuaugcggaccacaugggcccugugcgagucuaucacccucgcgaccgggccucugacaacgcugugggagggaagcccgggcaaguuuuggaauaccacaauugcuguuuccauggccaacaucuuccgcggcucuuaccucgcuggggccggacuugccuuuagccugaugaaaucccugggcgggggaagacggggcaccggggcucagggagaaacacucggcgagaaguggaagcgccagcugaaucagcuuagcaaauccgaguucaacaucuauaagagaucuggcauuauggaggucgaccggagcgaagccaaagaggggcugaagagaggagagaccacgcgccaugcggugucccggggcacagccaaacucagaugguucguggaacgcaaucuggucaagcccgaggggaagguuaucgaucugggauguggcagagggggauggucuuacuauugcgcuggccucaaaaaggugaccgaagugaaaggcuacaccaaagggggaccuggccacgaggaacccauuccuauggccacauauggguggaaccuugucaaacugcauagcggaaaggacguguuuuucacacccccugagaaaugugauacccugcucugcgacaucggcgaguccucuccgaaucccacgauugaagaggggagaacccugcgcguucuuaagaugguggaaccuuggcugcggggaaaccaauuuuguaucaagauucucaaucccuacaugccuagcgucguggagacacuggagcagaugcagagaaaacacggcggcaugcugguucgcaacccccucucccggaauagcacccacgaaauguacugggugucuugcgggacaggaaacaucgucuccgcugugaauaugaccagcagaaugcugcuuaaccgcuucacgauggcccaucggaagccgaccuaugagagagauguggaccugggcgcggggacacgccacgucgccguugaaccugagguggcuaaccucgauaucauuggacagagaaucgaaaauauuaaacaugagcacaagucuaccuggcauuacgacgaggauaaccccuauaaaacaugggccuaccacggcuccuaugaagugaagcccagcgggucugcuuccagcauggucaauggagugguuaagcugcuuaccaaaccuugggacgugauccccauggucacacaaauugccaugaccgauacgacaccuuuuggccagcagcggguguucaaggagaaaguugacacccgcaccccgaaggcuaaaagaggcacagcccaaaucauggaagugacggcgcgguggcuguggggguuucucuccagaaacaagaagccccggaucuguacccgcgaggaguucacaagaaaaguccggagcaaugccgcuauuggagccguguuuguugacgagaaccaguggaacucugcuaaggaggccguggaagaugagcgcuucugggaccugguccagaaagaaagagagcugcacaagcagggcaaaugcgcgaccugcguguacaacaugauggggaagcgggaaaagaaacucggagaguuuggcaaggcgaaagggagccgcgcuaucugguauauguggcugggcgccagauuccuugaguuugaagcccugggauucaugaaugaggaucauugguucucccgggaaaacucucucagcggcgucgagggggagggacugcacaaacuuggcuacauucugcgcgacaucuccaaaauuccugggggaaauauguacgcugaugacacagccggcugggauaccagaaucacagaagacgaucuccaaaacgaggcuaagaucaccgacauuauggaacccgagcaugcccugcuggcgacgucuaucuuuaaacucaccuaucagaauaaggugguucgggugcagcgcccugccaagaacgggacagucauggaugugauuagcagacgggaccagcgcggcuccggacaagugggcaccuacgggcugaauacauucaccaacauggaagcucagcuuaucagacagauggagucugagggaauuuuucugcccagcgaacucgagacgcagaaccuggccgaacggguucuugauuggcuggagaaauauggcguggaaagacucaagcgcauggcuaucuccggggacgacugugucgugaaaccgaucgaugaccgguucgccacagcgcugaccgcccugaaugauaugggaaagguuagaaaagacauuccucaaugggagcccagcaagggcuggaacgauuggcaacaggugccuuuuugcucucaccacuuccaucagcucaucaugaaggacgggcgcgagauugucgugcccugucggaaucaagaugaacuggucggcagagcucgcgugucccagggagccggcuggagccuucgggagacagcuugccuggggaaaucuuacgcccagauguggcaacucauguauuuucacagacgcgaccugcggcuugcugccaacgcgaucuguuccgccguuccuguggauuggguccccaccagcagaacgaccugguccauucaugcucaccaucaguggaugacaaccgaagacaugcugucuguguggaaucgcguuuggaucgaggaaaacccguggauggagaauaagacacacgugagcuccuggggagaugucccuuaccucggcaaacgggaggaccaguggugcgggagccugauuggacugaccgccagagccacaugggcuucuaacauccagguggccaucaaucaagugcggagacucauuggcaacgaaaauuaucuggacuacaugaccuccaugaagcgcuucaaaaacgagggggaucccgaaggcgcgcuuugguga

SEQ ID NO: 19003 - RNA, 9879 nt, Artificial Sequence
  derived and/or modified CDS sequence (opt5) from DENV-1__FJ882545__SS-prME
agcgugaccaugcugcucaugcugaugcccaccgcccuugcuuuccaccugacgaccagaggaggggaaccucauaugaucguguccaagcaggaacggggaaaaucucuccuguuuaagaccagcgccggcguuaacaugugcacccuuauugcgauggaccugggggaacucugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaagcucacaguuguggucggagauguggcuggcauucuggggcagggcaagaaaaugauccggccgcaacccauggaguacaaauauucuuggaaaagcuggggcaaggccaagauuaucggggccgacgcucagaauaccaccuucaucauugauggaccuaacacacccgaauguccugacgaucagagagcguggaauaucugggagguggaggacuacggcuuuggcauuuucaccacgaacaucuggcugaaacuucgcgauuccuauacacaggucugcgaccaccggcucaugagcgccgcuauuaaagauucuaaggccguucacgccgacaugggguacuggaucgaauccgagaaaaaugaaaccuggaagcuggcuagagccagcuuuaucgaggugaagacauguauuuggcccaaaucucauacccugugguccaacggagugcucgaaagcgagaugaucauuccgaagaucuauggcgggccuauuucucaacacaauuaccgccccggauacuucacacagaccgcgggcccuuggcaucuggggaaacuugagcuggauuucgaccucugcgaaggaacgaccgucgugguugaugagcacugcggcaaccggggccccagccugagaacaaccacagugaccgggaagaucauccacgaaugguguugccgguccuguacgcugccuccccuucgcuuuagaggagaggacggcugcugguaugggauggagauucggccggucaaagaaaaggaggaaaaucucgucaagagcaugguuucugcuggauccggcgagguggacagcuucucccuggggcugcucuguaucucuauuaugaucgaagaggucaugagaagccgcuggucccggaaaaugcugaugacaggaacccuugccguguuuuuccugcucauuaugggccagcugacauggaacgaucugaucagacuuugcauuaugguuggcgccaaugcuucugaccgcauggggaugggaaccaccuaccuggcccucauggcgacauuuaagaugagaccuauguucgcugugggccugcucuuucggcgccugacgagcagagagguccuucugcucaccaucgggcugucccugguggccucuguggaacuucccaacagccuggaggaacucggagauggccuggccauggggaucaugauucucaaacugcuuacagacuuccaaucccaucagcugugggcuacccuccugagccugacauuuaucaagaccacguucucucuucacuaugccuggaaaacaauggcuaugguccuguccauuguuagccucuuuccccugugucucucuaccaccucccagaagacaaccuggcugccugugcuucugggaagccugggcugcaagccgcucacaauguuccugaucgccgagaauaaaauuuggggccggaagucuuggccccuuaacgaagggaucauggcggugggaaucgucuccauucugcucagcucccugcucaaaaacgaugugccucuggccggcccccuuaucgcugggggaaugcugauugccuguuacguuaucagcggcucuagcgcugaccugucccucgagaaggccgccgaggugucuugggaagaggaagcugagcauagcggggcgucccacaauauucuggucgaagugcaggaugacggaacgaugaaaaucaaggaugaggagcgcgacgauacccuuacaauccugcucaaagccacccugcucgcuguuucuggcguguauccucugagcauucccgccacacuuuuugucugguacuucuggcaaaagaagaaacagagauccggcgugcugugggacaccccuucucccccggaagucgagcgggccgugcuggaugacgggaucuaucgcauuaugcagagaggacuccugggccggagccagguuggggugggagucuuccaagaaaacguguuucauacgauguggcacguuacccgcggcgcugugcuuauguaccaggggaagagacuggagccuuccugggccagcgucaaaaaggaccucaucucuuacggaggcggcuggcggcugagaggguccuggaauacaggagaggaaguccaggugauugcgguugagcccggcaaaaacccuaagaauguccagaccgcucccgggacauucaagaccccggaaggagaggugggcgccaucgcccucgauuuuaaaccugggacaagcggaucucccauugugaaccgcgaaggcaagaucgucggccuguaugggaauggagugguuacgaccuccggcacauacgugagcgcuaucgcccaagcgaaggcuucccaggaggggccucuucccgagauugaagacgaggucuuccggaagagaaaccugaccaucauggaucugcaccccggaucuggcaaaacccgccgguaucucccugccauugugagagaagccaucaagcgcaagcugcggacacuuauucuggcuccgacgagaguuguggccagcgagauggcugaagcccucaaagggaugcccauccgcuaccagaccacagcggucaaguccgagcauaccggcaaagagaucguggaccugaugugccacgccacauuuaccaugcggcugcucagcccuguuagagugcccaauuauaacaugauuaucauggaugaagcucauuucacggacccuucuuccauugccgcucggggauacaucagcacacgcgucggcaugggggaggccgccgcuauuuuuaugaccgcgacacccccuggaucuguggaagccuucccgcaaagcaaugcugugauccaggaugaggaaagagacauccccgagcgguccuggaacucuggcuaugaguggauuacagauuuuccugggaagaccgucugguucguucccagcaucaaauccggaaaugacauugccaacugucuucgcaagaauggcaagagagugauccagcugucucggaaaacauuugauaccgaauaccagaagacgaaaaacaacgacugggacuacguggucacaaccgauauuagcgagaugggggccaauuucagagcugaccgcgugaucgauccucggagaugccugaagcccguuauucucaaagacggcccggaacgcgugauccuggccggaccuaugcccgucacaguggcguccgcugcccaacggagaggccgcaucgggcggaaccacaauaaggagggagaucaguauauuuacaugggccagccccuuaacaaugacgaggaucaugcccacuggaccgaagcuaagaugcugcucgacaacaucaauacgccugaggggauuauccccgcccuguucgaaccugagagagaaaagagcgcggccguugauggagaguaucgccugagaggcgaggcucggaagaccuuuguggagcucaugcgcagaggggaccuuccggucuggcugucuuacaaaguggccuccgagggcuuccaguauagcgaucggcgcuggugcuuugacggagaaagaaacaaucaaguccuggaggaaaacauggauguggagauuuggacaaaggagggcgaacggaaaaagcucagaccccgcuggcuggacgcucggaccuacuccgacccucuugcccugagagaguucaaagaauuugcugccgggcgccggucuguuagcggagaucucauccuggagaucggcaagcugccccagcaccucacacagagagcgcagaaugcccuugacaaccuggugaugcugcauaauuccgaacaagggggacgggcuuaucgccacgccauggaggagcucccugauaccauugaaacacugaugcuucuggcucucaucgccgugcugaccggcggcgucacgcuguucuuucucucugggagaggacuuggcaagacaagcauugggcugcuguguguuauggccuccagcgugcuccuguggauggcuucuguggagccccauuggaucgcggccuccauuauccuugaguucuuucugaugguccuccugaucccggagccugaccggcagcgcacaccccaggauaaccagcuggcuuacgugguuauuggacuccuuuucaugauccugaccguggccgccaaugagaugggccugcucgaaacaaccaaaaaggaccuggggauuggacacgucgcuguggagaaccaccaucacgccgcgaugcuugaugucgaccugcauccugccagcgcuuggacacucuacgccguggcuacgaccaucauuacacccaugaugagacacaccaucgaaaacacaaccgccaauauuucucugacggcgaucgccaaccaagcugccauccugaugggccucgauaaaggcuggccuauuuccaagauggacaucgggguuccccuucuggcucugggaugcuauagccaggugaauccgcucacccugacagccgcuguccuuaugcugguggcccauuacgcgauuaucggcccugggcuccaggccaaagcuacccgggaggcccaaaagcgcacagcugccggaauuaugaagaaccccaccguugauggcaucguggccaucgaccuggaucccgucguguaugacgcgaaauuugaaaagcagcuggggcagauuaugcuccuuauccuguguacgucucagauucugcucaugagaacaaccugggcucugugcgagagcaucacacuugccaccggaccucugaccacacucugggagggcuccccgggcaaauucuggaauacgaccauugcugugucuauggccaacaucuuucgggggagcuaccuggccggagcuggccuggccuucucccucaugaaaagccuugggggaggccgcagagggacaggagcgcaaggcgaaacccugggcgagaaauggaagcggcagcugaaucagcucuccaagucugaguucaacacauauaaaagaagcgggaucauggagguugaccgcuccgaagccaaggagggacugaaacggggcgagaccacgaagcacgcugucucuagagggacagccaaacuucgcugguuuguggaacggaaucuggugaagcccgagggaaaggucauugaucucggcugugggagaggaggcuggagcuacuauugcgcuggccugaaaaagguuaccgaagugaaaggguacaccaagggaggcccugggcacgaggaacccaucccuauggccacauacggauggaaccuggugaaacuccauuccggcaaggacgucuucuuuauucccccugagaaaugugauacccuucugugcgacaucggggagucuagcccgaaucccacaauugaagagggacgcacgcugcgggugcucaagaugguugaaccuuggcugagaggcaaccaguucuguaucaagauucuuaaucccuauaugccuuccguggucgagacccuggagcaaaugcagcgcaaacacggcgggaugcucgugcggaacccccugagcagaaauucuacacaugaaauguacuggguuuccugcggaaccggcaacaucgugagcgcggucaauaugacaucucgcaugcugcucaaccgguuuaccauggcccacagaaagccgacguaugagcgcgauguggaccuggggaccggaacaagacacguggcugucgaaccugagguugccaaccuugauaucauuggccagcggaucgaaaauauuaaacaugagcacaaguccaccuggcauuacgacgaggauaaccccuauaaaacaugggcuuaccacgggagcuaugaagugaagcccucuggauccgccagcuccauggugaauggcgucgugaagcugcucaccaaaccuugggacguuauccccauggugacacagauugcuaugaccgauacgacaccuuucggccaacagcgcgucuuuaaggagaaaguggacaccagaaccccgaaggccaaacgggggacagcgcagaucauggaaguuacggccagauggcuguggggauuccuuagccggaacaagaagccccgcaucuguaccagagaggaauuuacacggaaagugcgcucuaaugcugccauuggcgcugucuucguggacgagaaccaauggaauagcgccaaggaggccguugaagaugagagauuuugggaccuggugcaucgggaacgcgagcuccacaaacaggggaagugcgcgaccugcgucuacaacaugaugggaaaaagagaaaagaagcugggcgaguucgggaaagcuaagggcucccgggccaucugguacauguggcugggagcccgcuuucucgaguucgaagcucugggcuucaugaaugaggaucacugguuuucuagagaaaacagccuuuccgggguggagggagagggccugcauaaacucggguauauucugcgggacaucucuaagauuccuggaggcaauauguacgccgaugacacagcugggugggauacccgcaucacagaagacgaucuucagaacgaggccaaaaucaccgacauuauggaacccgagcacgcgcugcucgccaaggcuaucuucaaacugacguaucagaauaaggucgugagaguucaacggccugccaagaacggcaccgugauggaugucauuagccgcagagaccagcggggauccggccagguggggacauacggacugaauaccuuuacaaacauggaagcucagcucaucagacaaauggagucugagggcauuuucagccccuccgaacuggagaccccgaaccuugccgaacgcgcgcuggauuggcucgggaaauauggaguggagcggcugaagagaauggccaucagcggcgacgacuguguugugaaaccuaucgaugaccgcuuugcuacggcccuuacagcucugaaugauauggggaagguccggaaagacauuccccagugggaaccuucuaagggcuggaacgauuggcaacaggugcccuucugcucccaucacuuucaccaacucaucaugaaggacggaagagagauuguugugccuugucgcaaucaggaugagcuggucggccgggccagagugagccagggggcuggauggucucugcgcgaaaccgccugccucggcaaauccuacgcgcagauguggcaacugauguauuuccaucggagagaccuucgccuggccgcuaacgccaucuguagcgccguccccguggauuggguuccgacaucccggaccacguggucuauucacgcucaucaccaguggaugaccacagaggacaugcucagcguguggaauagagucuggaucgaagagaacccuuggauggaagauaagacccauauuuccagcugggaggacgugcccuaccuggggaaacgggaggaccaguggugcggaucucuuaucggccugacagccagagcgaccugggcuacaaauauccaaguugccauuaaccaggugcgccggcucaucgggaaugaaaacuaccuggauuauaugaccuccaugaagagauuuaaaaaugagagcgaccccgaaggcgcccugugguga

SEQ ID NO: 19004 - RNA, 9879 nt, Artificial Sequence
  derived and/or modified CDS sequence (opt5) from DENV-1__FJ898372__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcucgcgauaagcccacacuggacaucgaacugcucaaaaccgaggucacaaacccugccguucugagaaagcuuugcauugaagcgaaaaucuccaauaccacgacagauagccgguguccgacccaaggagaggccacccugguggaagagcaggacgcuaacuucgugugccgcagaacauuugucgaucggggcuggggcaauggguguggacucuucggcaaggggucucugauuaccugcgccaaauuuaagugcgugacaaagcuugagggaaaaaucguucaguacgaaaaccugaaguauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccgcaccggccucgacuucaacgaaauggugcugcuuacgaugaaagagaaguccuggcugguccauaaacagugguuucucgaucugccucuucccuggacaagcggggcuuccaccucucaagagacauggaauagacaggaccugcucgugaccuucaagaccgcgcacgccaaaaagcaggaagucgugguucugggaagccaagagggcgcuaugcacacagcccugacgggggccaccgaaauucagacauccggaaccacaaccaucuuugcuggccaucucaagugccggcugaaaauggauaagcuuacgcugaaagggaugagcuaugugauguguacaggcucuuucaagcucgagaaagaagucgccgagacccagcacggaaccgugcugguucagauuaaguacgagggcacagacgcgccgugcaagaucccuuucuccacccaagaugaaaaaggggugacacagaacggaagacugaucacggcuaaucccauugucaccgacaaggagaaaccugugaacaucgaagccgagccccccuuuggcgagagcuauauugugaucggggccggagaaaaggcucuuaaacucucuugguucaagaagggcagcuccauugggaaaauguuugaggccacagcucgcggcgcccggagaauggcgauccugggagauaccgccugggacuucggcucuaucgggggaguuuuuacaagcgucggcaagcuggugcaucagauuuucgggaccgcuuacggagugcucuuuuccggcgucagcuggacgaugaaaaucgggauuggcgugcugcuuaccuggcugggacucaauucucgcuccacaagccugucuaugaccuguaucgccguuggccuggugacacuuuaccucggggucauggugcaggcugauuccggaugcguuauuaacuggaagggccgggaacugaaaugugggagcggaaucuucgugaccaaugagguccacacauggaccgaacaauauaaguuucaggccgacuccccuaagagacugucugcggccauuggcaaagcuugggaggagggggugugcggcauccgcagcgccacgcggcucgaaaacaucauguggaagcagauuuccaacgagcugaaucauauccuucuggaaaacgacaugaaacucacaguuguggucggagauguggcuggcauucuggggcagggaaagaaaaugaucagaccgcaacccauggaguacaaguauucuuggaaaagcuggggcaaggccaagauuaucggggccgacgcucagaauaccaccuucaucauugauggaccuaacacacccgaauguccugacgaucagcgcgcguggaauaucugggagguggaggacuacggcuuuggcauuuucaccacgaacaucuggcugaaacuucgggauuccuauacacaggucugcgaccacagacucaugagcgccgcuauuaaggauucuaaagccguucacgccgacaugggguacuggaucgaauccgagaagaaugaaaccuggaaacuggcucgcgccagcuuuaucgaggugaagacauguauuuggcccaagucucauacccugugguccaacggagugcucgaaagcgagaugaucauuccgaaaaucuauggcgggccuauuucucaacacaauuaccggcccggauacuucacacagaccgcgggcccuuggcaucuggggaagcuugagcuggauuucgaccucugcgaaggaacgaccgucgugguugaugagcacugcggcaacagaggccccagccugcggacaaccacagugaccgggaaaaucauccacgaaugguguugccgcuccuguacgcugccuccccuuagauuucggggagaggacggcugcugguaugggauggagauuagaccggucaaggaaaaagaggaaaaucucgugaagagcaugguuucugcuggauccggcgagguggacagcuucucccuggggcugcucuguaucucuauuaugaucgaagaggucaugcgcagccggugguccagaaagaugcugaugacaggaacccuugccguguuuuuccugcucauuaugggccagcugacauggaacgaucugauccgccuuugcauuaugguuggcgccaaugcuucugacagaauggggaugggaaccaccuaccuggcccucauggcgacauuuaaaaugcggccuauguucgcugugggccugcucuuucgcagacugacgagccgggagguccuucugcucaccaucgggcugucccugguggccucuguggaacuucccaacagccuggaggaacucggagauggccuggccauggggaucaugauucucaagcugcuuacagacuuccaaucccaucagcugugggcuacccuccugagccugacauuuaucaaaaccacguucucucuucacuaugccuggaagacaauggcuaugguccuguccauuguuagccucuuuccccugugucucucuaccaccucccagaaaacaaccuggcugccugugcuucugggaagccugggcugcaagccgcucacaauguuccugaucgccgagaauaagauuuggggccgcaaaucuuggccccuuaacgaagggaucauggcggugggaaucgucuccauucugcucagcucccugcucaagaacgaugugccucuggccggcccccuuaucgcugggggaaugcugauugccuguuacguuaucagcggcucuagcgcugaccugucccucgagaaagccgccgaggugucuugggaagaggaagcugagcauagcggggcgucccacaauauucuggucgaagugcaggaugacggaacgaugaagaucaaagaugaggagagagacgauacccuuacaauccugcucaaggccacccugcucgcuguuucuggcguguauccucugagcauucccgccacacuuuuugucugguacuucuggcaaaaaaagaagcagcgguccggcgugcugugggacaccccuucucccccggaagucgagcgcgccgugcuggaugacgggaucuauagaauuaugcagcggggacuccugggccgcagccagguuggggugggagucuuccaagaaaacguguuucauacgauguggcacguuaccagaggcgcugugcuuauguaccaggggaaacggcuggagccuuccugggccagcgucaagaaagaccucaucucuuacggaggcggcuggagacugcgcggguccuggaauacaggagaggaagugcaggugauugcgguugagcccggcaagaacccuaaaaauguccagaccgcucccgggacauucaagaccccggaaggagaggugggcgccaucgcccucgauuuuaagccugggacaagcggaucucccauugugaaccgggaaggcaaaaucgucggccuguaugggaauggagugguuacgaccuccggcacauacgugagcgcuaucgcccaagcgaaggcuucccaggaggggccucuucccgagauugaagacgaggucuucagaaaacgcaaccugaccaucauggaucugcaccccggaucuggcaagacccggagauaucucccugccauugugcgcgaagccaucaaacggaagcugagaacacuuauucuggcuccgacgcgcguuguggccagcgagauggcugaagcccucaaggggaugcccauccgguaccagaccacagcggucaaauccgagcauaccggcaaggagaucguggaccugaugugccacgccacauuuaccaugagacugcucagcccuguucgggugcccaauuauaacaugauuaucauggaugaagcucauuucacggacccuucuuccauugccgcucgcggauacaucagcacaagagucggcaugggggaggccgccgcuauuuuuaugaccgcgacccccccuggaucuguggaagccuucccgcaaagcaaugcugugauccaggaugaggaacgggacauccccgagcgcuccuggaacucuggcuaugaguggauuacagauuuuccugggaaaaccgucugguucguucccagcaucaaguccggaaaugacauugccaacugucuuagaaaaaauggcaagcgggugauccagcugucuagaaagacauuugauaccgaauaccagaaaacgaagaacaacgacugggacuacguggucacaaccgauauuagcgagaugggggccaauuuccgcgcugaccgggugaucgauccuagacgcugccugaaacccguuauucucaaggacggcccggaacgggugauccuggccggaccuaugcccgucacaguggcguccgcugcccaaagacgcggccggaucgggagaaaccacaauaaagagggagaucaguauauuuacaugggccagccccuuaacaaugacgaggaucaugcccacuggaccgaagcuaagaugcugcucgacaacaucaauacgccugaggggauuauccccgcccuguucgaaccugagcgcgaaaagagcgcggccguugauggagaguauagacugcggggcgaggcucgcaaaaccuuuguggaacucaugagacggggggaccuuccggucuggcugucuuacaagguggccuccgagggcuuccaguauagcgaucgcagauggugcuuugacggagaacggaacaaucaaguccuggaggaaaacauggauguggagauuuggacaaaagagggcgaaagaaagaaacuccgcccccgguggcuggacgcuagaaccuacuccgacccucuugcccugcgcgaguucaaggaauuugcugccgggcggagaucuguuagcggagaucucauccuggagaucggcaaacugccccagcaccucacacagcgggcgcagaaugcccuugacaaccuggugaugcugcauaauuccgaacaagggggacgcgcuuauagacacgccauggaggagcucccugauaccauugaaacacugaugcuucuggcucucaucgccgugcugaccggcggcgucacgcuguucuuucucucugggcggggacuuggcaagacaagcauugggcugcuguguguuauggccuccagcgugcuccuguggauggcuucuguggagccccauuggaucgcggccuccauuauccuugaauucuuucugaugguccuccugaucccggagccugaccgccagagaaccccccaggauaaccagcuggcuuacgugguuauuggacuccuuuucaugauccugaccguggccgccaaugagaugggccugcucgaaacaaccaagaaagaccuggggauuggacacgucgcuguggagaaccaccaucacgccgcgaugcuugaugucgaccugcauccugccagcgcuuggacacucuacgccguggcuacgaccaucauuacacccaugaugcggcacaccaucgaaaacacaaccgccaauauuucucugacggcgaucgccaaccaagcugccauccugaugggccucgauaagggcuggccuauuuccaaaauggacaucgggguuccccuucuggcucugggaugcuauagccaggugaauccgcucacccugacagccgcuguccuuaugcugguggcccauuacgcgauuaucggcccugggcuccaggccaaggcuacccgcgaggcccaaaaaagaacagcugccggaauuaugaagaaccccaccguugauggcaucguggccaucgaccuggaucccgucguguaugacgcgaaguuugaaaaacagcuggggcagauuaugcuccuuauccuguguacgucucagauucugcucaugcggacaaccugggcucugugcgagagcaucacacuugccaccggaccucugaccacacucugggagggcuccccgggcaaguucuggaauacgaccauugcugugucuauggccaacaucuuucgcgggagcuaccuggccggagcuggccuggccuucucccucaugaaaagccuugggggaggcagacgggggacaggagcgcaaggcgaaacccugggcgagaaguggaaaagacagcugaaucagcucuccaagucugaauucaacacauauaagcgcagcgggaucauggagguugaccgguccgaagccaaagagggacugaagagaggcgagaccacgaaacacgcugucucucgcgggacagccaagcuucggugguuuguggaaagaaaucuggugaaacccgagggaaaggucauugaucucggcugugggcgcggaggcuggagcuacuauugcgcuggccugaagaaaguuaccgaagugaagggguacaccaaaggaggcccugggcacgaggaacccaucccuauggccacauacggauggaaccuggugaagcuccauuccggcaaagacgucuucuuuauucccccugagaagugugauacccuucugugcgacaucggggagucuagcccgaaucccacaauugaagagggacggacgcugagagugcucaaaaugguugaaccuuggcugcgcggcaaccaguucuguaucaagauucuuaaucccuauaugccuuccguggucgagacccuggagcaaaugcagcggaagcacggcgggaugcucgugagaaacccccugagccgcaauucuacacaugaaauguacuggguuuccugcggaaccggcaacaucgugagcgcggucaauaugacaucucggaugcugcucaacagauuuaccauggcccaccgcaaaccgacguaugagagagauguggaccuggggaccggaacacggcacguggcugucgaaccugagguugccaaccuugauaucauuggccagcgcaucgaaaauauuaagcaugagcacaaauccaccuggcauuacgacgaggauaaccccuauaagacaugggcuuaccacgggagcuaugaagugaaacccucuggauccgccagcuccauggugaauggcgucgugaagcugcucaccaagccuugggacguuauccccauggugacacagauugcuaugaccgauacgacaccuuucggccaacagagagucuuuaaagagaagguggacacccggaccccgaaagccaagagagggacagcgcagaucauggaaguuacggcccgguggcuguggggauuccuuagccgcaacaaaaagcccagaaucuguacccgggaggaauuuacacgcaaggugagaucuaaugcugccauuggcgcugucuucguggacgagaaccaauggaauagcgccaaagaggccguugaagaugagcgguuuugggaccuggugcaucgcgaaagagagcuccacaagcaggggaaaugcgcgaccugcgucuacaacaugaugggaaagcgggaaaaaaagcugggcgaguucgggaaggcuaaaggcucccgcgccaucugguacauguggcugggagccagauuucucgaguucgaagcucugggcuucaugaaugaggaucacugguuuucucgggaaaacagccuuuccgggguggagggagagggccugcauaagcucggguauauucugcgcgacaucucuaaaauuccuggaggcaauauguacgccgaugacacagcugggugggauaccagaaucacagaagacgaucuucagaacgaggccaagaucaccgacauuauggaacccgagcacgcgcugcucgccaaagcuaucuucaagcugacguaucagaauaaagucgugcggguucaacgcccugccaagaacggcaccgugauggaugucauuagcagacgggaccagagaggauccggccagguggggacauacggacugaauaccuuuacaaacauggaagcucagcucauccgccaaauggagucugagggcauuuucagccccuccgaacuggagaccccgaaccuugccgaacgggcgcuggauuggcucgagaaguaugggguggaaagacugaaacgcauggccaucagcggagacgacuguguugugaagccuaucgaugaccgguuugcuacggcccuuacagcucugaaugauaugggcaaagucagaaaggacauuccccagugggagccuucuaaaggguggaacgauuggcagcaggugcccuucugcucccaucacuuucaccaacucaucaugaaggacggccgcgagauuguugugccuugucggaaucaggaugaacuggucggaagagcccgcgugagccagggcgcuggguggucucugcgggagaccgccugccucggaaaguccuacgcgcagauguggcaacugauguauuuccauagacgcgaccuucggcuggccgcuaacgccaucuguagcgccguccccguggauuggguuccgacauccagaaccacguggucuauucacgcucaucaccaguggaugaccacagaagacaugcucagcguguggaaucgggucuggaucgaggaaaacccuuggauggaggauaaaacccauauuuccagcugggaggacgugcccuaccugggcaagagagaagaccaguggugcgggucucuuaucggacugacagcccgcgcgaccugggcuacaaauauccaaguugccauuaaccaggugcggagacucaucggcaaugagaacuaccuggauuauaugaccuccaugaaacgcuuuaagaaugaaagcgaccccgagggggcccugugguga

SEQ ID NO: 19005 - RNA, 9879 nt, Artificial Sequence
  derived and/or modified CDS sequence (opt5) from DENV-1__FJ898373__SS-prME
agcgugaccaugcugcucaugcugaugcccacagcccuugcuuuccaccugacgaccagaggcggggaaccucauaugaucguguccaagcaggaacggggaaagucucuccuguuuaagaccagcgccggcguuaauaugugcacccuuaucgcgauggaccugggggaacucugugaagauacaaugaccuacaaaugcccgagaaucacagagguggaacccgacgauguggacuguuggugcaauaccacggauaccugggucacauauggaaccuguucccaaacaggcgagcacagacgggacaagcgcucuguggcucuggccccucauguugggcugggacucgagaccagagccgaaacguggaugagcuccgagggcgcuuggaaacagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaagauaagcccacacuggacaucgaacugcucaaaaccgagguuacaaacccugcugugcugcggaaacuuugcauugaagccaaaaucuccaauaccacgacagauagccgcuguccgacccaaggagaggcgacccugguggaagaacaggacgccaacuucgucugcagacggacauuuguggaucgcggcuggggcaauggguguggacucuucggcaaggggucucugauuaccugcgcuaaguuuaaaugcguuacaaaacuugagggaaaaaucgugcaguacgaaaaccugaaguauuccgucaucgugacgguucacaccggcgaccagcaucaaguggggaaugagagcacagaacacggaaccauugccacaaucacaccccaggcuccuacgucugagauucagcucaccgacuacggcgcccugacacuggauuguucccccagaaccggccucgacuucaacgaaaugguccugcuuacaaugaaagaaaagagcuggcuggugcauaaacagugguuucucgaucugccucuucccuggaccuccggggccucuacgagccaagagacauggaaucggcaggaccugcucgucaccuucaagacagcucacgcgaagaaacaggaagugguugugcugggaucccaagagggcgccaugcacaccgcucugaccggggccacagaaauccagacgaccggaacaaccacaauuuuugccggccaucucaagugccgccugaaaauggauaaacuuacccugaaagggaugagcuaugucauguguacgggcucuuucaagcucgagaaggaaguggcugagacacagcacggaaccguucuggugcagaucaaauacgagggcaccgacgccccgugcaagaucccuuucuccacacaagaugaaaaaggggucacccagaacggaagacugauuacagcgaaucccaucgugacggacaaggagaaaccugugaacauugaagcugagccgcccuuuggcgagagcuauaucguuauuggggccggagaaaaggcccuuaagcucucuugguucaaaaagggcagcuccaucgggaaaauguuugaggcuaccgcccggggcgcuagacgcauggccauccugggagauacagcgugggacuucggcucuauugggggagucuuuaccagcgugggcaagcuggugcaucagaucuucgggacagccuacggaguccucuuuuccggcgugagcuggaccaugaaaauugggaucggcguucugcuuacguggcugggacucaauucucgguccaccagccugucuaugacauguauugcugugggccugaucacccuuuaccucggggucauggugcaggccgauuccggaugcguuauuaacuggaagggcagagaacugaagugugggagcggaaucuucgugacaaaugagguccacaccuggacagaacaauauaaauuucaggcugacuccccuaagcgccugucugccgcggugggcaaagccugggaggaggggguuugcggcauccggagcgcuaccagacucgaaaacauuauguggcgccagaucuccaacgagcugaaucauauucuucuggaaaacgacaugaaguucacgguggucgugggagauguggucggcauccucgcccaggggaaaaagaugguucggccgcaacccauggagcacaaauacucuuggaaaagcuggggaaaggcuaagauuaucggcgccgacgugcagaauacaaccuuuaucauugaugggccuaacacccccgaauguccugacgaucagagagccuggaauaucugggagguggaggacuauggauucggcauuuuuacaaccaacaucuggcugaagcugcgcgauuccuacacgcaggucugcgaccaccggcuuaugagcgcugcgauuaaagauucuaaggccgugcaugcugacaugggcuauuggaucgaauccgagaaaaaugaaacauggaagcucgccagagccagcuucaucgagguuaagaccuguauuuggcccaaaucucacacacugugguccaacggggugcuggaaagcgagaugaucauuccgaagaucuacggaggcccuauuucucaacauaauuaucgccccggguacuucacccagacagcuggaccuuggcaccucggcaaacuggagcuugauuuugaccugugcgaagggaccacggucgugguugaugagcacugcggaaaccggggccccagccucagaaccacaaccgugacaggcaagaucauccaugaaugguguugccgguccuguacccugccuccccugcgcuucaaaggggaggacggaugcugguacggcauggagauuagaccggucaaggaaaaggaggaaaaucuugugaaaagcaugguuucugccggguccggagagguggacagcuuuucccucggccugcuguguaucucuauuaugaucgaagaggucaugcggagcagauggucccgcaagaugcucaugacggggacacuggcgguguucuuucuucugauuaugggacagcucaccuggaacgaucugauccggucuugcauuauggugggcgcuaaugccagcgacagaaugggcauggggacaaccuaucuggcccuuauggcuaccuucaaaaugcgcccuauguuugccgucggacuccuguucagacggcugacaucccgcgagguucuccugcuuacgaucggccugucucucguggcgagcguggaacugcccaacucccuggaggaacuuggggauggacuggcuaugggcaucaugauucucaagcugcucaccgacuuucaaagcuaccagcugugggccacacuucugucucucaccuucaucaaaacaaccuuuucccugcacuaugccuggaagacgauggcuaugguccugagcauugugucucuucugccccucugucuguccacaaccagccagaagaccacauggcucccuguucugcuugggucucugggaugcaaaccgcugaccauguuccucaucgccgagaauaagauuuggggcagaaaauccuggccccugaacgaaggcaucauggcuguggggaucgucagcauucuucuguccagccuccugaagaacgaugugccucucgccggaccccugaucgcgggcgggaugcuuauugccuguuacguuaucucuggaagcuccgcugaccugucucuggagaaagccgcugaggugagcugggaagaggaagccgagcauuccggcgccucucacaauauucucgucgaagugcaggaugacgggacaaugaagaucaaagaugaggagcgggacgauacgcugaccauccuucugaaggcuacacuccuggcggucagcggaguguauccucucuccauucccgccacccuguuuguuugguacuucuggcaaaagaaaaagcagcgcucuggcgugcuuugggacacaccuagcccucccgaagucgagagagcugugcuggaugacggcaucuaucggauuaugcagcgcgggcugcucggaagaucccagguuggcgugggggucuuccaagaaaacguguuucauaccauguggcacgugacgcggggagccguucugauguaccagggcaaacgccuugagcccagcugggccucugucaagaaagaccugaucuccuacgggggaggcuggagacuccagggcagcuggaauaccggggaggaaguccaggugauugcugucgagcccggaaagaacccuaagaaugugcaaacagcccccggcaccuucaaaacaccggaaggggagguuggagcgaucgcucuggauuuuaagccuggcaccucugggucccccauugugaaccgggaaggaaaaaucgucggccucuauggcaauggggugguuacaacgagcggaaccuacguguccgccaucgcccaggcuaaggccucucaggagggcccucugcccgagauugaagacgaggucuucagaaaacgcaaccuuacaaucauggaucugcaccccgggagcggaaagacccggagauaucugccugcgauugugcgcgaagcuaucaagcggaaacucagaacccugauucuugccccgacacgcguuguggccuccgagauggcugaagcccugaagggcaugcccauccgguaccaaacgaccgcugucaaaagcgagcauacagggagagagaucguggaccucaugugccacgccaccuuuacaaugcgccugcugucuccugugcggguccccaauuauaacaugauuaucauggaugaagcgcauuucaccgacccuuccagcauugccgcuagaggcuacaucucuacgcggguuggaaugggcgaggccgcugccauuuuuaugacagccacacccccugggagcguggaggcuuucccgcaguccaaugcggugauccaggaugaggaacgcgacauccccgagagaucuuggaacagcggauaugaguggauuaccgauuuuccuggcaagacagucugguucgugcccuccaucaaaucugggaaugacauugccaacugucuccggaagaauggaaagcgcguuauccagcuuagcagaaaaaccuuugauacagaauaccaaaagaccaaaaacaacgacugggacuacguggucacgacagauauuuccgagaugggcgcuaauuuccgggccgacagagugaucgauccucgccggugccugaagcccguuauucugaaagacgggccggaaagagugauccucgccggcccuaugcccgucaccguggcuagcgccgcgcagcgccggggaagaaucggccgcaaccacaauaaggagggggaucaguauauuuacaugggacagccccugaacaaugacgaggaucaugcucacuggacagaagccaagaugcuucuggacaacaucaauaccccugagggcauuauccccgcccucuucgaaccugagcgggaaaaaucugcugccauugauggggaguauagacugcgcggagaggcgagaaagacguuugucgaacugaugcggcgcggcgaccucccgguguggcuuuccuacaaaguugccagcgagggguuccaauauuccgauagacgguggugcuuugacggcgaacgcaacaaucaggugcuggaggaaaacauggauguggagaucuggaccaaggagggagaacgcaagaagcugcggcccagauggcucgacgcucgcacauacucugacccucuggcccuucgggaguucaaagaauuugcugccggcagacgcagcgucuccggggaucugauccucgagauuggaaagcugccccagcaccugacccagcgggcucaaaaugcccucgacaaccuuguuaugcugcauaauucugaacagggcgggagagcguaucggcacgccauggaggagcugccugauacaaucgaaacccucaugcugcuugcucugauugccgugcucacaggaggcgugacccuguucuuucugagcggccgcgggcucggaaagacguccaucggccuucugugugucauggcuagcucugcccugcucuggauggccuccguggagccccauuggauugcugcgagcaucauccuggaguucuuucuuaugguucugcucauuccggagccugacagacagcggacaccccaggauaaccaacuggccuacguggucaucgggcuccuguucaugauucuuaccguggcugccaaugagaugggacugcuggaaaccaccaagaaggaccucggcaucgggcacgucgccguggagaaccaccaucacgcuaccaugcuggauguugaccuucauccugccucugcguggacacuguacgccguggcuacgaccauuaucacacccaugaugcgccacaccauugaaaacacaaccgccaauaucucccucacggcuaucgccaaccaggcggccauucugaugggacuggauaaaggcuggccuaucagcaagauggacauuggcgucccccuccuugcucuggggugcuauucucaggugaauccgcugacccucacagccgcuguucugaugcuuguggcccauuacgcuaucauuggaccuggccugcaagccaaagcgaccagagaggcccagaagcggacagcugccgggaucaugaagaaccccaccgucgauggaaucguggcuauugaccucgaucccgugguuuaugacgccaaauuugaaaagcagcugggccagaucaugcugcucauucuuuguacgagccaaauccugcugaugcgcacaaccugggcccucugcgaguccauuacacuggcgaccgggccucuuaccacacugugggagggaucuccgggcaaauucuggaauacgaccaucgcugucagcauggccaacaucuuuagaggcuccuaccucgcuggggccggacuggccuucagccugaugaagucccucggcgggggacggcgcggcacaggggcucagggagaaacccuuggcgagaaauggaagagacagcugaaucagcugucuaagagcgaguucaacacauauaaacgguccggcauuauggagguggacagaucugaagccaaggaggggcuccgccggggagagaccacgaaacacgcggugagcagaggcacagccaagcugcgcugguuugucgaacggaaucuuguuaaacccgaggggaaggugaucgaucugggauguggcagagggggaugguccuacuauugcgcuggccucaagaaagugaccgaagucaagggcuacaccaaagggggaccuggccacgaggaacccauuccuauggccacauacggguggaaccuggugaagcugcauucuggaaaagacguuuucuuuauucccccugagaagugugauacccuccuuugcgacauuggcgagagcuccccgaaucccacaaucgaagaggggcgcacgcugcgggugcugaaaauggucgaaccuuggcucagaggaaaccaauucuguauuaagauccugaaucccuauaugccuagcgugguugagacccuugagcacaugcagcgcaagcauggcggcaugcuggugcggaacccccucucuagaaauuccacacacgaaauguacugggucagcugcgggaccggaaacaucgugucugcugugaauaugacaucccgcaugcugcugaaccgguuuaccauggcccacagaaaaccgacguaugagcgcgaugucgaccucggcgcggggaccagacauguugccguggaaccugagguggcuaaccuggauauuaucggacagcggauugaaaauaucaagcacgagcauaaaagcacauggcacuacgacgaggauaaccccuauaagaccugggccuaccauggcucuuaugaagucaaacccuccgggagcgcuuccagcauggugaauggaguugugaaacuucugacaaagccuugggacgucauucccauggugacccagaucgccaugacagauaccacgccuuucggccaacagcgcguuuuuaaagagaagguggacacaagaaccccgaaagcuaagcggggcaccgcccagaucauggaagucacagcgagauggcucuggggguuccugucucggaacaaaaagccccgcauuuguacgagagaggaauuuacccggaaggugcgcagcaaugccgcuaucggagccguuuucguggacgagaaccaauggaacuccgcuaaagaggccgucgaagaugagagauuuugggaccuugugcaccgggaacgcgagcugcacaagcagggcaaaugcgccacaugcgucuacaacaugauggggaagagagagaagaagcucggagaguucggcaaggcgaaagggucucgggcuauuugguacauguggcugggcgcccgcuuucuggaguucgaagcccucggauucaugaaugaggaucauugguuuagcagagaaaacucccugucuggcguggagggggagggacuucacaagcugggcuauauccuccgggacauuagcaaaaucccugggggaaauauguacgcugaugacaccgccggcugggauacacgcaucaccgaagacgaucugcagaacgaggcuaagauuacagacaucauggaacccgagcaugcccuucuggcgaccuccauuuucaaacucacguaucagaauaagguugugagaguccaacggccugccaaaaacgggaccgugauggaugugaucucucgcagagaccagcggggcagcggacagguuggcacauacgggcugaauaccuuuacaaacauggaagcucagcugauuagacaaauggaguccgagggaaucuucagccccucugaacucgagaccccgaaccuggccgaacgcgugcuugauuggcuggagaaguauggcgucgaacggcucaagagaauggcuaucuccggggacgacugugugguuaaaccuauugaugaccgcuuugccacggcgcugacagcccuuaaugauaugggaaaggugcggaaagacaucccccagugggagccuagcaagggcuggaacgauuggcagcagguccccuucugcucucaccacuuucaucaacugauuaugaaagacgggagagagaucguggucccuugucgcaaucaggaugaacucgugggccgggcuagaguuucccagggagccggcuggagccugcgcgagaccgcuugccuggggaaguccuacgcccagauguggcaacucauguauuuccaccggagagaccugcgccuugcugccaacgcgauuuguucugccgugcccgucgauugggugccgacaagccggaccacgugguccauccaugcucaccaucaguggaugaccacagaagacaugcugagcguuuggaauagaguguggauugaggaaaacccuuggauggaggauaagacccacaucucuuccuggggagacguccccuaccucggcaaacgggaggaccaguggugcgggagccugaucggacuuacagccagagccaccugggcuacaaauauucaaguggccaucaaccaggugcgccggcugauuggcaaugaaaacuaccucgauuauaugaccucuaugaagagauuuaaaaaugagagcgaccccgaaggggcgcugugguga

SEQ ID NO: 19006 - RNA, 9879 nt, Artificial Sequence
  derived and/or modified CDS sequence (opt5) from DENV-1__FJ898374__SS-prME
agcgugaccaugcugcucaugcugaugcccaccgcccuugcuuuccaccugacgacccggggcggggaaccucauaugaucgugacaaagcaggaacggggaaaaucccuccuguuuaagaccucugccggcguuaacaugugcacccuuauugcgauggaccugggggaacucugugaagauaccaugacauacaaaugcccccgcaucaccgaagcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuauccagaacggacggcugauuacagcuaaucccaucgugacggacaaagagaagccugucaacauugaagccgagccgcccuuuggcgagagcuauaucgugauuggggugggagaaaaagcccuuaagcucucuugguucaagaaaggcagcuccaucgggaagauguuugaggcuaccgccagaggcgcucgccggauggccauccugggagauacagcgugggacuucggcucuauugggggaguuuuuaccagcgucggcaaacuggugcaucagaucuucgggacagccuacggagugcucuuuuccggcgucagcuggaccaugaagauugggaucggcgugcugcuuacguggcugggacucaauucuagauccaccagccugucuaugacauguauugcuguuggccuggugacccuuuaccucggggucauggugcaggccgauuccggaugcguuaucaacuggaaaggccgcgaacugaagugugggagcggaauuuucgugacaaaugagguccacaccuggacagaacaauauaaguuucaggcugacuccccuaaacggcugucugccgcgaucggcaaggccugggaggagggggugugcggcaucagaagcguuacccgccucgaaaacauuauguggaaacagaucuccaacgagcugaaucauauucuucuggaaaacgacaugaaguucacgguggucgugggagauguggucggcauccucgcucaggggaaaaagaugauucggccgcaacccauggagcacaaauacucuuggaaaagcuggggaaaggccaagaucaucggcgcugacguucagaauacaaccuuuauuaucgaugggccuaacacccccgaauguccugacgaucagagagccuggaauauuugggagguggaggacuauggauucggcaucuuuacaaccaacauuuggcugaagcugcgcgauuccuacacgcaggccugcgaccaccggcuuaugagcgcugcgaucaaagauucuaaggccgugcaugcugacaugggcuauuggaucgaauccgagaaaaaugaaacauggaagcucgccagagccagcuucauugaggucaagaccuguaucuggcccaaaucucacacacugugguccaacggggugcuggaaagcgagaugguuauuccgaagaucuacggaggcccuauuucucaacauaauuaucgccccggguacuucacccagacagcuggaccuuggcaccucggcaaacuggagcuugauuuugaccugugcgaagggaccacgguggucguggaugagcacugcggaaaccggggccccagccucagaaccacaaccguuacaggcaagaucauccaugaaugguguugccgguccuguacccugccuccccugcgcuucaaaggggaggacggaugcugguacggcauggagauuagaccggugaaggaaaaggaggaaaaucuugucaaaagcauggugucugccggguccggagagguugacagcuuuucccucggccugcuguguaucucuauuaugaucgaagaggugaugcggagcagauggucccgcaagaugcucaugacggggacacuggcggucuuccuucugcucauuaugggacagcugaccuggaacgaucugauccggcuuugcauuauggugggcgcuaaugccucugacagaaugggcauggggacaaccuaucuggcccucauggcuaccuuuaaaaugcgcccuauguucgccgugggacugcucuuuagacggcugacaagccgcgagguccuucugcucacgaucggccugucccugguugcgucuguggaacuucccaacagccuggaggaacucggggauggacuggcuaugggcaucaugauucucaagcugcuuaccgacuuccaaucccaccagcugugggccacacuccugagccugaccuuuaucaaaacaacccuuucucugcauuacgccuggaagacgauggcuauggugcucuccauugucagccuguucccccucugucugucuacaaccucccagaagaccacauggcuuccugugcugcuggggagccucggaugcaaaccgcugaccauguuucuuaucgccgagaauaagauuuggggcagaaaaucuuggccccugaacgaaggcaucauggcuguugggguggucuccauccuccugagcucccuccugaagaacgaugugccucuugccggaccccugauugcgggcgggaugcugaucgccuguuauguuauuagcggaucuagcgcugaccucucccuggagaaagccgcugaggugucuugggaagaggaagccgagcacagcggcgccucccauaauauccuugucgaagugcaggaugacgggacaaugaagauuaaagaugaggagcgggacgauacgcugaccauccuccugaaggcuacacuccuggcggucucuggaguguacccucuuagcauccccgccacccuguucguuugguauuuuuggcaaaagaaaaagcagcgcuccggcgugcugugggacacaccuucucccccggaagucgagagagcugugcucgaugacggcauuuaccggaucaugcagcgcgggcugcuuggaagaagccagguuggcgugggggucuuccaagaaaacguguuccacaccauguggcacgugacgcggggagccguucugauguaucagggcaaacgccucgagccuuccugggccagcgucaagaaagaccugauuucuuacgggggaggcuggagacuccagggcuccuggaauaccggggaggaaguccaggugaucgcugucgagcccggaaagaacccuaagaaugugcaaacagcccccggcaccuuuaaaacaccggaaggggagguuggagcgauugcucuggauuucaagccuggcaccagcgggucucccaucgugaaccgggaaggaaaaauugucggccuuuacggcaauggggugguuacaacguccggaaccuaugugagcgccaucgcccaggcuaaggccucccaggagggcccucugcccgagaucgaagacgaggucuuuagaaaacgcaaccugacaauuauggaucuccaucccgggucuggaaagacccggagauaccugccugcgaucgugcgcgaagcuauuaagcggaaacuuagaacccugauccucgccccgacacgcguuguggccagcgagauggcugaagcccugaagggcaugcccauucgguaucaaacgaccgcugucaaauccgagcacacagggaaggagaucguggaccugaugugccaugccaccuucacaaugagacuccuuagcccugugcgcguccccaauuacaacaugaucauuauggaugaagcgcacuuuaccgacccuucuuccaucgccgcucggggcuauauuagcacgagaguuggaaugggcgaggccgcugccaucuucaugacagccacacccccugggucuguggaggcuuuuccgcagagcaaugcggugauucaggaugaggaacgggacauccccgagcgcuccuggaacucuggauacgaguggaucaccgauuucccuggcaaaacagucugguuugugcccagcauuaaguccgggaaugacaucgccaacugucugagaaagaauggaaaacggguuauucagcugucucgcaagaccuucgauacagaauaucagaagaccaagaacaacgacugggacuacguggucacgacagauaucagcgagaugggcgcuaauuuuagagccgaccgggugauugauccuagacgcugccucaaacccguuauccugaaggacgggccggaacgggugauucuugccggcccuaugcccgucaccguggcuuccgccgcgcagagacgcggacggaucggcagaaaccauaauaaggagggggaucaguacaucuauaugggacagccccugaacaaugacgaggaucacgcucacuggacagaagccaaaaugcuccuggacaacauuaauaccccugagggcaucauucccgcccuguucgaaccugagcgcgaaaagagcgcugccaucgauggggaguaccggcucagaggagaggcgcgcaaaacguucgucgaacuuaugagacggggcgaccugccgguguggcugucuuauaagguugccuccgagggguuucaauacagcgaucgcagauggugcuucgacggcgaacggaacaaucaggugcucgaggaaaacauggauguggagauuuggaccaaagagggagaacgcaagaaacugagaccccgguggcuugacgcuagaacauauuccgacccucuggcccuccgcgaguuuaaggaguucgcugccggccggagaucugucagcggggaucugauccuggagaucggaaagcucccccagcaucuuacccagcgcgcucaaaaugcccuggacaaccugguuaugcuccacaauuccgaacagggcgggcgggcguacagacaugccauggaggagcugccugauacaauugaaacccuuaugcugcucgcucugaucgccgugcugacaggaggcgugacccucuuuuuccuuucuggccgggggcugggaaaaacgagcauuggccugcucugugucauggcuuccagcgugcugcuuuggauggccucuguugagccccacuggaucgccgcuuccauuauccuggaauuuuuccucauggugcugcugaucccggagccugaccgccagagaacaccccaggauaaccaacucgcguaugucgugauugggcuucuguuuaugauccugaccgucgccgcuaaugagaugggacuccuggaaaccacaaagaaagaccuuggcauugggcacguggccguugagaaccaucaccaugccaccaugcuggauguggaccuccacccugcuagcgccuggacacuguacgcggucgccacgaccaucauuacacccaugaugcggcauaccaucgaaaacacaaccgcuaauauuucucugacggccaucgcuaaccaggccgcgauccucaugggacuugauaagggcuggccuauuuccaaaauggacaucggcgugccccugcuggcccucgggugcuacagccagguuaauccgcugacccuuacagcugccgugcugaugcucgucgcucacuaugccauuaucggaccuggccugcaagcuaaggccacccgcgaggcgcagaagagaacagccgcugggauuaugaaaaaccccaccguggauggaaucguggccaucgaccuggaucccguugucuacgacgcuaaguucgaaaaacagcucggccagauuaugcuucugauccuguguacgucucaaauucuccugaugcggacaaccugggcccuuugcgagagcaucacacuggccaccgggccucucaccacacugugggagggauccccgggcaaguuuuggaauacgaccauugcggugucuauggcuaacaucuuccgcggcagcuaucuggccggggcuggacucgccuuuucccuuaugaaaagccugggcgggggaagacggggcacaggggcccagggagaaacccugggcgagaaguggaagcgccagcucaaucagcuguccaaaucugaguucaacaucuacaagagaagcggcauuauggagguggaccgguccgaagcuaaagaggggcuuaagagaggagagacaacccgccacgccgucucucggggcacggcgaaacugagaugguucguugaacgcaaucucgugaagcccgaggggaaggugaucgaucugggauguggcagagggggauggagcuauuacugcgccggccugaaaaaggucacagaagugaaaggcuauaccaaagggggaccuggccaugaggaacccauuccuauggcuaccuacggguggaaccucguuaaacuucacuccggaaaggacguguuuuucacacccccugagaaaugugauacccugcugugcgacaucggcgagucuagcccgaaucccacaauugaagaggggagaacgcuccgcguccugaagaugguggaaccuuggcuucggggaaaccaauuuuguaucaagauucugaaucccuacaugccuuccguuguggagacccucgagcagaugcagagaaaacauggcggcaugcugguccgcaacccccugagcagaaauucuacacacgaaauguauuggguguccugcgggaccggaaacaucgugagcgccgucaauaugacaucuagaaugcuccugaaccgcuucaccauggcucaccggaagccgacguacgagagagauguugaccuuggcgccgggacccgccauguggcgguggaaccugaggucgccaaccuggauaucauuggacagagaaucgaaaauauuaaacacgagcauaaguccacauggcacuaugacgaggauaaccccuacaaaaccugggcuuaucauggcagcuacgaagugaagcccucuggguccgccagcuccaugguuaauggaguggucaagcuccugacaaaaccuugggacgugauccccaugguuacccaaauugcuaugacagauaccacgccuuuuggccagcagcggguguucaaggagaaagucgacacacgcaccccgaaggccaaaagaggcaccgcucaaaucauggaagugacagcccgguggcuuuggggguuucugagcagaaacaagaagccccggaucuguacgcgcgaggaguucaccagaaaaguucggucuaaugcggccauuggagcuguguuugucgacgagaaccaguggaauagcgccaaggaggcuguggaagaugagcgcuucugggaccucguccagaaagaaagagagcugcacaagcagggcaaaugcgccacaugcguguauaacaugauggggaagcgggaaaagaaacugggagaguuuggcaaggccaaagggucccgcgcgaucugguacauguggcucggcgcuagauuccuggaguuugaagcccuuggauucaugaaugaggaucacugguucucucgggaaaacagccuguccggcguugagggggagggacuccauaagcugggcuacauucuucgcgacaucucuaaaauuccugggggaaauauguaugccgaugacaccgcuggcugggauacaagaaucaccgaagacgaucugcaaaacgaggccaagaucacagacauuauggaacccgagcacgcucuccuggccaccagcaucuuuaaacugacguaccagaauaaggugguccgggugcagcgcccugcgaagaacgggaccgugauggauguuauuuccagacgggaccagcgcggcucuggacaagugggcacauaugggcucaauaccuucacaaacauggaagcccagcugaucagacagauggagagcgagggaauuuuucuucccuccgaacuggagaccccgaaccucgcugaacggguccuggauuggcuugagaaacauggcguggaaagacugaagcgcauggccaucagcggggacgacuguguugugaaaccuaucgaugaccgguucgcuacggcccucacagcgcugaaugauaugggaaaggucagaaaagacauuccccagugggagccuucuaagggcuggaacgauuggcaacaggugcccuuuugcucccaccacuuccaucagcugaucaugaaggacgggcgcgagauugucgugccuugucggaaucaggaugaacucguuggcagagcccgcgugagccaaggagcuggcuggucucugcgggagaccgccugccuugggaaauccuacgcucagauguggcagcugauguauuuucacagacgcgaccuccggcuggccgcuaacgccaucuguagcgcgguccccguggauuggguuccgacauccagaaccacguggucuauucaugcccaccaucaauggaugaccacagaagacaugcuuagcguguggaaucgcgucuggaucgaggaaaacccuuggauggaggauaagacccacguguccagcuggggagacgugcccuaccugggcaaacgggaggaccaguggugcgggucucucauuggacugacagcuagagccaccugggccuccaauauccagguugcuaucaaccagguccggagacugauuggcaaugaaaacuaucucgauuacaugacaagcaugaagcgcuucaaaaaugagggggaccccgaaggcgcccugugguga

SEQ ID NO: 19007 - RNA, 9879 nt, Artificial Sequence
  derived and/or modified CDS sequence (opt5) from DENV-1__FJ898375__SS-prME
agcgugaccaugcugcucaugcugaugcccaccgcccuugcuuuccaccugacgaccagaggcggggaaccucauaugaucgucuccaagcaggaacggggaaaaucucuccuguuuaagacaagcgccggcguuaacaugugcacccuuaucgcgauggaccugggggaguucugugaagauacaaugaccuacaaaugcccgagaaucacagaagcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugauggcccuguuccuugcgcaugccaucgggacaucuauuacccagaagggaaucaucuuuauucugcucaugcuggucaccccuagcauggcuaugagaugcgugggcaucgggucccgggauuucguugagggacuuagcggcgccacauggguggacgucgugcuggagcacgggucuugugugacgaccauggcuaaggauaaacccacacucgacauugaacugcugaagaccgaggucacaaacccugccguucuccgcaaacugugcaucgaagcgaagauuuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugauugucaccgugcacacaggcgaccagcaucaaguugggaaugagagcaccgaacacggaacaaccgcuacgaucacaccccaggccccuucuacagagauccagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauucaaacaagcggaaccacaaccaucuucgcuggccaucugaagugcagacucaaaauggauaagcugacgcuuaaagggaugucuuaugugauguguacaggcuccuucaagcuggagaaggaagucgccgagacccagcacggaaccgugcucguucagauuaaauacgagggcacagacgcgccgugcaagaucccuuuuagcacccaggaugaaaaaggggugacacaaaacggacggcugauuacggcuaaucccaucgucaccgacaaggagaaaccugugaacaucgaagccgagccgcccuucggcgagucuuauauugugaucggggccggagaaaaggcucugaaacuuagcugguuuaaaaagggcuccucuauugggaaaauguucgaggccacagcuagaggcgcccgccggauggcgauccucggagauaccgccugggacuuuggcagcauugggggaguuuucacauccgucggcaagcuggugcaucagaucuuugggaccgcuuacggagugcuguucagcggcgucucuuggacgaugaaaaucgggauuggcgugcuccugaccuggcuuggacucaauuccagaagcacaucucucuccaugaccuguaucgccguuggccuggugacacuguaccuuggggucauggugcaggcugauagcggaugcguuauuaacuggaagggccgcgaacucaaguguggguccggaaucuuugugaccaaugagguccacacauggaccgaacaguauaaauuccaagccgacucuccuaagcggcugagcgcggccauuggcaaggcuugggaggagggggugugcggcaucagauccgccacgcgccuggaaaacauuauguggaagcagaucucuaacgagcucaaucauauccugcuugaaaacgacaugaaauuuacaguuguggucggagauguggcuggcauucuggcccaggggaagaaaaugauccggccgcagcccauggaguacaaguauagcuggaaguccuggggaaaagccaagauuaucggcgcugacgugcaaaauaccaccuucauuaucgaugggccuaacacacccgaauguccugacgaucagagagcguggaauaucugggaggucgaggacuacggauuuggcauuuucaccacgaacaucuggcucaaacugcgcgauagcuauacacagguuugcgaccaccggcugaugucugccgcuauuaaggauuccaaagccgugcacgccgacaugggcuacuggaucgaaagcgagaagaaugaaaccuggaaacuugcuagagccucuuucauugaggugaagacauguaucuggcccaagucccauacccucuggagcaacgggguccuggaaucugagaugaucauuccgaaaaucuauggaggcccuauuagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaaucauucacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguaucagcauuaugaucgaagaggugaugcgguccagauggucucgcaaaaugcugaugacagggacccucgccgucuuuuuccugcuuauuaugggacagcugacauggaacgaucucauccggcugugcauuauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccaucggccugucucucguggccagcgucgaacugcccaacucccuggaggaacuuggggauggacuggccaugggcauuaugauccucaaacugcucacagacuuccagagccaucaacugugggcuacccuucugucucucacauuuaucaagaccacguucucccugcacuaugccuggaagacaauggcuaugguucugagcauugugucucuuuuuccccugugucucuccaccaccagccagaaaacaaccuggcugccugugcuccuggggucucuuggaugcaagccgcugacaauguuccugaucgccgagaauaaaauuuggggcagaaaguccuggccccucaacgaaggcaucauggcggucgggauugugagcauccugcuuuccagccugcucaaaaacgauguuccucuggccggaccccucaucgcuggcgggaugcugauugccuguuacgugaucucuggaagcuccgcugaccuuucucuggagaaggccgccgaggucagcugggaagaggaagcugagcauuccggcgcgucucacaauauucugguggaaguucaggaugacgggacgaugaaaaucaaggaugaggagcgggacgauacccucacaauucugcuuaaggccacccugcucgcugugagcggagucuauccucuguccauccccgccacacucuucgugugguacuuuuggcagaaaaagaaacaacgcucuggcguccugugggacaccccuuccccucccgaaguggagagagccguucuugaugacggcaucuaucggauuaugcagcgcgggcugcugggaagaucccaggugggcgucgggguguuccaggaaaacguuuuucauacgauguggcacgugacccggggagcuguccucauguaccaaggcaagcgccuggagcccagcugggccucugugaaaaaggaccuuaucuccuacgggggaggcuggagacugcagggcagcuggaauacaggggaggaagugcagguuauugcggucgagcccggaaagaacccuaaaaaugugcagaccgcucccggcacauucaagaccucugaaggggaggugggagccaucgcccucgauuuuaaaccgggcacauccgggagcccuauugucaaccgggaaggaaagaucgugggccuguauggcaaugggguugugacgaccuccggaacauacgucucugcuauugcccaagcgaaagcuagccaggagggcccccucccugagaucgaagacgagguguucagaaagcgcaaccugaccaucauggaucuucaccccggguccggaaagacccggagauaucugcccgccauuguucgcgaagccaucaaacggaagcugagaacacucauucuggcuccuacgcgcguggucgccagcgagauggcugaagcccuuaaaggcaugccgauccgguaccagaccacagcggugaagucugagcauaccgggaaagagauuguugaccugaugugccacgccacauuuaccaugagacuccugucccccgugcgcgucccuaauuauaacaugaucaucauggaugaagcucauuucacggaccccagcucuauugccgcucggggcuacaucagcacaagagugggaaugggcgaggccgccgcuauuuuuaugaccgcgaccccucccggguccguggaagccuucccucaaucuaaugcugucauccaggaugaggaacgggacauuccggagcgcagcuggaacuccggauaugaguggaucacagauuuucccggcaagaccguuugguucgugccuucuaucaagagcgggaaugacauugccaacugucugcgcaaaaauggaaagcgggugauccagcucucccgcaaaacauucgauaccgaauaccagaagacgaaaaacaacgacugggacuacgucgugacaaccgauauuagcgagaugggcgccaauuuuagagcugaccggguuaucgaucccagacgcugccuuaagccugugauucugaaggacgggcccgaacgggucauccuggccggcccgaugccugugacaguugcgucugcugcccaaagacgcggacggauuggcagaaaccacaauaaagagggggaucaguauaucuacaugggacagccccucaacaaugacgaggaucaugcccacuggaccgaagcuaagaugcugcuugacaacaucaauacgcccgagggcauuaucccugcccuguucgaacccgagcgcgaaaaauccgcggccauugauggggaguaucggcucagaggagaggcucgcaagaccuuuguggaacugaugagacggggcgaccugccugucuggcucagccacaaaguggccuccgagggguuccaguacucugaucgcagauggugcuuugacggcgaacggaacaaucaaguccuugaggaaaacauggauguggagaucuggacaaaggagggagaacgcaaaaagcugagaccgcgguggcuggacgcuagaaccuauagcgacccccucgcccugcgcgaguucaaggaauuugcugccggccggagauccguuucuggggaucuuauucuggagaucggaaaacucccucagcaucugacacagcgcgcgcagaaugcccuggacaaccucgugaugcuucacaauagcgaacaaggcgggcgggcuuacagacaugccauggaggagcugcccgauaccaucgaaacacugaugcuccuggcucuuauugccgugcugaccggaggcgucacgcuguucuuucuguccggccgggggcugggaaagacaagcaucggccuccuuuguguuauggccucuuccgugcugcuguggauggcuagcguggagccucacuggauugcggccucuaucauucucgaguucuuucugaugguccuucugauccccgagccggaccgccagagaaccccucaggauaaccagcucgcuuaugugguuaucgggcugcuguucaugauucucaccguggccgccaaugagaugggacuucuggaaacaaccaaaaaggaccugggcaucgggcacgucgcuguggagaaacaucaccaugccgcgaugcucgaugucgaccugcaccccgccuccgcuuggacacuuuacgccguggcuacgaccauuaucacaccuaugaugcggcauaccauugaaaacacaaccgccaacaucagccugacggcgauugccaaucaagcugccauccucaugggacuggauaagggcuggcccaucucuaagauggacauuggcguuccucugcucgcucuugggugcuacagccaggugaacccccugacccugacagccgcuguccucaugcugguggcccacuaugcgaucauuggaccgggccuucaggccaaagcuacccgcgaggcccaaaagagaacagcugccgggaucaugaaaaauccuaccguugauggaauuguggccaucgaccuggaucccgucguguacgacgcgaaguuugaaaaacagcucggccagaucaugcugcugauucucuguacgucccagauccuucugaugcggacaaccugggcucugugcgagucuauuacacucgccaccgggccccugaccacacuuugggagggaagcccuggcaaguucuggaacacgaccaucgcuguguccauggccaauauuuuccgcggcagcuaucuggccggggcuggacucgccuuuucccugaugaagucucugggcgggggaagacggggcacaggggcgcaaggagaaacccucggcgagaaauggaagcgccagcuuaaccagcugagcaaauccgaguucaauacauacaagagaucuggcaucauggagguugaccggagcgaagccaaagaggggcugaagagaggagagaccacgaagcacgcugucucccgcggcacagccaaacuccggugguuuguggaaagaaaccuggugaagccggaggggaaagucaucgaucuuggauguggccgcgggggauggucuuauuacugcgcuggccugaagaaaguuaccgaagugaagggcuauaccaaagggggacccggccaugaggaaccuauucccauggccacauacggguggaaucucgugaagcugcacagcggaaaggacgucuucuuuaucccucccgagaaaugugauacccugcucugcgacauuggcgaguccagcccuaacccgacaaucgaagaggggcggacgcuuagagugcugaagaugguugaacccuggcugcgcggaaaucaguucuguauuaaaauccucaacccuuacaugcccucuguggucgagacccuggagcaaaugcagcggaagcauggcggcaugcuugugagaaauccucugucccgcaacagcacacacgaaauguauuggguuucuugcgggaccggaaauauuguguccgcggucaacaugacaagccggaugcuccugaauagauuuaccauggcccaccgcaaacccacguacgagcgggauguggaccugggcgcugggaccagacauguggccgucgaaccggagguugcuaaccucgauaucaucggacagcgcauugaaaacaucaagcacgagcauaagucuacauggcacuaugacgaggauaauccuuacaaaaccugggccuaucauggcuccuacgaagugaagcccagcggguccgcuagcucuauggugaacggagucgugaaacugcuuacaaagcccugggacguuauuccuauggugacccagaucgccaugacagauaccacgcccuucggccaacagagagucuuuaaagagaagguggacacacggaccccuaaggcgaaacgcggcaccgcccagauuauggaaguuacagcuaaguggcuguggggguuccucagcagaaauaaaaagccgcggaucuguacgagagaggaauuuacccggaaagugcgcuccaacgccgcuaucggagccgucuucguggacgagaaucaauggaacucugccaaggaggcgguugaagaugagagauuuugggaccuggugcaccgggaacgcgagcuucacaagcagggcaaaugcgcuacaugcgucuauaauaugauggggaagagagagaaaaagcugggagaguucggcaaagccaaggggagccgggccauuugguacauguggcucggcgcucgcuuccuggaguuugaagcccugggauucaugaacgaggaucauugguuuuccagagaaaauucucucagcggcguggagggggagggacugcacaaacuuggcuacauccugcgggacauuuccaagauccccgggggaaacauguaugcugaugacaccgccggcugggauacacgcauuaccgaagacgaucuccagaaugaggcgaagaucacagacaucauggaaccugagcaugcccugcuugcuaaaucuauuuucaagcugaccuaccagaacaaagucgugagaguucaacggcccgccaagaaugggacggugauggaugucaucagccgcagagaccagcggggcuccggacaggugggcaccuaugggcucaacacauuuaccaauauggaagcucagcugauucgccaaauggagagcgagggaaucuucucuccuuccgaacuggagacacccaaccucgccggcagagugcuggauuggcuugaaaaacacgggguugagcggcugaagagaauggcgauuagcggagacgacuguguggucaagccgaucgaugaccgcuuugccaccgcucucacggcccugaacgauaugggcaaagugcggaaggacaucccucagugggaacccucuaaaggguggaaugauuggcagcagguuccuuucugcucccaccauuuucaccaacuuauuaugaaggacggcagagagaucgugguccccugucgcaaccaggaugagcuggugggacgggcuagagucagccagggcgccggguggucccuccgcgaaacagcuugccugggaaaaucuuacgcccagauguggcaacugauguauuuccaucggagagaccuccgccuggcggccaaugcuauuuguagcgccgugccuguugauugggugcccaccucccggacaaccuggagcauccacgcccaucaccaguggaugacgaccgaggacaugcuuucugucuggaacagaguguggauugaagagaauccguggauggaagauaagacacacaucuccagcuggggcgacguuccuuaccuggggaagcgcgaggaccaguggugcggaucucucauuggccugaccgcucgggccacaugggcgaccaacauccaaguggcuaucaaucaggucagacggcuuauugggaacgagaauuaucuggauuacaugacaagcaugaaaagauuuaagaacgaauccgaccccgagggcgcccucugguga

SEQ ID NO: 19008 - RNA, 9879 nt, Artificial Sequence
  derived and/or modified CDS sequence (opt5) from DENV-1__FJ898376__SS-prME
agcgugaccaugcugcucaugcugaugcccaccgcccuugcuuuccaccugacgacccggggcggggaaccucauaugaucgucacaaagcaggaacggggaaaaucccuccuguuuaagaccucugccggcguuaacaugugcacccuuauugcgauggaccugggggaacucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccguugcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugucauugggaccuccaucacccagaagggaaucauuuucauccuccugaugcuugugacaccuucuauggccaugagaugcguuggcauugggagccgggauuuuguggagggacuguccggcgcuacgugggucgacguggugcucgagcacgggagcugugucaccacaauggccaaggauaaacccacccuggacaucgaacugcucaagacagagguuaccaacccugcugugcugcgcaaacuuugcauugaagccaagaucucuaauacgacaaccgauuccagauguccgacccaaggagaggcgacacugauggaagaacaagacgccaacuucgugugccggcgcaccuuugucgauagaggcuggggcaauggguguggacucuucggcaaagggagccugauuacaugcgcuaaguuuaagugcgugacgaaacuugagggaaagaucguucaguacgaaaaccugaaauauucugugaucgucaccgugcacacaggcgaccagcaucaaguugggaaugaguccaccgaacacggaacaaccgccacgauuacaccccaggcuccuacaagcgagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggccuccaccucucaagagacauggaaucgccaggaccugcucgugaccuucaaaaccgcucacgcgaagaagcaggaagucgugguucugggaagccaagagggcgccaugcacacagcucugacgggggccaccgaaauucagacauccggaaccacaaccaucuuugccggccaucucaaaugcagacugaagauggauaaacuuacgcugaaggggaugagcuaugugauguguacaggcucuuucaaacucgagaaggaagucgcugagacccagcacggaaccgugcugguucagauuaaguacgagggcacagacgccccgugcaaaaucccuuucuccacccaagaugaaaagggggugacacagaacggacggcugaucacggcgaaucccauugucaccgacaaagagaagccugugaacaucgaagcugagccgcccuuuggcgagagcuauauugugaucggggccggagaaaaagcccuuaagcucucuugguucaagaaaggcagcuccauugggaagauguuugaggcuacagccagaggcgcucgccggauggccauccugggagauaccgcgugggacuucggcucuaucgggggaguuuuuacaagcgucggcaaacuggugcaucagauuuucgggaccgccuacggagugcucuuuuccggcgucagcuggacgaugaagaucgggauuggcgugcugcuuaccuggcugggacucaauucuagauccacaagccugucuaugaccuguaucgcuguuggccuggugacacuuuaccucggggucauggugcaggccgauuccggaugcguuauuaacuggaaaggccgcgaacugaagugugggagcggaaucuucgugaccaaugagguccacacauggaccgaacaauauaaguuucaggcugacuccccuaaacggcugucugccgcgauuggcaaggccugggaggagggggugugcggcaucagaagcgcuacgcgccucgaaaacaucauguggaaacagauuuccaacgagcugaaucauauccuucuggaaaacgacaugaaguucacaguuguggucggagauguggugggcauucucgcccaggggaaaaagaugauccggccgcaacccauggagcacaaauacucuuggaaaagcuggggaaaggcuaagauuaucggcgccgacguccagaauaccaccuuuaucauugaugggccuaacacacccgaauguccugacgaucagagagccuggaauaucugggagguugaggacuauggauucggcauuuuuaccacgaacaucuggcugaagcugcgcgauucccacacacaggugugcgaccaucggcuuaugagcgcugcgauuaaagauucuaaggccgugcacgcugacaugggcuacuggaucgaauccgagaaaaaugaaaccuggaagcucgccagagccagcuucaucgaggucaagacauguauuuggcccaaaucucauacccugugguccaacggggugcuggaaagcgagaugaucauuccgaagaucuauggaggcccuauuucucaacacaauuaccgccccggguauuucacacagaccgcuggaccuuggcaccucggcaaacuggagcuugauuuugaccugugcgaagggacgaccguuguggucgaugagcauugcggaaaccggggccccagccucagaacaaccacagugaccggcaagaucauccacgaaugguguugccgguccuguacgcugccuccccugcgcuucaaaggggaggacggaugcugguacggcauggagauuagaccgguuaaggaaaaggaggaaaaucuugugaaaagcauggucucugccggguccggagagguggacagcuuuucccucggccugcuguguaucucuauuaugaucgaagagguuaugcggagcagauggucccgcaagaugcucaugacagggacccuggcgguguuccuucugcucauuaugggacagcugacauggaacgaucugauccggcuuugcauuauggucggcgcuaaugccucugacagaaugggcauggggaccaccuaccuggcccucauggcuacauuuaaaaugcgcccuauguucgccgugggacugcucuuuagacggcugacgagccgcgaggugcuucugcucaccaucggccugucccuggucgcgucuguugaacuucccaacagccuggaggaacucggggauggacuggcuaugggcaucaugauucucaagcugcuuacagacuuccaaucccaucagcugugggccacccuccugagccugacauuuaucaaaaccacgcuuucucugcacuaugccuggaagacaauggcuauggugcucuccauugugagccuguucccccucugucugucuaccaccucccagaagacaaccuggcuuccuguccugcuggggagccucggaugcaaaccgcuggccauguuucuuaucgcugagaauaagauuuggggcagaaaaucuuggccccugaacgaaggcaucauggccguggggguuguguccauccuccugagcucccuccugaagaacgaugucccucuugcgggaccccugauugccggcgggaugcugaucgcuuguuacgugauuagcggaucuagcgccgaccucucccuggagaaagcugccgagguuucuugggaagaggaagccgagcauagcggcgcuucccacaauauccuuguggaaguccaggaugacgggacaaugaagauuaaagaugaggagcgggacgauacgcugaccauccuccugaaggcgacacuccuggccgugucuggagucuauccucuuagcauccccgcuacccuguucgugugguacuuuuggcaaaagaaaaagcagcgcuccggcguucugugggacacaccuucucccccggaaguggagagagccguccucgaugacggcauuuaucggaucaugcagcgcgggcugcuuggaagaagccaggugggcguugggguguuccaagaaaacgucuuccacaccauguggcaugugacgcggggagccgugcugauguaccagggcaaacgccucgagccuuccugggcuagcguuaagaaagaccugauuucuuaugggggaggcuggagacuccagggcuccuggaauaccggggaggaaguccaggugaucgccguggagcccggaaagaacccuaagaauguccaaacagcgcccggcaccuuuaaaacaccggaaggggaggugggagcuauugcccuggauuucaagccuggcaccagcgggucucccaucguuaaccgggaaggaaaaauugugggccuuuacggcaauggggucgugacaacguccggaaccuacguuagcgccaucgcucaggccaaggcgucccaggagggcccucugcccgagaucgaagacgagguguuuagaaaacgcaaccugacaauuauggaucuccaccccgggucuggaaagacccggagauaucugccugcuaucguccgcgaagccauuaagcggaaacuuagaacccugauccucgccccgacacgcgugguugcuagcgagauggccgaagcucugaagggcaugcccauucgguaccaaacgaccgccgugaaauccgagcauacagggaaggagaucgucgaccugaugugccacgcgaccuucacaaugagacuccuuagcccugugcgcgugcccaauuauaacaugaucauuauggaugaagcccauuuuaccgacccuucuuccaucgcugcccggggcuacauuagcacgagagucggaaugggcgaggcugccgccaucuucaugacagcuacacccccugggucuguugaagcguuuccgcagagcaaugccgugauucaggaugaggaacgggacauccccgagcgcuccuggaacucuggauaugaguggaucaccgauuucccuggcaaaacagugugguuuguccccagcauuaaguccgggaaugacaucgcuaacugucugagaaagaauggaaaacgggugauucagcugucucgcaagaccuucgauacagaauaccagaagaccaagaacaacgacugggacuauguugugacgacagauaucagcgagaugggcgccaauuuuagagccgaccgggucauugauccuagacgcugccucaaacccgugauccugaaggacgggccggaacggguuauucuugcuggcccuaugcccgugaccgucgccuccgcggcucagagacgcggacggaucggcagaaaccacaauaaggagggggaucaguacaucuacaugggacagccccugaacaaugacgaggaucacgcccauuggacagaagccaaaaugcuccuggacaacauuaauaccccugagggcaucauucccgcucuguucgaaccugagcgcgaaaagagcgccgcgaucgauggggaguaucggcucagaggagaggcccgcaaaacguucguggaacuuaugagacggggcgaccugccggucuggcugucuuacaagguggcuuccgagggguuucaauauagcgaucgcagauggugcuucgacggcgaacggaacaaucagguucucgaggaaaacauggauguggagauuuggaccaaagagggagaacgcaagaaacugagaccccgguggcuugacgccagaacauacuccgacccucuggcucuccgcgaguuuaaggaguucgccgcuggccggagaucugugagcggggaucugauccuggagaucggaaagcucccccagcaccuuacccagcgcgcccaaaaugcgcuggacaaccuggucaugcuccauaauuccgaacagggcgggcgggccuauagacacgcuauggaggagcugccugauacaauugaaacccuuaugcugcucgcccugaucgcuguucugacaggaggcgugacccucuuuuuccuuucuggccgggggcugggaaaaacgagcauuggccugcucugugugauggccuccagcguccugcuuuggauggccucuguggagccccacuggaucgcugcguccauuauccuggaauuuuuccucaugguucugcugaucccggagccugaccgccagagaacaccccaggauaaccaacucgccuacguggucauugggcuucuguuuaugauccugaccguggcugccaaugagaugggacuccuggaaaccacaaagaaagaccuuggcauugggcaugucgccguggagaaccaccaucacgcuaccaugcuggauguugaccuccauccugccagcgcguggacacuguaugccguggcuacgaccaucauuacacccaugaugcggcacaccaucgaaaacacaaccgccaauauuucucugacggcuaucgccaaccaggcggccauccucaugggacuugauaagggcuggccuauuuccaaaauggacaucggcgucccccugcuggcucucgggugcuacagccaggugaauccgcugacccuuacagccgcuguucugaugcucguggcccacuacgcuauuaucggaccuggccugcaagccaaggcgacccgcgaggcccagaagagaacagcugccgggauuaugaaaaaccccaccgucgauggaaucguggcuaucgaccuggaucccgugguuuaugacgccaaguucgaaaaacagcucggccagauuaugcuucugauccuguguacgucucaaauucuccugaugcggacaaccugggcccuuugcgagagcaucacacuggcgaccgggccucucaccacacugugggagggauccccgggcaaguuuuggaauacgaccauugcugucucuauggccaacaucuuccgcggcagcuaccuggcuggggccggacucgccuuuucccuuaugaaaagccugggcgggggaagacggggcacaggggcucagggagaaacccugggcgagaaguggaagcgccagcucaaucagcuguccaaaucugaguucaacaucuauaagagaagcggcauuauggagguggaccgguccgaagccaaagaggggcuuaagagaggagagacaacccgccaugcggugucucggggcacggccaaacugagaugguucgucgaacgcaaucucguuaagcccgaggggaaggugaucgaucugggauguggcagagggggauggagcuacuauugcgcuggccugaaaaaggugacagaagucaaaggcuacaccaaagggggaccuggccacgaggaacccauuccuauggccaccuauggguggaaccucgugaaacuucauuccggaaaggacgucuuuuucacacccccugagaaaugugauacccugcugugcgacaucggcgagucuagcccgaaucccacaauugaagaggggagaacgcuccgcgugcugaagauggucgaaccuuggcuucggggaaaccaauuuuguaucaagauucugaaucccuacaugccuuccgugguugagacccucgagcagaugcagagaaaacacggcggcaugcuggugcgcaacccccugagcagaaauucuacacacgaaauguacugggucuccugcgggaccggaaacaucgugagcgcugugaauaugacaucuagaaugcuccugaaccgcuucaccauggcccaucggaagccgacguaugagagagaugucgaccuuggcgcggggacccgccacguugccguggaaccugagguggcuaaccuggauaucauuggacagagaaucgaaaauauuaaacaugagcacaaguccacauggcauuacgacgaggauaaccccuauaaaaccugggccuaccacggcagcuaugaagucaagcccucuggguccgcuagcuccauggugaauggaguugugaagcuccugacaaaaccuugggacgucauccccauggugacccaaauugccaugacagauaccacgccuuuuggccagcagcggguuuucaaggagaaaguggacacacgcaccccgaaggcuaaaagaggcaccgcccaaaucauggaagucacagcgcgguggcuuuggggguuucugagcagaaacaagaagccccggaucuguacgcgcgaggaguucaccagaaaagugcggucuaaugccgcuauuggagccguuuuuguggacgagaaccaguggaauagcgcuaaggaggccgucgaagaugagcgcuucugggaccucgugcagaaagaaagagagcugcacaagcagggcaaaugcgccacaugcgucuacaacaugauggggaagcgggaaaagaaacugggagaguuuggcaaggcgaaagggucccgcgcuaucugguauauguggcucggcgccagauuccuggaguuugaagcccuuggauucaugaaugaggaucauugguucucucgggaaaacagccuguccggcguggagggggagggacuccacaagcugggcuacauucuucgcgacaucucuaaaauuccugggggaaauauguacgcugaugacaccgccggcugggauacaagaaucaccgaagacgaucugcaaaacgaggcuaagaucacagacauuauggaacccgagcaugcccuccuggcgaccagcaucuuuaaacugacguaucagaauaagguugugcggguccagcgcccugccaagaacgggaccgugauggaugugauuuccagacgggaccagcgcggcucuggacaaguuggcacauacgggcucaauaccuucacaaacauggaagcucagcugaucagacagauggagagcgagggaauuuuucuucccuccgaacuggagacccagaaccucgccgaacgggugcuggauuggcuugagaaauauggcgucgaaagacugaagcgcauggcuaucagcggggacgacugugugguuaaaccgaucgaugaccgguucgccacggcgcucacagcccugaaugauaugggaaaggugagaaaagacauuccucaaugggagcccucuaagggcuggaacgauuggcagcaggucccuuuuugcucccaccacuuccaucagcugaucaugaaggacgggcgcgagauugugguccccugucggaaucaagaugaacucgugggcagagcucgcguuagccagggagccggcuggucucugcgggagaccgcuugccuugggaaauccuacgcccagauguggcaacugauguauuuucacagacgcgaccuccggcuggcugccaacgcgaauuguagcgccgugccugucgauugggugcccacauccagaaccacguggucuauccaugcucaccaucaguggaugaccacagaagacaugcuuagcguuuggaaccgcguguggauugaggaaaauccguggauggaggauaagacccacgucuccagcuggggagacgugccuuaccugggcaaacgggaggaccaguggugcgggucucucaucggacugacagccagagccaccugggcuuccaacauucagguggccaucaaucaaguucggagacugaucggcaacgaaaauuaucucgauuacaugacaagcaugaagcgcuucaaaaacgagggggaccccgaaggcgcgcugugguga

SEQ ID NO: 19009 - RNA, 9879 nt, Artificial Sequence
  derived and/or modified CDS sequence (opt5) from DENV-1__FJ898379__SS-prME
agcgugaccaugcugcucaugcugaugcccacagcccuugcuuuccaccugacgaccagaggcggggaaccucauaugaucgucuccaagcaggaacgggggaaaucucuccuguuuaagacaagcgccggcguuaacaugugcacccuuauugccauggaccugggggaacucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugucauugggaccucuaucacccagaagggaaucauuuucauccuccugaugcuugugacaccuagcauggcgaugagaugcguuggcauugggucccgggauuuuguggagggacugagcggcgccacgugggucgacguggugcucgagcacgggucuugugucaccacaauggcuaaggauaaacccacccuggacaucgaacugcucaagacagagguuaccaacccugccgugcugcgcaaacuuugcauugaagcuaagaucuccaauacgacaaccgauagcagauguccgacccaaggagaggccacacugguggaagaacaagacgcgaacuucgucugccggcgcaccuuuguggauagaggcuggggcaauggguguggacucuucggcaaagggucucugauuacaugcgccaaguuuaagugcguuacgaaacuugagggaaagaucgugcaguacgaaaaccugaaauauuccgucaucgugaccguucacacaggcgaccagcaucaaguggggaaugagagcaccgaacacggaacaaccgcuacgauuacaccccaagccccuaccaccgagauccagcucacagacuacggcgcucugacccuggauuguucuccccggacgggccucgacuucaacgaaaugguccugcuuacaaugaaggagaaauccuggcuggugcauaagcagugguuucucgaucugccucuucccuggaccagcggggccuccacaucucaagagaccuggaaucgccaggaccugcucgucaccuucaaaacagcccacgcuaagaagcaggaagugguugugcugggaagccaagagggcgcgaugcacacggcccugaccggggcuacagaaauucagaccuccggaacaaccacgaucuuugccggccaucucaaaugcagacugaagauggauaaacuuacacugaaggggaugagcuaugucauguguaccggcucuuucaaacucgagaaggaaguggccgagacccagcacggaacaguucuggugcagauuaaguacgagggcaccgacgcuccgugcaaaaucccuuucuccacacaagaugaaaagggggucacgcagaacggacggcugaucaccgccaaucccauugugacagacaaagagaagccugugaacaucgaagcggagccgcccuuuggcgagagcuauauuaucauuggggcuggagaaaaagcccuuaagcucucuugguucaagaaaggcagcuccaucgggaagauguuugaggccaccgcuagaggcgcccgccggauggcuauccugggagauacagccugggacuucggcucuauugggggaguuuuuaccagcgucggcaaacuggugcaucagaucuucgggacggcguacggagugcucuuuuccggcgucagcuggaccaugaagauugggaucggcgugcugcuuacauggcugggacucaauucuagauccaccagccugucuaugacauguauugccguuggccuggugacccuuuaccucggggucauggugcaggcugauuccggaugcguuaucaacuggaaaggccgcgaacugaagugugggagcggaauuuucgugacaaaugagguccacaccuggacggaacaauauaaguuucaggccgacuccccuaaacggcugucugcugccaucggcaaggcgugggaggagggggugugcggcaucagaagcgccacacgccucgaaaacauuauguggaaacagaucuccaacgagcugaaucauauucuucuggaaaacgacaugaaguucaccguuguggucggagauguggcuggcauccucgcccaggggaaaaagaugauucggccgcaacccauggaguacaaauauucuuggaaaagcuggggaaaggcuaagaucaucggcgccgacgugcagaauaccacauuuauuaucgaugggccuaacacccccgaauguccugacgaucagagagccuggaauauuugggaggucgaggacuacggauucggcaucuuuacgacaaacauuuggcugaagcugcgcgauuccuauacccagguuugcgaccaccggcuuaugagcgcugcgaucaaagauucuaaggccgugcacgcugacaugggcuacuggaucgaauccgagaaaaaugaaacauggaagcucgccagagccagcuucauugaggugaagaccuguaucuggcccaaaucucauacacugugguccaacgggguccuggaaagcgagaugauuaucccgaagauuuauggaggcccuaucucucaacacaauuaccgccccggguacuucacccagacggcuggaccuuggcaucucggcaaacuggagcuugauuuugaccugugcgaagggaccacagugguuguggaugagcacugcggaaaccggggccccagccucagaaccacaaccgucacgggcaagaucauucacgaaugguguugccgguccuguacacugccuccccugcgcuucagaggggaggacggaugcugguauggcauggagauccggccggugaaagaaaaggaggaaaaucuuguuaagagcauggugucugccggguccggagaggucgacagcuuuucccucggccugcuguguauuucuaucaugauugaagaggugaugagaagccgcuggucccggaaaaugcucaugaccgggacacuggcgguuuucuuucuucugaucaugggacagcucaccuggaacgaucugauuagacugugcaucauggugggcgcuaaugccucugaccgcaugggcauggggaccacauaccuugcccugauggcuacguucaagaugagaccuauguuugccgucggacuccuguuccggcgccucaccagcagagaggugcugcuucugacaaucggccucucccugguggcgucugucgaacugcccaacagccuugaggaacugggggauggacucgcuaugggcauuaugauccugaaacuccugaccgacuuucaaucccaucagcuuugggccacacugcucagccugaccuucauuaagacgacauuuucucugcacuaugccuggaaaaccauggcuaugguucuuuccaucgugagccuguucccccucugucugucuaccacaucccagaagaccacauggcucccugugcugcuugggagccugggaugcaagccgcugacgauguuucucauugccgagaauaaaaucuggggccggcgcucuuggccccugaacgaaggcaucauggcugucgggauuguguccauccuucugagcucccuccugaagaacgauguuccucucgccggaccccugauugcgggcgggaugcuuaucgccuguuacgugauuagcggaucuagcgcugaccugucccuggagaaagccgcugaggucucuugggaagaggaagccgagcauagcggcgccucccacaauauccucguggaaguucaggaugacgggaccaugaagaucaaagaugaggagagagacgauacacugaccauucuucugaaggcuacacuccuggcggugucuggagucuauccucucagcauccccgccacccuguucgugugguacuucuggcagaagaagaagcagcgguccggcguccuuugggacacgccuucucccccggaaguggagcgcgcuguucuggaugacggcauuuauagaaucaugcagcgggggcugcucggacgcagccaggugggcgucgggguguuucaagaaaacguuuuccauaccauguggcacgugacaagaggagccguccugauguaccagggcaaacggcuugagccuuccugggccagcgugaagaaagaccugauuucuuacgggggaggcuggagacuccagggcuccuggaauaccggggaggaagugcagguuaucgcugucgagcccggaaagaacccuaaaaaugugcaaacagcccccggcaccuuuaagacaccggaaggggaggugggagcgauugcucuggauuucaagccuggcacgagcgggucucccaucgucaaccgcgaaggaaaaaucgugggccucuauggcaaugggguugugaccacauccggaaccuacgucagcgccauugcccaggcuaaggccucccaggagggcccucugcccgagaucgaagacgagguguuucggaaaagaaaccuuaccauuauggaucugcaccccgggucuggaaagacacgccgguaucugccugcgaucguuagagaagcuauuaaacgcaagcuccggacgcugauccuugccccgaccagaguggucgccagcgagauggcugaagcccugaagggcaugcccauccgcuaccaaacaaccgcugugaaauccgagcauacagggaaggagauuguugaccucaugugccacgccaccuucacgaugcggcugcugagcccugugagaguccccaauuauaacaugaucauuauggaugaagcgcauuuuacagacccuucuuccaucgccgcucggggcuacauuagcacccgcgugggaaugggcgaggccgcugccaucuucaugaccgccacacccccugggucuguggaggcuuuuccgcagagcaaugcggucauccaggaugaggaaagagacauucccgagcgguccuggaacucuggauaugaguggaucaccgauuucccuggcaaaacaguuugguuugugcccagcauuaaguccgggaaugacaucgccaacugucuccgcaaaaauggaaagagagugauucagcuuucucggaagaccuucgauacggaauaccagaaaaccaagaacaacgacugggacuacgucgugaccacagauaucagcgagaugggcgcuaauuucagagccgaccgcguuauugauccucggagaugccugaaacccgugauccugaaggacgggccggaacgcgucauccucgccggcccuaugcccgugaccguugcuuccgccgcgcagcggagaggacgcauuggccggaaccacaauaaagagggggaucaguauaucuacaugggacagccccugaacaaugacgaggaucaugcucacuggacggaagccaagaugcuucuggacaacauuaauaccccugagggcaucauucccgcccucuuugaaccugagagagaaaagagcgcugccaucgauggggaguaucgccugagaggagaggcgcggaaaacauucguggaacugaugcgcagaggcgaccucccggucuggcuuucuuacaagguggccuccgagggguuucaauauagcgaucggcgcuggugcuucgacggcgaaagaaacaaucagguccuggaggaaaacauggauguggagaucuggaccaaagagggagaacggaagaaacugagaccccgcuggcucgacgcucggacauacuccgacccucuggcccuuagagaguuuaaggaguucgcugccggccgccggucuguuagcggggaucugauucucgagaucggaaaacugccccagcaccugacccagagagcucaaaaugcccucgacaaccuugugaugcugcauaauuccgaacagggcgggcgggcguaucgccacgccauggaggagcugccugauacaauugaaacccucaugcugcuugcucugaucgccgugcucacgggaggcgucacacuguuuuuccugucuggcagagggcucggaaagaccagcauuggccuucuguguguuauggcuuccagcgugcugcucuggauggccucuguggagccccauuggaucgccgcuuccaucauucuggaauuuuuccuuaugguccugcucaucccggagccugaccggcagcgcacaccccaggauaaccaacuggcguacgugguuauugggcugcucuuuaugauccuuacaguggccgcuaaugagaugggacugcuggaaaccacaaagaaagaccucggcauugggcacgucgccguggagaaccaccaucacgccgcuaugcuggaugucgaccuucauccugccagcgcguggacgcuguacgccguggcuaccacaaucauuacccccaugaugagacacacaaucgaaaacaccacggccaauaucucucucaccgcuauugccaaccaggcggccauccugaugggacuggauaagggcuggccuauuuccaaaauggacaucggcguuccccuccuugcucuggggugcuauagccaggugaauccgcugacacucaccgccgcuguccugaugcuuguggcccauuacgcuauuaucggaccuggccugcaagccaaggcgacacgggaggcccagaaacgcaccgcugccgggaucaugaagaaccccacgguugauggaauuguggcuaucgaccucgaucccgucguguaugacgccaaguucgaaaaacagcugggccagauuaugcugcucauccuuuguacaucucaaauucugcugaugagaaccacaugggcccucugcgagagcaucacccuggcgaccgggccucuuacaacgcugugggagggauccccgggcaaguuuuggaauaccacaaucgcugugucuauggccaacauuuuccggggcagcuaccucgcuggggccggacuggccuucucccugaugaaaagccucggcgggggacgcagaggcaccggggcucagggagaaacacuuggcgagaaguggaaacggcagcugaaucagcuguccaagucugaauuuaacaccuauaagagaagcggcaucauggagguugaccgcuccgaagccaaagaggggcucaagcggggagagacgacaaaacacgcggucucuagaggcaccgccaagcugcgcugguucguggaacggaaucuugugaaacccgaggggaaggucauugaucugggauguggcagagggggauggagcuacuauugcgcuggccucaagaaaguuaccgaagugaagggcuacacaaaagggggaccuggccacgaggaacccaucccuauggccaccuacggguggaaccuggugaagcugcauuccggaaaagacgucuuuuucauucccccugagaagugugauacacuccuuugcgacaucggcgagucuagcccgaaucccacgauugaagaggggcgcacccugcgggugcugaaaaugguugaaccuuggcucagaggaaaccaauuuuguaucaagauccugaaucccuauaugccuuccguggucgagacacuugagcagaugcagcgcaagcacggcggcaugcuggugcggaacccccucagcagaaauucuacccaugaaauguacuggguuuccugcgggacaggaaacauugugagcgcugucaauaugaccucucgcaugcugcugaaccgguucacgauggcccacagaaaaccgaccuaugagcgcgauguggaccucggcgcggggacaagacacguggccgucgaaccugagguugcuaaccuggauaucauuggacagcggaucgaaaauauuaagcaugagcacaaauccaccuggcauuacgacgaggauaaccccuauaagacaugggccuaccacggcagcuaugaagugaaacccucuggguccgcuagcuccauggugaauggagucgugaaacuucugaccaagccuugggacguuauccccauggugacacaaaucgccaugaccgauacgacaccuuuuggccagcagcgcgucuucaaagagaagguggacaccagaaccccgaaagcuaagcggggcacagcccaaauuauggaaguuacggcgaaauggcucuggggguuucugagcagaaacaagaagccccggaucuguacccgcgaggaguucacaagaaaagugcggucuaaugccgcuauuggagccgucuuuguggacgagaaccaguggaauagcgcuaaggaggccguugaagaugagcgcuucugggaccuugugcauagagaacgggagcugcacaaacagggcaagugcgcgaccugcgucuacaacaugauggggaaacgcgaaaagaagcucggagaguuuggcaaagcgaagggguccagagcuaucugguacauguggcugggcgcccgguuccuggaguucgaagcccucggauuuaugaaugaggaucacugguucucucgcgaaaacagccuguccggcguggagggggagggacuucauaaacugggcuauauucucagagacaucucuaagaucccugggggaaauauguacgcugaugacacagccggcugggauacccggauuacagaagacgaucugcagaacgaggcucgcaucaccgacauuauggaacccgagcacgcccuucuggcgaaaagcaucuuuaagcucacguaucaaaauaaagucgugagaguucagcggccugccaagaacgggaccgugauggaugucauuucccgcagagaccagcggggcucuggacaggugggcacauacgggcugaauaccuucacaaacauggaagcucaacugaucagacagauggagagcgagggaaucuuuucccccagcgaacucgagaccccgaaccuggccgaacgcgugcuugauuggcuggagaaguauggcguugaacggcucaaaagaauggcuauuucuggggacgacuguguggucaagccuaucgaugaccgcuucgccacggcgcugacagcccuuaaugauaugggaaaagugcggaaggacauuccccagugggagccuuccaaaggcuggaacgauuggcagcaaguucccuuuugcagccaucacuuccaccagcugaucaugaaggacgggagagagauuguggucccuugucgcaaucaggaugaacucgugggccgggcuagagucucucagggagccggcuggucccugcgcgagaccgcuugccugggaaagagcuacgcccaaauguggcagcucauguauuuucaucggagagaccugcgccuugcugccaacgcgaucuguuccgccgugcccguugauuggauuccgacaucucggaccacguggagcauccacgcucaucaccaguggaugaccacagaagacaugcuguccguguggaauagagucuggaucgaggaaaacccuuggauggaggauaaaacccauauuagcucuuggggagacgugcccuaccucggcaagcgggaggaccaauggugcgggucccugaucggacuuacagccagagccaccugggcuacaaauauucagguugccaucaaccaggugcgccggcugauuggcaaugaaaacuaccucgauuauaugaccagcaugaaaagauucaagaaugagucugaccccgaaggggcgcugugguga

SEQ ID NO: 19010 - RNA, 9879 nt, Artificial Sequence
  derived and/or modified CDS sequence (opt5) from DENV-1__GQ199773__SS-prME
agcgugacaaugcugcugaugcugaugcccacagcccuugcuuuccaccugacgacaagaggcggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaccgucacagugcacaccggcgaccagcaucaaguugggaaugagagcacagaacacggaaccacggcuaccaucacaccccaggccccuucuaccgagauccagcugacagacuacggcgcccucacccuggauuguagcccccggacgggccuggacuuuaacgaaauggugcuccugacaaugaaggagaaaagcuggcuuguccauaagcagugguuccuggaucucccucugcccuggaccuccggggcuucuacaagccaagagaccuggaaucgcaaagaccuucuggugaccuuuaagacagcgcacgccaagaaacaggaagucgugguucucggaucccaggagggcgcuaugcacacggcccugaccggggccacagaaauucaaaccagcggaacaaccacgaucuucgcuggccaucugaagugcagacucaaaauggauaagcugacacuuaaagggaugucuuaugugauguguaccggcuccuucaagcuggagaaggaagucgccgagacccagcacggaacagugcucguucagauuaaauacgagggcaccgacgcgccgugcaagaucccuuuuagcacacaggaugaaaaaggggugacgcaaaacggacggcugauuaccgcuaaucccaucgucacagacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcauugggggaguuuucaccuccgucggcaagcuggugcaucagaucuuugggacggcuuacggagugcuguucagcggcgucucuuggaccaugaaaaucgggauuggcgugcuccugacauggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacggaacaguauaaauuccaagccgacucuccuaagcggcugagcgcggccauuggcaaggcuugggaggagggggugugcggcaucagauccgccacacgccuggaaaacauuauguggaagcagaucucuaacgagcucaaucauauccugcuugaaaacgacaugaaauuuaccguuguggucggagauguggcuggcauucuggcccaggggaagaaaaugauccggccgcagcccauggaguacaaguauagcuggaaguccuggggaaaagccaagauuaucggcgcugacgugcaaaauaccacauucauuaucgaugggccuaacacccccgaauguccugacgaucagagagcguggaauaucugggaggucgaggacuacggauuuggcauuuucacgacaaacaucuggcucaaacugcgcgauagcuauacccagguuugcgaccaccggcugaugucugccgcuauuaaggauuccaaagccgugcacgccgacaugggcuacuggaucgaaagcgagaagaaugaaacauggaaacuugcuagagccucuuucauugaggugaaaaccuguaucuggcccaagucccauacacucuggagcaacgggguccuggaaucugagaugaucauuccgaaaaucuauggaggcccuauuagccagcacaauuaccgccccggguacuuuacccaaacggcgggaccuuggcaucugggcaagcucgagcuggauuucgaccuuugcgaagggaccacagugguuguggaugagcacugcggaaaccggggccccucccugagaaccacaaccgucacgggcaaaaucauucacgaaugguguugccggagcuguacacucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguaucagcauuaugaucgaagaggugaugcgguccagauggucucgcaaaaugcugaugaccgggacacucgccgucuuuuuccugcuuauuaugggacagcugaccuggaacgaucucauccggcugugcauuauggugggcgccaaugcuagcgacagaaugggcauggggaccacauaccuggcccuuauggcgacguuuaagaugcgcccuauguucgcugucggacugcucuuuagacggcugaccucccgcgaggugcuccugcuuacaaucggccugucucucguggccagcgucgaacugcccaacucccuggaggaacuuggggauggacuggccaugggcauuaugauccucaaacugcucaccgacuuccagagccaucaacugugggcuacacuucugucucucaccuuuaucaagacgacauucucccugcacuaugccuggaagaccauggcuaugguucugagcauugugucucuuuuuccccugugucucuccaccacaagccagaaaaccacauggcugccugugcuccuggggucucuuggaugcaagccgcugacgauguuccugaucgccgagaauaaaauuuggggcagaaaguccuggccccucaacgaaggcaucauggcggucgggauugugagcauccugcuuuccagccugcucaaaaacgauguuccucuggccggaccccucaucgcuggcgggaugcugauugccuguuacgugaucucuggaagcuccgcugaccuuucucuggagaaggccgccgaggucagcugggaagaggaagcugagcauuccggcgcgucucacaauauucugguggaaguucaggaugacgggaccaugaaaaucaaggaugaggagcgggacgauacacucaccauucugcuuaaggccacacugcucgcugugagcggagucuauccucuguccauccccgccacccucuucgugugguacuuuuggcagaaaaagaaacaacgcucuggcguccugugggacacgccuuccccucccgaaguggagagagccguucuugaugacggcaucuaucggauuaugcagcgcgggcugcugggaagaucccaggugggcgucgggguguuccaggaaaacguuuuucauaccauguggcacgugacacggggagcuguccucauguaccaaggcaagcgccuggagcccagcugggccucugugaaaaaggaccuuaucuccuacgggggaggcuggagacugcagggcagcuggaauaccggggaggaagugcagguuauugcggucgagcccggaaagaacccuaaaaaugugcagacagcucccggcaccuucaagacaucugaaggggaggugggagccaucgcccucgauuuuaaaccgggcacguccgggagcccuauugucaaccgggaaggaaagaucgugggccuguauggcaaugggguugugaccacauccggaaccuacgucucugcuauugcccaagcgaaagcuagccaggagggcccccucccugagaucgaagacgagguguucagaaagcgcaaccugaccaucauggaucuucaccccggguccggaaagacacggagauaucugcccgccauuguucgcgaagccaucaaacggaagcugagaacgcucauucuggcuccuacccgcguggucgccagcgagauggcugaagcccuuaaaggcaugccgauccgguaccagacaaccgcggugaagucugagcauacagggaaagagauuguugaccugaugugccacgccaccuuuacgaugagacuccugucccccgugcgcgucccuaauuauaacaugaucaucauggaugaagcucauuucacagaccccagcucuauugccgcucggggcuacaucagcaccagagugggaaugggcgaggccgccgcuauuuuuaugaccgcgacaccucccggguccguggaagccuucccucaaucuaaugcugucauccaggaugaggaacgggacauuccggagcgcagcuggaacuccggauaugaguggaucaccgauuuucccggcaagacaguuugguucgugccuucuaucaagagcgggaaugacauugccaacugucugcgcaagaauggaaagcgggugauccagcucucccgcaaaaccuucgauacggaauaccagaagaccaagaauaacgacugggacuacgucgugaccacagauauuagcgagaugggcgccaauuuuagagcugaccggguuaucgaucccagacgcugccuuaagccugugauucugaaggacgggcccgaacgggucauccuggccggcccgaugccugugaccguugcgucugcugcccaaagacgcggacggauuggcagaaaccacaauaaagagggggaucaguauaucuacaugggacagccccucaacaaugacgaggaucaugcccacuggacggaagcuaagaugcugcuugacaacaucaauacccccgagggcauuaucccugcccuguucgaacccgagcgcgaaaaauccgcggccauugauggggaguaucggcucagaggagaggcucgcaagacauuuguggaacugaugagacggggcgaccugccugucuggcucagcuacaaaguggccuccgagggguuccaguauucugaucgcagauggugcuuugacggcgaacggaacaaucaaguccuugaggaaaacauggauguggagaucuggaccaaggagggagaacgcaaaaagcugagaccgcgguggcuggacgcuagaacauacagcgacccccucgcccugcgcgaguucaaggaauuugcugccggccggagauccguuucuggggaucuuauucuggagaucggaaaacucccucagcaccugacccagcgcgcgcagaaugcccuggacaaccucgugaugcuucauaauagcgaacaaggcgggcgggcuuauagacacgccauggaggagcugcccgauacaaucgaaacccugaugcuccuggcucuuauugccgugcugacgggaggcgucacacucuucuuucuguccggccgggggcugggaaagaccagcaucggccuccuuuguguuauggccucuuccgugcugcuguggauggcuagcguggagccucauuggauugcggccucuaucauucucgaguucuuucugaugguccuucugauccccgagccggaccgccagagaaccccucaggauaaccagcucgcuuacgugguuaucgggcugcuguucaugauucucacaguggccgccaaugagaugggacuucuggaaaccaccaagaaggaccugggcaucgggcacgucgcuguggagaaccaccaucacgccgcgaugcucgaugucgaccugcaucccgccuccgcuuggacgcuuuacgccguggcuaccacaauuaucaccccuaugaugcggcacacaauugaaaacaccacggccaauaucagccugaccgcgauugccaaccaagcugccauccucaugggacuggauaaaggcuggcccaucucuaagauggacauuggcguuccucugcucgcucuugggugcuauagccaggugaauccccugacacugaccgccgcuguccucaugcugguggcccauuacgcgaucauuggaccgggccuucaggccaaggcuacacgcgaggcccagaaaagaaccgcugccgggaucaugaagaacccuacgguugauggaauuguggccaucgaccuggaucccgucguguaugacgcgaaauuugaaaagcagcucggccagaucaugcugcugauucucuguacaucccagauccuucugaugcggaccacaugggcucugugcgagucuauuacccucgccaccgggccccugacaacgcuuugggagggaagcccuggcaaauucuggaauaccacaaucgcuguguccauggccaacauuuuccgcggcagcuaccuggccggggcuggacucgccuuuucccugaugaagucucugggcgggggaagacggggcaccggggcgcaaggagaaacacucggcgagaaguggaaacgccagcuuaaucagcugagcaaguccgaguucaacaccuauaaaagaucuggcaucauggagguugaccggagcgaagccaaggaggggcugaaaagaggagagacgacaaagcacgcugucucccgcggcaccgccaagcuccggugguuuguggaaagaaaucuggugaaaccggaggggaaggucaucgaucuuggauguggccgcgggggauggucuuacuauugcgcuggccugaaaaagguuaccgaagugaaaggcuacacaaaagggggacccggccacgaggaaccuauucccauggccaccuacggguggaaccucgugaaacugcauagcggaaaggacgucuucuuuaucccucccgagaagugugauacacugcucugcgacauuggcgaguccagcccuaauccgacgaucgaagaggggcggacccuuagagugcugaaaaugguugaacccuggcugcgcggaaaccaguucuguauuaagauccucaauccuuauaugcccucuguggucgagacacuggagcaaaugcagcggaaacacggcggcaugcuugugagaaacccucugucccgcaauagcacccaugaaauguacuggguuucuugcgggacaggaaacauuguguccgcggucaauaugaccagccggaugcuccugaacagauuuacgauggcccaccgcaagcccaccuaugagcgggauguggaccugggcgcugggacaagacacguggccgucgaaccggagguugcuaaccucgauaucaucggacagcgcauugaaaauaucaaacaugagcacaagucuaccuggcauuacgacgaggauaacccuuauaagacaugggccuaccacggcuccuaugaagugaaacccagcggguccgcuagcucuauggugaauggagucgugaagcugcuuaccaaacccugggacguuauuccuauggugacacagaucgccaugaccgauacgacacccuucggccaacagagagucuuuaaggagaaaguggacacccggaccccuaaggcgaagcgcggcacagcccagauuauggaaguuacggcuaaauggcuguggggguuccucagcagaaacaagaaaccgcggaucuguaccagagaggaauuuacacggaaggugcgcuccaaugccgcuaucggagccgucuucguggacgagaaccaauggaacucugccaaagaggcgguugaagaugagagauuuuggaaccuggugcaucgggaacgcgagcuucacaagcagggcaagugcgcuaccugcgucuacaauaugauggggaaaagagaaaagaaacugggagaguucggcaaggccaaagggagccgggccauuugguacauguggcucggcgcucgcuuccuggaguuugaagcccugggauucaugaacgaggaccacugguuuuccagagaaaauucucucagcggcguggagggggagggacugcauaaacuuggcuauauccugcgggauauuuccaaaauccccgggggaaacauguacgcugacgauacagccggcugggacacccgcauuacagaagaugaccuccagaaugaggcgaagaucaccgauaucauggaaccugagcacgcccugcuugcuaagucuauuuucaaacugacguaucagaacaaggucgugagaguucaacggcccgccaaaaaugggaccgugauggacgucaucagccgcagagaucagcggggcuccggacaggugggcacauacgggcucaacaccuuuacaaacauggaagcucagcugauucgccaaauggagagcgagggaaucuucucuccuuccgaacuggagacccccaaucucgccggcagagugcuggacuggcuugaaaagcaugggguugagcggcugaaaagaauggcgauuagcggagaugacuguguggucaagccgaucgacgaucgcuuugccacggcucucacagcccugaacgacaugggcaaggugcggaaagauaucccucagugggaacccucuaagggguggaaugacuggcagcagguuccuuucugcucccaccacuuucaucaacuuauuaugaaagauggcagagagaucgugguccccugucgcaaccaggacgagcuggugggacgggcuagagucagccagggcgccggguggucccuccgcgaaaccgcuugccugggaaagucuuaugcccagauguggcaacugauguacuuccaccggagagaucuccgccuggcggccaaugcuauuuguagcgccgugccuguugacugggugcccacaucccggaccacguggagcauccaugcccaccaucaguggaugaccacagaggauaugcuuucugucuggaacagaguguggauugaagagaauccguggauggaagacaaaacccacaucuccagcuggggcgauguuccuuaucuggggaagcgcgaggaccaguggugcggaucucucauuggccugacagcucgggccaccugggcgacaaacauccaaguggcuaucaaucaggucagacggcuuauugggaacgagaauuaccuggacuacaugaccagcaugaagagauuuaaaaacgaauccgaucccgagggcgcccucugguga

SEQ ID NO: 19011 - RNA, 9879 nt, Artificial Sequence
  derived and/or modified CDS sequence (opt5) from DENV-1__JF937596__SS-prME
agcgugaccaugcugcucaugcugaugcccaccgcccuugcuuuccaccugacgacccggggcggggaaccucauaugaucgucaccaagcaggaacggggaaaaucccuccuguuuaagaccucugccggcguuaacaugugcacccuuauugcgauggaccugggggaacucugugaagauaccaugacauacaaaugcccccgcaucaccgaagcugaacccgacgauguggacuguuggugcaaugccacggauaccugggugacauauggaaccuguagccaaacaggcgagcaccggcgggacaagcgcuccguugcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcccaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuauccagaacggacggcugauuacagcuaaucccaucgugacggacaaagagaagccugucaacauugaagccgagccgcccuuuggcgagagcuauaucgugauuggggugggagaaaaagcccuuaagcucucuugguucaagaaaggcagcuccaucgggaagauguuugaggcuaccgccagaggcgcucgccggauggccauccugggagauacagcgugggacuucggcucuauugggggaguuuuuaccagcgucggcaaacuggugcaucagaucuucgggacagccuacggagugcucuuuuccggcgucagcuggaccaugaagauugggaucggcgugcugcuuacguggcugggacucaauucuagauccaccagccugucuaugacauguauugcuguuggccuggugacccuuuaccucggggucauggugcaggccgauuccggaugcguuaucaacuggaaaggccgcgaacugaagugugggagcggaauuuucgugacaaaugagguccacaccuggacagaacaauauaaguuucaggcugacuccccuaaacggcugucugccgcgaucggcaaggccugggaggagggggugugcggcaucagaagcgcuacccgccucgaaaacauuauguggaaacagaucuccaacgagcugaaucauauucuucuggaaaacgacaugaaguucacgguuguggucggagauguggugggcauccucgcccaggggaaaaagaugauucggccgcaacccauggagcacaaauacucuuggaaaagcuggggaaaggcuaagaucaucggcgccgacguccagaauacaaccuuuauuaucgaugggccuaacacccccgaauguccugacgaucagagagccuggaauauuugggagguugaggacuauggauucggcaucuuuacaaccaacauuuggcugaagcugcgcgauuccuacacgcaggcuugcgaccaccggcuuaugagcgcggccaucaaagauucuaaggcugugcaugccgacaugggcuauuggaucgaauccgagaaaaaugaaacauggaagcucgccagagcuagcuucauugaggugaagaccuguaucuggcccaaaucucacacacugugguccaacgggguccuggaaagcgagauggugauuccgaagaucuacggaggcccuauuucucaacauaauuaucgccccggguacuucacccagacagccggaccuuggcaccucggcaaacuggagcuugauuuugaccugugcgaagggaccacgguuguggucgaugagcacugcggaaaccggggccccagccucagaaccacaaccgugacaggcaagaucauccaugaaugguguugccgguccuguacccugccuccccugcgcuucaaaggggaggacggaugcugguacggcauggagauuagaccgguuaaggaaaaggaggaaaaucuugugaaaagcauggucucugcgggguccggagagguggacagcuuuucccucggccugcuguguaucucuauuaugaucgaagagguuaugcggagcagauggucccgcaagaugcucaugacggggacacuggcuguguuccuucugcucauuaugggacagcugaccuggaacgaucugauccggcuuugcauuauggucggcgccaaugccucugacagaaugggcauggggacaaccuaucuggcucucauggccaccuuuaaaaugcgcccuauguucgcggugggacugcucuuuagacggcugacaagccgcgaggugcuucugcucacgaucggccugucccuggucgcuucuguugaacuucccaacagccuggaggaacucggggauggacuggccaugggcaucaugauucucaagcugcuuaccgacuuccaaucccaccagcugugggccacacuccugagccugaccuuuaucaaaacaacccuuucucugcauuacgcuuggaagacgauggccauggugcucuccauugugagccuguucccccucugucugucuacaaccucccagaagaccacauggcuuccuguccugcuggggagccucggaugcaaaccgcugaccauguuucuuaucgcugagaauaagauuuggggcagaaaaucuuggccccugaacgaaggcaucauggccguggggguuguguccauccuccugagcucccuccugaagaacgaugucccucuugcgggaccccugauugccggcgggaugcugaucgcuuguuaugugauuagcggaucuagcgccgaccucucccuggagaaagcugccgagguuucuugggaagaggaagccgagcacagcggcgcuucccauaauauccuuguggaaguccaggaugacgggacaaugaagauuaaagaugaggagcgggacgauacgcugaccauccuccugaaggcgacacuccuggccgugucuggagucuacccucuuagcauccccgcuacccuguucgugugguauuuuuggcaaaagaaaaagcagcgcuccggcguucugugggacacaccuucucccccggaaguggagagagccguccucgaugacggcauuuaccggaucaugcagcgcgggcugcuuggaagaagccaggugggcguugggguguuccaagaaaacgucuuccacaccauguggcacgugacgcggggagccgugcugauguaucagggcaaacgccucgagccuuccugggcuagcguuaagaaagaccugauuucuuacgggggaggcuggagacuccagggcuccuggaauaccggggaggaaguccaggugaucgccguggagcccggaaagaacccuaagaauguccaaacagcgcccggcaccuuuaaaacaccggaaggggaggugggagcuauugcccuggauuucaagccuggcaccagcgggucucccaucguuaaccgggaaggaaaaauugugggccuuuacggcaauggggucgugacaacguccggaaccuauguuagcgccaucgcucagacaaaggccucccaggagggcccucugcccgagaucgaagacgagguguuuagaaaacgcaaccugaccauuauggaucuccaucccgggucuggaaagacccggagauaccugccugcgaucguccgcgaagcuauuaagcggaaacuuagaacacugauccucgccccgacgcgcgugguugccagcgagauggcugaagcccugaagggcaugcccauucgguaucaaaccacagcugugaaauccgagcacaccgggaaggagaucgucgaccugaugugccaugccacauucaccaugagacuccuuagcccugugcgcgugcccaauuacaacaugaucauuauggaugaagcgcacuuuacggacccuucuuccaucgccgcucggggcuauauuagcacaagagucggaaugggcgaggccgcugccaucuucaugaccgccacacccccugggucuguugaggcuuuuccgcagagcaaugcggugauucaggaugaggaacgggacauccccgagcgcuccuggaacucuggacaugaguggaucacagauuucccuggcaaaaccgugugguuuguccccagcauuaaguccgggaaugacaucgccaacugucugagaaagaauggaaaacgggugauucagcugucucgcaagacauucgauaccgaauaccagaagacgaagaacaacgacugggacuauguugugacaaccgauaucagcgagaugggcgcuaauuuuagagccgaccgggucauugauccuagacgcugccucaaacccgugauccugaaggacgggccggaacggguuauucuugccggcccuaugcccgugacagucgcuuccgccgcgcagagacgcggacggaucggcagaaaccacaauaaggagggggaucaguacaucuacaugggacagccccugaacaaugacgaggaucacgcucauuggaccgaagccaaaaugcuccuggacaacauuaauacgccugagggcaucauucccgcccuguucgaaccugagcgcgaaaagagcgcugccaucgauggggaguaucggcucagaggagaggcgcgcaaaaccuucguggaacuuaugagacggggcgaccugccggucuggcugucuuacaagguggccuccgagggguuucaauauagcgaucgcagauggugcuucgacggcgaacggaacaaucagguucucgaggaaaacauggauguggagauuuggacaaaagagggagaacgcaagaaacugagaccccgguggcuugacgcuagaaccuacuccgacccucuggcccuccgcgaguuuaaggaguucgcugccggccggagaucugugagcggggaucugauccuggagaucggaaagcucccccagcaccuuacacagcgcgcucaaaaugcccuggacaaccuggucaugcuccauaauuccgaacagggcgggcgggcguauagacacgccauggaggagcugccugauaccauugaaacacuuaugcugcucgcucugaucgccguucugaccggaggcgugacgcucuuuuuccuuucuggccgggggcugggaaaaacaagcauuggccugcucugugugauggcuuccagcguccugcuuuggauggccucuguggagccccacuggaucgccgcuuccauuauccuggaauuuuuccucaugguucugcugaucccggagccugaccgccagagaacaccccaggauaaccaacucgcguacguggucauugggcuucuguuuaugauccugaccguggccgcuaaugagaugggacuccuggaaacaaccaagaaagaccuuggcauugggcaugucgccguggagaaccaccaucacgccacaaugcuggauguugaccuccauccugcuagcgccuggacgcuguaugcgguggccaccacaaucauuacccccaugaugcggcacacaaucgaaaacaccacggcuaauauuucucugaccgccaucgcuaaccaggccgcgauccucaugggacuugauaagggcuggccuauuuccaaaauggacaucggcgucccccugcuggcccucgggugcuacagccaggugaauccgcugacacuuaccgcugccguucugaugcucguggcucacuacgccauuaucggaccuggccugcaagcuaaggccacacgcgaggcgcagaagagaaccgccgcugggauuaugaaaaaccccacggucgauggaaucguggccaucgaccuggaucccgugguuuaugacgcuaaguucgaaaaacagcucggccagauuaugcuucugauccuguguacaucucaaauucuccugaugcggaccacaugggcccuuugcgagagcaucacccuggccaccgggccucucacaacgcugugggagggauccccgggcaaguuuuggaauaccacaauugcggucucuauggcuaacaucuuccgcggcagcuaccuggccggggcuggacucgccuuuucccuuaugaaaagccugggcgggggaagacggggcaccggggcccagggagaaacacugggcgagaaguggaagcgccagcucaaucagcuguccaaaucugaguucaacaucuauaagagaagcggcauuauggagguggaccgguccgaagcuaaagaggggcuuaagagaggagagaccacgcgccaugccgugucucggggcacagcgaaacugagaugguucgucgaacgcaaucucguuaagcccgaggggaaggugaucgaucugggauguggcagagggggauggagcuacuauugcgccggccugaaaaaggugaccgaagucaaaggcuacaccaaagggggaccuggccacgaggaacccauuccuauggcuacauauggguggaaccucgugaaacuucauuccggaaaggacgucuuuuucgcgcccccugagaaaugugauacccugcugugcgacaucggcgagucuagcccgaaucccacaauugaagaggggagaacgcuccgcgugcugaagauggucgaaccuuggcuucggggaaaccaauuuuguaucaagauucugaaucccuacaugccuuccgugguugagacccucgagcagaugcagagaaaacacggcggcaugcuggugcgcaacccccugagcagaaauucuacacacgaaauguacugggucuccugcgggaccggaaacaucgugagcgcugugaauaugacaucuagaaugcuccugaaccgcuucaccauggcccaucggaagccgacguaugagagagaugucgaccuuggcgcggggacccgccacguugccguggaaccugagguggcuaaccuggauaucauuggacagagaaucgaaaauauuaaacaugagcacaaguccacauggcauuacgacgaggauaaccccuauaaaaccugggccuaccacggcagcuaugaagucaagcccucuggguccgcuagcuccauggugaauggaguugugaagcuccugacaaaaccuugggacgucauccccauggugacccaaauugccaugacagauaccacgccuuuuggccagcagcggguuuucaaggagaaaguggacacacgcaccccgaaggcuaaaagaggcaccgcccaaaucauggaagucacagcgcgguggcuuuggggguuucugagcagaaacaagaagccccggaucuguacgcgcgaggaguucaccagaaaagugcggucuaaugccgcuauuggagccguuuuuguggacgagaaccaguggaauagcgcuaaggaggccgucgaagaugagcgcuucugggaccucgugcagaaagaaagagagcugcacaagcagggcaaaugcgccacaugcgucuacaacaugauggggaagcgggaaaagaaacugggagaguuuggcaaggcgaaagggucccgcgcuaucugguauauguggcucggcgccagauuccuggaguuugaagcccuuggauucaugaaugaggaucauugguucucucgggaaaacagccuguccggcguggagggggagggacuccacaagcugggcuacauucuucgcgacaucucuaaaauuccugggggaaauauguacgcugaugacaccgccggcugggauacaagaaucaccgaagacgaucugcaaaacgaggcuaagaucacagacauuauggaacccgagcaugcccuccuggcgaccagcaucuuuaaacugacguaucagaauaagguugugcggguccagcgcccugccaagaacgggaccgugauggaugugauuuccagacgggaccagcgcggcucuggacaaguuggcacauacgggcucaauaccuucacaaacauggaagcucagcugaucagacagauggagagcgagggaauuuuucuucccuccgaacuggagaccccgaaccucgccgaacgggugcuggauuggcuugagaaacacggcgucgaaagacugaagcgcauggcuaucagcggggacgacugugugguuaaaccuaucgaugaccgguucgccacggcgcucacagcccugaaugauaugggaaaggugagaaaagacauuccccagugggagccuucuaagggcuggaacgauuggcaacagguccccuuuugcucccaccauuuccaccagcugaucaugaaggacgggcgcgagauuguggucccuugucggaaucaggaugaacucgugggcagagcucgcguuagccaaggagccggcuggucucugcgggagaccgcuugccuugggaaauccuaugcccagauguggcagcugauguacuuucauagacgcgaccuccggcuggcugccaacgcgaucuguagcgccgugcccgucgauugggugccgacauccagaaccacguggucuauucacgcucaucaccaauggaugaccacagaagacaugcuuagcguuuggaaucgcguguggaucgaggaaaacccuuggauggaggauaagacccacgucuccagcuggggagacgugcccuaucugggcaaacgggaggaccaguggugcgggucucucauuggacugacagccagagccaccugggcuuccaauauccagguggccaucaaccagguucggagacugauuggcaaugaaaacuaccucgauuauaugacaagcaugaagcgcuucaaaaaugagggggaccccgaaggcgcgcugugguga

SEQ ID NO: 19012 - RNA, 9879 nt, Artificial Sequence
  derived and/or modified CDS sequence (opt5) from DENV-1__FJ898380__SS-prME
agcgugaccaugcugcucaugcugaugcccaccgcccuugcuuuccaccugacgaccagaggcggggaaccucauaugaucgucuccaagcaggaacgggggaaaucucuccuguuuaagaccagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccaggccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucaaaggggaggacggaugcugguauggcauggagauuagaccggugaaggaaaaggaggaaaaucuuguuaaaagcauggugucugcuggguccggagaggucgacagcuuuucccucggccugcuguguaucucuauuaugaucgaagaggugaugcggagcagauggucccgccggaugcucaugacagggacccuggccguuuucuuucuucugauuaugggacagcucacauggaacgaucugaucagacugugcauuauggugggcgccaaugcuucugaccgcaugggcauggggaccaccuaccuugcccugauggcgacauucaagaugagaccuauguuugcugucggacuccuguuccggcgccucacgagcagagaggugcugcuucugaccaucggccucucccugguggccucugucgaacugcccaacagccuugaggaacugggggauggacucgccaugggcaucaugauucugaaacuccugacagacuuucaaucccaucagcuuugggcuacccugcucagccugacauucaucaagaccacguuuucucugcacuaugccuggaaaacaauggcuaugguucuuuccauugugagccuguucccccucugucugucuaccaccucccagaagacaaccuggcucccugugcugcuugggagccugggaugcaagccgcugacaauguuucucaucgccgagaauaaaauuuggggccggcgcucuuggccccugaacgaaggcaucauggcggucgggaucguguccauucuucugagcucccuccugaagaacgauguuccucucgccggaccccugaucgcuggcgggaugcuuauugccuguuacgugaucagcggaucuagcgcugaccugucccuggagaaagccgccgaggucucuugggaagaggaagcugagcauagcggcgcgucccacaauauucucguggaaguucaggaugacgggacgaugaagaucaaagaugaggagagagacgauacccugacaauccuucugaaggccacccuccuggcugugucuggagucuauccucucagcauucccgccacacuguucgugugguacuucuggcagaagaagaagcagcgguccggcguccuuugggacaccccuucucccccggaaguggagcgcgccguucuggaugacggcaucuauagaauuaugcagcgggggcugcucggacgcagccaggugggcgucgggguguuucaagaaaacguuuuccauacgauguggcacgugaccagaggagcuguccugauguaccagggcaaacggcuugagccuuccugggccagcgugaagaaagaccugaucucuuacgggggaggcuggagacuccagggcuccuggaauacaggggaggaagugcagguuauugcggucgagcccggaaagaacccuaaaaaugugcaaaccgcucccggcacauuuaagaccccggaaggggaggugggagccaucgcccuggauuucaagccuggcacaagcgggucucccauugucaaccgcgaaggaaaaaucgugggccucuauggcaaugggguugugacgaccuccggaacauacgucagcgcuaucgcccaggcgaaggcuucccaggagggcccucugcccgagauugaagacgagguguuucggaaaagaaaccuuaccaucauggaucugcaccccgggucuggaaagacccgccgguaucugccugccauuguuagagaagccaucaaacgcaagcuccggacacugauucuugcuccgacgagaguggucgccagcgagauggcugaagcccugaagggcaugcccauccgcuaccaaaccacagcggugaaauccgagcauaccgggaaggagaucguugaccucaugugccacgccacauucaccaugcggcugcugagcccugugagaguccccaauuauaacaugauuaucauggaugaagcucauuuuacggacccuucuuccauugccgcucggggcuacaucagcacacgcgugggaaugggcgaggccgccgcuauuuucaugaccgcgacacccccugggucuguggaagccuuuccgcagagcaaugcugucauccaggaugaggaaagagacauccccgagcgguccuggaacucuggauaugaguggauuacagauuucccuggcaaaaccguuugguuugugcccagcaucaaguccgggaaugacauugccaacugucuccgcaaaaauggaaagagagugauccagcuuucucggaagacauucgauaccgaauaccagaaaacgaagaacaacgacugggacuacgucgugacaaccgauauuagcgagaugggcgccaauuucagagcugaccgcguuaucgauccucggagaugccugaaacccgugauucugaaggacgggccggaacgcgucauccucgccggcccuaugcccgugacaguugcguccgcugcccagcggagaggacgcaucggccggaaccacaauaaagagggggaucaguauauuuacaugggacagccccugaacaaugacgaggaucaugcccacuggaccgaagcuaagaugcuucuggacaacaucaauacgccugagggcauuauccccgcccucuuugaaccugagagagaaaagagcgcggccauugauggggaguaucgccugagaggagaggcucggaaaaccuucguggaacugaugcgcagaggcgaccucccggucuggcuuucuuacaagguggccuccgagggguuucaauauagcgaucggcgcuggugcuucgacggcgaaagaaacaaucagguccuggaggaaaacauggauguggagaucuggacaaaagagggagaacggaagaaacugagaccccgcuggcucgacgcucggaccuacuccgacccucuggcccuuagagaguuuaaggaguucgcugccggccgccggucuguuagcggggaucugauccucgagauuggaaaacugccccagcaccugacacagagagcgcaaaaugcccucgacaaccuugugaugcugcauaauuccgaacagggcgggcgggcuuaucgccacgccauggaggagcugccugauaccaucgaaacacucaugcugcuugcucugauugccgugcucaccggaggcgucacgcuguuuuuccugucuggcagagggcucggaaagacaagcaucggccuucuguguguuauggccuccagcgugcugcucuggauggcuucuguggagccccauuggauugcggccuccaucauccuggaauuuuuccuuaugguccugcucauuccggagccugaccggcagcgcacaccccaggauaaccaacuggcuuacgugguuaucgggcugcucuuuaugauucuuaccguggccgccaaugagaugggacugcuggaaacaaccaagaaagaccucggcaucgggcacgucgcuguggagaaccaccaucacgccgcgaugcuggaugucgaccuucauccugccagcgcuuggacacuguacgccguggcuacgaccauuaucacacccaugaugagacacaccauugaaaacacaaccgccaauaucucucucacggcgaucgccaaccaggcugccauucugaugggacuggauaagggcuggccuaucuccaaaauggacauuggcguuccccuccuugcucuggggugcuauagccaggugaauccgcugacccucacagccgcuguccugaugcuuguggcccauuacgcgaucauuggaccuggccugcaagccaaggcuacccgggaggcccagaaacgcacagcugccgggaucaugaagaaccccaccguugauggaaucguggccauugaccucgaucccgucguguaugacgcgaaguucgaaaaacagcugggccagaucaugcugcucauucuuuguacgucucaaauccugcugaugagaacaaccugggcucucugcgagagcauuacacuggccaccgggccucuuaccacacugugggagggauccccgggcaaguuuuggaauacgaccaucgcugugucuauggccaacaucuuccggggcagcuaccucgccggggcuggacuggccuucucccugaugaaaagccucggcgggggacgcagaggcacaggggcgcagggagaaacccuuggcgagaaguggaaacggcagcugaaucagcuguccaagucugaauuuaacacauauaagagaagcggcauuauggagguugaccgcuccgaagccaaagaggggcucaagcggggagagaccacgaaacacgcugucucuagaggcacagccaagcugcgcugguucguggaacggaaucuugugaaacccgaggggaaggucaucgaucugggauguggcagagggggauggagcuacuauugcgcuggccucaagaaaguuaccgaagugaagggcuacaccaaagggggaccuggccacgaggaacccauuccuauggccacauacggguggaaccuggugaagcugcauuccggaaaagacgucuuuuucauucccccugagaagugugauacccuccuuugcgacauuggcgagucuagcccgaaucccacaaucgaagaggggcgcacgcugcgggugcugaaaaugguugaaccuuggcucagaggaaaccaauuuuguauuaagauccugaaucccuauaugccuuccguggucgagacccuugagcagaugcagcgcaagcacggcggcaugcuggugcggaacccccucagcagaaauucuacacaugaaauguacuggguuuccugcgggaccggaaacaucgugagcgcggucaauaugacaucucgcaugcugcugaaccgguucaccauggcccacagaaaaccgacguaugagcgcgauguggaccucggcgcugggaccagacacguggccgucgaaccugagguugcuaaccuggauauuaucggacagcggauugaaaauaucaagcaugagcacaaauccacauggcauuacgacgaggauaaccccuauaagaccugggccuaccacggcagcuaugaagugaaacccucuggguccgcuagcuccauggugaauggagucgugaaacuucugacaaagccuugggacguuauucccauggugacccaaaucgccaugacagauaccacgccuuuuggccagcagcgcgucuucaaagagaagguggacacaagaaccccgaaagcgaagcggggcaccgcccaaaucauggaaguuacagcuaaauggcucuggggguuucugagcagaaacaagaagccccggauuuguacgcgcgaggaguucaccagaaaagugcggucuaaugccgcuaucggagccgucuuuguggacgagaaccaguggaauagcgccaaggaggcgguugaagaugagcgcuucugggaccuugugcauagagaacgggagcugcacaaacagggcaagugcgcuacaugcgucuacaacaugauggggaaacgcgaaaagaagcucggagaguuuggcaaagccaagggguccagagccauuugguacauguggcugggcgcucgguuccuggaguucgaagcccucggauuuaugaaugaggaucacugguucucucgcgaaaacagccuguccggcguggagggggagggacuucauaaacugggcuauauccucagagacauuucuaagaucccugggggaaauauguacgcugaugacaccgccggcugggauacacggaucaccgaagacgaucugcagaacgaggcgcgcauuacagacaucauggaacccgagcacgcccuucuggcuaaaagcauuuuuaagcucaccuaucaaaauaaagucgugagaguucagcggccugccaagaacgggacggugauggaugucaucucccgcagagaccagcggggcucuggacaggugggcaccuacgggcugaauacauucaccaacauggaagcucaacugauuagacagauggagagcgagggaaucuuuucccccagcgaacucgagacaccgaaccuggccgaacgcgugcuugauuggcuggagaaguauggcguugaacggcucaaaagaauggcgaucucuggggacgacuguguggucaagccuauugaugaccgcuucgccaccgcucugacggcccuuaaugauaugggaaaagugcggaaggacaucccccagugggagccuuccaaaggcuggaacgauuggcagcaaguucccuuuugcagccaucacuuccaccagcugauuaugaaggacgggagagagaucguggucccuugucgcaaucaggaugaacucgugggccgggcuagagucucucagggagccggcuggucccugcgcgagacagcuugccugggaaagagcuacgcccaaauguggcagcucauguauuuucaucggagagaccugcgccuugcggccaacgcuauuuguuccgccgugcccguugauuggaucccgaccucucggacaaccuggagcauucacgcccaucaccaguggaugacgaccgaagacaugcuguccguguggaauagagucuggaucgaggaaaacccuuggauggaggauaaaacacauaucagcucuuggggagacgugcccuaccucggcaagcgggaggaccaauggugcgggucccugauuggacuuaccgcuagagccacaugggcgaccaauauccagguugcuauuaaccaggugcgccggcugaucggcaaugaaaacuaccucgauuauaugacaagcaugaaaagauucaagaaugagucugaccccgaaggggcccugugguga

SEQ ID NO: 19013 - RNA, 9879 nt, Artificial Sequence
  derived and/or modified CDS sequence (opt5) from DENV-1__FJ898382__SS-prME
agcgugaccaugcugcucaugcugaugcccaccgcccuugcuuuccaccugacgaccagaggaggggaaccucauaugaucgucuccaagcaggaacgggggaaaucucuccuguuuaagaccagcgccggcguuaacaugugcacccuuaucgcgauggaccugggggaacucugugaagauaccaugaccuacaaaugccccagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaaaauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccaggccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucagaggggaggacggaugcugguauggcauggagauucggccggugaaagaaaaggaggaaaaucuuguuaagagcauggugucugcuggguccggagaggucgacagcuuuucccucggccugcuguguaucucuauuaugaucgaagaggugaugagaagccgcuggucccggagaaugcucaugacagggacccuggccguuuucuuucuucugauuaugggacagcucacauggaacgaucugauccgccugugcauuauggugggcgccaaugcuucugacagaaugggcauggggaccaccuaccuugcccugauggcgacauucaaaaugcggccuauguuugcugucggacuccuguuccgcagacucacgagccgggaggugcugcuucugaccaucggccucucccugguggccucugucgaacugcccaacagccuugaggaacugggggauggacucgccaugggcaucaugauucugaagcuccugacagacuuucaaucccaucagcuuugggcuacccugcucagccugacauucaucaaaaccacguuuucucugcacuaugccuggaagacaauggcuaugguucuuuccauugugagccuguucccccucugucugucuaccaccucccagaaaacaaccuggcucccugugcugcuugggagccugggaugcaagccgcugacaauguuucucaucgccgagaauaagauuuggggccgcagaucuuggccccugaacgaaggcaucauggcggucgggaucguguccauucuucugagcucccuccugaaaaacgauguuccucucgccggaccccugaucgcuggcgggaugcuuauugccuguuacgugaucagcggaucuagcgcugaccugucccuggagaaggccgccgaggucucuugggaagaggaagcugagcauagcggcgcgucccacaauauucucguggaaguucaggaugacgggacgaugaaaaucaaggaugaggagcgggacgauacccugacaauccuucugaaagccacccuccuggcugugucuggagucuauccucucagcauucccgccacacuguucgugugguacuucuggcaaaagaaaaagcagcgcuccggcguccuuugggacaccccuucucccccggaaguggagagagccguucuggaugacggcaucuaucggauuaugcagcgcgggcugcucggaagaagccaggugggcgucgggguguuucaagaaaacguuuuccauacgauguggcacgugacccggggagcuguccugauguaccagggcaagagacuugagccuuccugggccagcgugaaaaaggaccugaucucuuacgggggaggcuggcgccuccagggcuccuggaauacaggggaggaagugcagguuauugcggucgagcccggcaagaacccuaagaaugugcaaaccgcucccggcacauuuaaaaccccggaaggggaggugggagccaucgcccuggauuucaagccuggcacaagcgggucucccauugucaaccgggaaggaaagaucgugggccucuauggcaaugggguugugacgaccuccggaacauacgucagcgcuaucgcccaggcgaaggcuucccaggagggcccucugcccgagauugaagacgagguguuuagaaagcgcaaccuuaccaucauggaucugcaccccgggucuggaaaaacccggagauaucugccugccauuguucgcgaagccaucaagcggaaacucagaacacugauucuugcuccgacgcgcguggucgccagcgagauggcugaagcccugaagggcaugcccauccgguaccaaaccacagcggugaaguccgagcauaccgggaaagagaucguugaccucaugugccacgccacauucaccaugagacugcugagcccugugcggguccccaauuauaacaugauuaucauggaugaagcucauuuuacggacccuuucucuauugccgcucgcggcuacaucuccacaagagugggaaugggcgaggccgccgcuauuuuuaugaccgcgacacccccugggagcguggaagccuucccgcagucuaaugcugucauccaggaugaggaacgggacauccccgagcgcagcuggaacuccggauaugaguggauuacagauuuuccuggcaagaccguuugguucgugcccucuaucaaaagcgggaaugacauugccaacugucucagaaagaauggaaaacgggugauccagcuuuccagaaagacauucgauaccgaauaccaaaagacgaaaaacaacgacugggacuacgucgugacaaccgauauuucugagaugggcgccaauuuucgcgcugaccggguuaucgauccuagacgcugccugaagcccgugauucugaaagacgggccggaacgggucauccucgccggcccuaugcccgugacaguugcgagcgcugcccagagacgcggacggaucggcagaaaccacaauaaggagggggaucaguauauuuacaugggacagccccugaacaaugacgaggaucaugcccacuggaccgaagcuaaaaugcuucuggacaacaucaauacgccugagggcauuauccccgcccucuucgaaccugagcgcgaaaaguccgcggccauugauggggaguauagacugcggggagaggcucgcaagaccuuuguggaacugaugagacggggcgaccucccggucuggcuuagcuacaaaguggccucugagggguuccaauauuccgaucgcagauggugcuuugacggcgaacggaacaaucagguccuggaggaaaacauggauguggagaucuggacaaaggagggagaacgcaagaaacugcgcccccgguggcucgacgcuagaaccuacagcgacccucuggcccuucgcgaguucaaagaauuugcugccggccggagauccguuucuagcgaucugauccucgagauugggaagcugccccagcaccugacacagcgggcgcaaaaugcccucgacaaccuugugaugcugcauaauuccgaacagggaggccgcgcuuauagacacgccauggaggagcugccugauaccaucgaaacacucaugcugcuugcucugauugccgugcucaccgggggagucacgcuguucuuucugucuggccggggccucgggaaaacaagcaucggacuucuguguguuauggccuccagcgugcugcucuggauggcuucuguggagccccauuggauugcggccuccaucauccuggaguucuuucuuaugguccugcucauuccggagccugaccgccagagaacaccccaggauaaccaacuggcuuacgugguuaucggccuccuguucaugauucuuaccguggccgccaaugagauggggcugcuggaaacaaccaagaaggaccucggaaucggccacgucgcuguggagaaccaccaucacgccgcgaugcuggaugucgaccuucauccugccagcgcuuggacacuguacgccguggcuacgaccauuaucacacccaugaugcggcacaccauugaaaacacaaccgccaauaucucucucacggcgaucgccaaccaggcugccauucugauggggcuggauaaaggauggccuaucuccaagauggacauuggcguuccccuccuugcucugggcugcuauagccaggugaauccgcugacccucacagccgcuguccugaugcuuguggcccauuacgcgaucauugggccuggacugcaagccaaagcuacccgcgaggcccagaagagaacagcugccggcaucaugaaaaaccccaccguugaugggaucguggccauugaccucgaucccgucguguaugacgcgaaguuugaaaagcagcugggacagaucaugcugcucauucuuuguacgucucaaauccugcugaugcggacaaccugggcucucugcgagagcauuacacuggccaccggcccucuuaccacacugugggagggguccccgggaaaauucuggaauacgaccaucgcugugucuauggccaacaucuuccgcggcagcuaccucgccggcgcugggcuggccuuuucccugaugaaaagccucggaggcgggagacggggaacaggcgcgcagggggaaacccuuggagagaaauggaagagacagcugaaucagcuguccaaaucugaguucaacacauauaagcgcagcggcauuauggagguugaccgguccgaagccaaggagggccucaaaagaggggagaccacgaagcacgcugucucucgcggaacagccaaacugcggugguuuguggaaagaaaucuugugaagcccgagggcaaagucaucgaucugggguguggacgcggcggguggagcuacuauugcgcuggacucaagaagguuaccgaagugaaaggcuacaccaagggcgggccuggacacgaggaacccauuccuauggccacauacggcuggaaccuggugaaacugcauuccgggaaggacgucuucuuuauucccccugagaaaugugauacccuccuuugcgacauuggagagucuagcccgaaucccacaaucgaagagggccggacgcugagagugcugaagaugguugaaccuuggcuccgcgggaaccaauucuguauuaaaauccugaaucccuauaugccuuccguggucgagacccuugagcagaugcagcggaagcacggaggcaugcuggugagaaacccccucagccgcaauucuacacaugaaauguacuggguuuccugcggcaccgggaacaucgugagcgcggucaauaugacaucucggaugcugcugaacagauuuaccauggcccaccgcaagccgacguaugagagagauguggaccucggagcuggcacccggcacguggccgucgaaccugagguugcuaaccuggauauuaucgggcagcgcauugaaaauaucaaacaugagcacaaguccacauggcauuacgacgaggauaaccccuauaaaaccugggccuaccacggaagcuaugaagugaagcccucuggcuccgcuagcuccauggugaauggggucgugaaacuucugacaaagccuugggacguuauucccauggugacccaaaucgccaugacagauaccacgccuuucggacagcagagagucuuuaaggagaaaguggacacacggaccccgaaggcgaaaagaggcaccgcccaaaucauggaaguuacagcuaaguggcucuggggcuuccugagccggaacaaaaagccccgcauuuguacgagagaggaauuuacccggaaggugcgcucuaaugccgcuaucggggccgucuucguggacgagaaccaguggaauagcgccaaagaggcgguugaagaugagagauuuugggaccuugugcaucgggaacgcgagcugcacaagcagggaaaaugcgcuacaugcgucuacaacaugaugggcaagagagagaaaaagcucggggaguucggaaaggccaaaggcucccgggccauuugguacauguggcugggggcucgcuuccuggaguuugaagcccucggcuucaugaaugaggaucacugguuuucuagagaaaacagccuguccggaguggagggcgaggggcuucauaagcugggauauauccuccgggacauuucuaaaaucccuggcgggaauauguacgcugaugacaccgccggaugggauacacgcaucaccgaagacgaucugcagaacgaggcgagaauuacagacaucauggaacccgagcacgcccuucuggcuaagagcauuuucaaacucaccuaucaaaauaaggucgugcggguucagcgcccugccaaaaacggcacggugauggaugucaucuccagacgggaccagagagggucuggccaggugggaaccuacggccugaauacauuuaccaacauggaagcucaacugauucgccagauggagagcgaggggaucuucucccccagcgaacucgagacaccgaaccuggccgaacgggugcuugauuggcuggagaaguauggaguugaaagacucaagcgcauggcgaucucuggcgacgacuguguggucaaaccuauugaugaccgguuugccaccgcucugacggcccuuaaugauauggggaaggugagaaaagacaucccccagugggagccuuccaagggauggaacgauuggcagcaaguucccuucugcagccaucacuuucaccagcugauuaugaaagacggccgcgagaucguggucccuugucggaaucaggaugaacucguggggagagcucgcgucucucagggcgccggauggucccugcgggagacagcuugccugggcaagagcuacgcccaaauguggcagcucauguauuuccauagacgcgaccugcggcuugcggccaacgcuauuuguuccgccgugcccguugauuggaucccgaccucuagaacaaccuggagcauucacgcccaucaccaguggaugacgaccgaagacaugcuguccguguggaaucgggucuggaucgaggaaaacccuuggauggaggauaagacacauaucagcucuuggggagacgugcccuaccucggaaaaagagaggaccaauggugcggcucccugauugggcuuaccgcucgcgccacaugggcgaccaauauccagguugcuauuaaccaggugcggagacugaucggaaaugaaaacuaccucgauuauaugacaagcaugaagcgcuuuaaaaaugagucugaccccgaaggcgcccugugguga

SEQ ID NO: 19014 - RNA, 9879 nt, Artificial Sequence
  derived and/or modified CDS sequence (opt5) from DENV-1__FJ898383__SS-prME
agcgugaccaugcugcucaugcugaugcccaccgcccuugcuuuccaccugacgaccagaggaggggaaccucauaugaucguguccaagcaggaacggggaaaaucucuccuguuuaagaccagcgccggcguuaacaugugcacccuuauugcgauggaccugggggaacucugugaagauaccaugaccuacaaaugccccagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccuaucaacauugaagcugagccgcccuuuggcgagagcuauaucgugauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauuccuauacccaggucugcgaccaccggcuuaugagcgcggccaucaaagauucuaaggcuguucacgccgacaugggcuacuggaucgaauccgagaaaaaugaaacauggaagcucgccagagcuagcuucauugaggugaagaccuguaucuggcccaaaucucauacacugugguccaacggggugcuggaaagcgagaugauuaucccgaagauuuauggaggcccuaucucucaacacaauuaccgccccggguacuucacccaggccgcgggaccuuggcaucucggcaaacuggagcuugauuuugaccugugcgaagggacgaccgucgugguugaugagcacugcggaaaccggggccccagccucagaacaaccacagugaccggcaagaucauucacgaaugguguugccgguccuguacgcugccuccccugcgcuucagaggggaggacggaugcugguauggcauggagauccggccggucaaagaaaaggaggaaaaucuugugaaaagcaugguuucugcuggguccggagagguggacagcuuuucccucggccugcuguguauuucuaucaugauugaagaggucaugagaagccgcuggucccggagaaugcucaugacagggacccuggccguguucuuucuucugaucaugggacagcucacauggaacgaucugauucgccugugcaucaugguuggcgccaaugcuucugacagaaugggcauggggaccaccuaccuugcccugauggcgacauucaaaaugcggccuauguuugcugugggacuccuguuccgcagacucacgagccgggagguccugcuucugaccaucggccucucccugguggccucuguggaacugcccaacagccuugaggaacugggggauggacucgccaugggcauuaugauccugaagcuccugacagacuuucaaucccaucagcuuugggcuacccugcucagccugacauucauuaaaaccacguuuucucugcacuaugccuggaagacaauggcuaugguccuuuccaucguuagccuguucccccucugucugucuaccaccucccagaaaacaaccuggcucccugugcugcuugggagccugggaugcaagccgcugacaauguuucucauugccgagaauaagaucuggggccgcagaucuuggccccugaacgaaggcaucauggcgguggggauugucuccauccuucugagcucccuccugaaaaacgaugugccucucgccggaccccugauugcuggcgggaugcuuaucgccuguuacguuauuagcggaucuagcgcugaccugucccuggagaaggccgccgaggugucuugggaagaggaagcugagcauagcggcgcgucccacaauauccucgucgaagugcaggaugacgggacgaugaaaaucaaggaugaggagcgggacgauacccugacaauucuucugaaagccacccuccuggcuguuucuggaguguauccucucagcauccccgccacacuguucgucugguacuucuggcaaaagaaaaagcagcgcuccggcgugcuuugggacaccccuucucccccggaagucgagagagccgugcuggaugacggcauuuaucggaucaugcagcgcgggcugcucggaagaagccagguuggcgugggggucuuucaagaaaacguguuccauacgauguggcacguuacccggggagcugugcugauguaccagggcaagagacuugagccuuccugggccagcgucaaaaaggaccugauuucuuacgggggaggcuggcgccuccagggcuccuggaauacaggggaggaaguccaggugaucgcgguugagcccggcaagaacccuaagaauguccaaaccgcucccggcacauuuaaaaccccggaaggggaggugggagccauugcccuggauuucaagccuggcacaagcgggucucccaucgugaaccgggaaggaaagaucgucggccucuauggcaauggggugguuacgaccuccggaacauacgugagcgcuauugcccaggcgaaggcuucccaggagggcccucugcccgagaucgaagacgaggucuuuagaaagcgcaaccuuaccauuauggaucugcaccccgggucuggaaaaacccggagauaucugccugccaucgugcgcgaagccauuaagcggaaacucagaacacugauccuugcuccgacgcgcguuguggccagcgagauggcugaagcccugaagggcaugcccauccgguaccaaaccacagcggucaaguccgagcauaccgggaaagagauuguggaccucaugugccacgccacauucaccaugagacugcugagcccuguucgggugcccaauuauaacaugaucauuauggaugaagcucauuuuacggacccuucuuccaucgccgcucgcggcuacauuagcacaagagucggaaugggcgaggccgccgcuaucuucaugaccgcgacacccccugggucuguggaagccuuuccgcagagcaaugcugugauccaggaugaggaacgggacauucccgagcgcuccuggaacucuggauaugaguggaucacagauuucccuggcaagaccgucugguuuguucccagcauuaaauccgggaaugacaucgccaacugucucagaaagaauggaaaacgggugauucagcuuucuagaaagacauucgauaccgaauaccaaaagacgaaaaacaacgacugggacuacguggucacaaccgauaucagcgagaugggcgccaauuuccgcgcugaccgggugauugauccuagacgcugccugaagcccguuauccugaaagacgggccggaacgggugauccucgccggcccuaugcccgucacaguggcguccgcugcccagagacgcggacggauuggcagaaaccacaauaaggagggggaucaguauaucuacaugggacagccccugaacaaugacgaggaucaugcccacuggaccgaagcuaaaaugcuucuggacaacauuaauacgccugagggcaucauucccgcccucuuugaaccugagcgcgaaaagagcgcggccaucgauggggaguauagacugcggggagaggcucgcaagaccuucguugaacugaugagacggggcgaccucccgguguggcuuucuuacaaagucgccuccgagggguuucaauauagcgaucgcagauggugcuucgacggcgaacggaacaaucaggugcuggaggaaaacauggaugucgagaucuggacaaaggagggagaacgcaagaagcugcgcccccgguggcucgacgcuagaaccuacuccgacccucuggcccuucgcgaguuuaaagaguucgcugccggccggagaucugugagcggggaucugauucucgagaucggaaagcugccccagcaccugacacagcgggcgcaaaaugcccucgacaaccuuguuaugcugcauaauuccgaacagggcgggcgcgcuuauagacacgccauggaggagcugccugauaccauugaaacacucaugcugcuugcucugaucgccgugcucaccggaggcgugacgcuguuuuuccugucuggccgggggcucggaaaaacaagcauuggccuucugugugucauggccuccagcguucugcucuggauggcuucuguggagccccauuggaucgcggccuccaucauucuggaauuuuuccuuauggugcugcucaucccggagccugaccgccagagaacaccccaggauaaccaacuggcuuacgucgugauugggcugcucuuuaugauccuuaccguugccgccaaugagaugggacugcuggaaacaaccaagaaggaccucggcauugggcacguggcugucgagaaccaccaucacgccgcgaugcuggauguggaccuucauccugccagcgcuuggacacuguacgccgucgcuacgaccaucauuacacccaugaugcggcacaccaucgaaaacacaaccgccaauaucucucucacggcgauugccaaccaggcugccauccugaugggacuggauaaaggcuggccuauuuccaagauggacaucggcgugccccuccuugcucuggggugcuauagccagguuaauccgcugacccucacagccgcugugcugaugcuugucgcccauuacgcgauuaucggaccuggccugcaagccaaagcuacccgcgaggcccagaagagaacagcugccgggaucaugaaaaaccccaccguggauggaauuguugccaucgaccucgaucccguggucuaugacgcgaaguucgaaaagcagcugggccagauuaugcugcucauccuuuguacgucucaaauucugcugaugcggacaaccugggcucucugcgagagcaucacacuggccaccgggccucuuaccacacugugggagggauccccgggcaaauuuuggaauacgaccaucgcugugucuauggccaacauuuuccgcggcagcuaccucgccggggcuggacuggccuucucccugaugaaaagccucggcgggggaagacggggcacaggggcgcagggagaaacccuuggcgagaaauggaagagacagcugaaucagcuguccaaaucugaauuuaacacauauaagcgcagcggcaucauggagguggaccgguccgaagccaaggaggggcucaaaagaggagagaccacgaagcacgcuguuucucgcggcacagccaaacugcggugguucgucgaaagaaaucuugugaagcccgaggggaaagugauugaucugggauguggccgcgggggauggagcuacuauugcgcuggccucaagaaggucaccgaaguuaaaggcuacaccaaaggcgggccugggcacgaggaacccaucccuauggccacauacggguggaaccuggugaaacugcauuccggaaaggacguguuuuucauucccccugagaaaugugauacccuccuuugcgacaucggcgagucuagcccgaaucccacaauugaagaggggcggacgcugagaguccugaagaugguggaaccuuggcuccgcggaaaccaauuuuguaucaaaauccugaaucccuauaugccuuccguuguggagacccuugagcagaugcagcggaagcacggcggcaugcuggucagaaacccccucagccgcaauucuacacaugaaauguacuggguguccugcgggaccggaaacauuguuagcgcggugaauaugacaucucggaugcugcugaacagauucaccauggcccaccgcaagccgacguaugagagagaugucgaccucggcgcugggacccggcacguggccguggaaccugaggucgcuaaccuggauaucauuggacagcgcaucgaaaauauuaaacaugagcacaaguccacauggcauuacgacgaggauaaccccuauaaaaccugggccuaccacggcagcuaugaaguuaagcccucuggguccgcuagcuccauggugaauggaguggucaaacuucugacaaagccuugggacgugauccccaugguuacccaaaucgccaugacagauaccacgccuuuuggccagcagagaguguucaaggagaaagucgacacacggaccccgaaggcgaaaagaggcaccgcccaaauuauggaagugacagcuaaguggcucuggggguuucugagccggaacaaaaagccccgcaucuguacgagagaggaguucacccggaagguucgcucuaaugccgcuauuggagccguguuugucgacgagaaccaguggaauagcgccaaagaggcgguggaagaugagagauucugggaccuuguucaucgggaacgcgagcugcacaagcagggcaaaugcgcuacaugcguguacaacaugauggggaagagagagaaaaagcucggagaguuuggcaaggccaaagggucccgggccaucugguacauguggcugggcgcucgcuuccuggaguucgaagcccucggauuuaugaaugaggaucacugguucucuagagaaaacagccuguccggcgucgagggggagggacuucauaagcugggcuauauucuccgggacaucucuaaaaucccugggggaaauauguacgcugaugacaccgccggcugggauacacgcauuaccgaagacgaucugcagaacgaggcgagaaucacagacauuauggaacccgagcacgcccuucuggcuaagagcaucuuuaaacucaccuaucaaaauaaggugguccgggugcagcgcccugccaaaaacgggacgguuauggaugugauuuccagacgggaccagagaggcucuggacaggucggcaccuacgggcugaauacauucaccaacauggaagcucaacugauccgccagauggagagcgagggaaucuuuucccccagcgaacucgagacaccgaaccuggccgaacgggugcuugauuggcuggagaaguauggcguggaaagacucaagcgcauggcgauuucuggggacgacuguguugugaaaccuaucgaugaccgguucgccaccgcucugacggcccuuaaugauaugggaaaggucagaaaagacauuccccagugggagccuuccaagggcuggaacgauuggcagcaagugcccuuuugcagccaucacuuccaccagcugaucaugaaagacgggcgcgagauuguugugccuugucggaaucaggaugaacucgucggcagagcucgcgugucucagggagccggcuggucccugcgggagacagcuugccugggaaagagcuacgcccaaauguggcagcucauguauuuucauagacgcgaccugcggcuugcggccaacgcuaucuguuccgccguccccguggauuggauuccgaccucuagaacaaccuggagcauccacgcccaucaccaguggaugacgaccgaagacaugcuguccguuuggaaucggguguggaucgaggaaaacccuuggauggaggauaagacacauauuagcucuuggggagacguccccuaccucggcaaaagagaggaccaauggugcgggucccugaucggacuuaccgcucgcgccacaugggcgaccaauauucagguggcuaucaaccagguucggagacugauuggcaaugaaaacuaccucgauuauaugacaagcaugaagcgcuucaaaaaugagucugaccccgaaggggcccugugguga

SEQ ID NO: 19015 - RNA, 9879 nt, Artificial Sequence
  derived and/or modified CDS sequence (opt5) from DENV-1__FJ898384__SS-prME
agcgugaccaugcugcucaugcugaugcccacagcccuugcuuuccaccugacgaccagaggaggggaaccucauaugaucgucuccaagcaggaacggggaaaaucucuccuguuuaagacaagcgccggcguuaacaugugcacccuuaucgcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgccauuuuccuggcgcaugccaucgggacaucuaucacccagaagggaauuaucuuuauucuucugaugcucgucaccccuagcauggcuaugagaugcgugggcaucgggucccgggauuucguugagggacugagcggcgccacauggguggacgucgugcuugagcacgggucuugugugacgaccauggcuaaggauaaacccacacuggacauugaacuccugaagaccgaggucacaaacccugccguucugcgcaaacucugcaucgaagcgaagauuuccaauaccacgacagauagcagauguccgacccaaggagaggccacccugguggaagaacaagacgcuaacuuugugugccggcgcacauucgucgauagaggcuggggcaauggguguggacuuuuuggcaaagggucucugauuaccugcgccaaguucaagugcgugacaaaacucgagggaaagaucguucaguacgaaaaccugaaauauuccgugauugucacggugcacaccggcgaccagcaucaaguugggaaugagagcacagaacacggaaccacagcuaccaucacgccccaggccccuucuaccgagauucagcuuacagacuacggcgcccugacccucgauuguagcccccggacaggccuggacuuuaacgaaauggugcugcucaccaugaaggagaaaagcuggcugguccauaagcagugguuccuugaucugccucuccccuggacguccggggcuucuacaagccaagagaccuggaaucgccaggaccugcuugugacauuuaaaaccgcgcacgccaagaagcaggaagucgugguucugggaucccaagagggcgcuaugcacaccgcccucacaggggccacggaaauccagaccagcggaacaaccacaauuuucgcuggccaucugaaaugcagacugaagauggauaaacucacccugaaggggaugucuuaugugauguguacgggcuccuucaaacuugagaaggaagucgccgagacacagcacggaaccgugcugguucagaucaaguacgagggcaccgacgcgccgugcaaaaucccuuuuagcacacaagaugaaaagggggugacccagaacggacggcucauuacagcuaaucccaucgucacggacaaagagaagccugugaacauugaagccgagccgcccuucggcgagucuuauaucgugauuggggccggagaaaaagcucugaagcugagcugguuuaagaaaggcuccucuaucgggaagauguucgaggccaccgcuagaggcgcccgccggauggcgauccuuggagauacagccugggacuuuggcagcauugggggaguuuucaccuccgucggcaaacucgugcaucagaucuuugggacagcuuacggagugcuguucagcggcgucucuuggaccaugaagauugggaucggcgugcugcucacguggcugggacuuaauuccagaagcaccucucuguccaugacauguauugccguuggccucgugacccuguaccugggggucauggugcaggcugauagcggaugcguuaucaacuggaaaggccgcgaacuuaaguguggguccggaauuuuugugacaaaugagguccacaccuggacagaacaauauaaguuccaggccgacucuccuaaacggcucagcgcggccaucggcaaggcuugggaggagggggugugcggcaucagauccgccacccgccuggaaaacauuauguggaaacagaucucuaacgagcugaaucauauucuccuggaaaacgacaugaaacuuacgguuguggucggagauguggcuggcauccuggcccaggggaaaaagaugauucggccgcaacccauggaguacaaauauagcuggaaguccuggggaaaggccaaaaucaucggcgcugacgugcagaauacaaccuuuauuaucgaugggccuaacacccccgaauguccugacgaucagagagcguggaauauuugggaggucgaggacuacggauucggcaucuuuacaaccaacauuuggcucaagcugcgcgauagcuauacgcagguuugcgaccaccggcugaugucugccgcuaucaaagauuccaaggccgugcacgccgacaugggcuacuggaucgaaagcgagaaaaaugaaacauggaaacuugcuagagccucuuucauugaggugaagaccuguaucuggcccaagucccauacacucuggagcaacgggguccuggaaucugagaugauuaucccgaagauuuauggaggcccuaucagccaacacaauuaccgccccggguacuucacccagacagcgggaccuuggcaucugggcaaacucgagcuggauuuugaccuuugcgaagggaccacggugguuguggaugagcacugcggaaaccggggccccucccugagaaccacaaccgucacaggcaagaucauucacgaaugguguugccggagcuguacccucccuccccugcgcuucaaaggggaggacggaugcugguauggcauggagaucagaccggugaaggaaaaggaggaaaaucugguuaaaucuaugguguccgcugggagcggagaggucgacuccuuuucucuuggccuccuguguauuagcaucaugauugaagaggugaugcgguccagauggucucgcaagaugcugaugacggggacacucgccguuuucuuucugcuuaucaugggacagcugaccuggaacgaucucauucggcugugcaucauggugggcgccaaugcuagcgacagaaugggcauggggacaaccuaccuggcccuuauggcgaccuucaaaaugcgcccuauguuugcugucggacuccuguucagacggcugacaucccgcgaggugcuccugcuuacgaucggccugucucucguggccagcgucgaacugcccaacucccuggaggaacuuggggauggacuggccaugggcauuaugauccucaagcugcucaccgacuuucaaagccaucagcugugggcuacacuucugucucucaccuucauuagaacaaccuuuucccugcacuaugccuggaaaacgauggcuaugguucugagcaucgugucucuuuucccccugugucucuccacaaccagccagaagaccacauggcugccugugcuccuggggucucuuggaugcaagccgcugaccauguuucugauugccgagaauaaaaucuggggccggaaguccuggccccucaacgaaggcaucauggcggucgggauugugagcauccugcuuuccagccugcucaaaaacgauguuccucuggccggaccccucauugcuggcgggaugcugaucgccuguuacgugauuucuggaagcuccgcugaccuuucucuggagaaggccgccgaggucagcugggaagaggaagcugagcauuccggcgcgucucacaauauccugguggaaguucaggaugacgggacaaugaaaaucaaggaugaggagcgcgacgauacgcucaccauucugcuuaaagccacacugcucgcugugagcggagucuauccucuguccauccccgccacccucuucgugugguacuucuggcaaaagaagaaacagagaucuggcguccugugggacacaccuuccccucccgaaguggagcgggccguucuugaugacggcauuuaucgcaucaugcagagagggcugcugggacggucccaggugggcgucgggguguuucaagaaaacguuuuccauaccauguggcacgugacgcgcggagcuguccucauguaccagggcaagagacuggagcccagcugggccucugugaaaaaggaccuuauuuccuacgggggaggcuggcggcugcagggcagcuggaauaccggggaggaagugcagguuaucgcggucgagcccggcaagaauccuaagaaugugcaaacagcucccggcaccuuuaagacaucugaaggggaggugggagccauugcccucgauuucaaaccgggcaccuccgggagcccuaucgucaacagagaaggaaagaucgugggccuguauggcaaugggguugugacaacguccggaaccuacgucucugcuauugcccaggcgaaagcuagccaggagggcccccucccugagaucgaagacgagguguuucgcaagcggaaccugacaauuauggaucuucaccccggguccggaaaaaccagacgcuaucugcccgccaucguucgggaagccauuaagagacgccugcggacccucauccuggcuccuacaagaguggucgccagcgagauggcugaagcccuuaagggcaugccgauccgcuaccaaacgaccgcggugaaaucugagcauacagggaaggagauuguugaccugaugugccacgccaccuucacaaugcggcuccugucccccgugagagucccuaauuauaacaugaucauuauggaugaagcucauuuuaccgaccccagcucuaucgccgcucggggcuacauuagcacgcgcgugggaaugggcgaggccgccgcuaucuucaugacagcgaccccucccggguccguggaagccuuuccucagucuaaugcugucauccaggaugaggaaagagacauuccggagcggagcuggaacuccggauaugaguggaucaccgauuuccccggcaaaacaguuugguuugugccuucuauuaagagcgggaaugacaucgccaacugucugcgcaaaaauggaaagagagugauucagcucucccggaagaccuucgauacagaauaccagaaaaccaagaacaacgacugggacuacgucgugacgacagauaucagcgagaugggcgccaauuucagagcugaccgcguuauugauccccggagaugccuuaaaccugugauccugaaggacgggcccgaacgcgucauccuggccggcccgaugccugugaccguugcgucugcugcccagcggagaggacgcauuggccggaaccacaauaaagagggggaucaguauaucuacaugggacagccccucaacaaugacgaggaucaugcccacuggacagaagcuaagaugcugcuugacaacauuaauacccccgagggcaucauuccugcccuguuugaacccgagagagaaaaguccgcggccaucgauggggaguaucgccucagaggagaggcucggaaaacguucguggaacugaugcgcagaggcgaccugccugucuggcucagcuacaagguggccuccgagggguuucaauauucugaucggcgcuggugcuucgacggcgaaagaaacaaucagguccuugaggaaaacauggauguggagaucuggaccaaagagggagaacggaagaaacugagaccgcgcuggcuggacgcucggacauacagcgacccccucgcccugagagaguuuaaggaguucgcugccggccgccgguccguuucuggggaucuuauucuggagaucggaaaacucccucagcaccugacccagagagcgcaaaaugcccuggacaaccucgugaugcuucauaauagcgaacagggcgggcgggcuuaucgccacgccauggaggagcugcccgauacaauugaaacccugaugcuccuggcucuuaucgccgugcugacaggaggcgucacccucuuuuuccuguccggcagagggcugggaaagacgagcauuggccuccuuuguguuauggccucuuccgugcugcuguggauggcuagcguggagccucauuggaucgcggccucuaucauucucgaauuuuuccugaugguccuucugauccccgagccggaccggcagcgcacaccucaggauaaccaacucgcuuacgugguuauugggcugcuguuuaugauccucaccguggccgccaaugagaugggacuucuggaaaccacaaagaaagaccugggcauugggcacgucgcuguggagaaccaccaucacgccgcgaugcucgaugucgaccugcaucccgccuccgcuuggacccuuuacgccguggcuacaacgaucauuaccccuaugaugagacacacaaucgaaaacaccacagccaauaucagccugaccgcgauugccaaccaggcugccauccucaugggacuggauaagggcuggcccauuucuaaaauggacaucggcguuccucugcucgcucuugggugcuauagccaggugaauccccugacgcugaccgccgcuguccucaugcugguggcccauuacgcgauuaucggaccgggccuucaagccaaggcuacacgggaggcccagaaacgcaccgcugccgggaucaugaagaacccuacaguugauggaauuguggccaucgaccuggaucccgucguguaugacgcgaaguucgaaaaacagcucggccagauuaugcugcugauccucuguaccucccaaauucuucugaugagaacgacaugggcucugugcgagucuaucacccucgccacagggccccugaccacccuuugggagggaagcccuggcaaguuuuggaauacaacgaucgcuguguccauggccaacauuuuccggggcagcuaccuggccggggcuggacucgccuucucccugaugaaaucucugggcgggggacgcagaggcaccggggcgcagggagaaacacucggcgagaaguggaaacggcagcuuaaucagcugagcaaguccgaauuuaacaccuauaagagaucuggcaucauggagguugaccgcagcgaagccaaagaggggcugaagcggggagagacaaccaaacacgcugucuccagaggcacggccaagcuccgcugguucguggaacggaaucuggugaaaccggaggggaaggucauugaucuuggauguggcagagggggauggucuuacuauugcgcuggccugaagaaaguuacagaagugaagggcuacaccaaagggggacccggccacgaggaaccuauccccauggccaccuacggguggaaccucgugaagcugcauagcggaaaagacgucuuuuucauuccucccgagaagugugauacacugcucugcgacaucggcgaguccagcccuaauccgaccauugaagaggggcgcacacuucgggugcugaaaaugguugaacccuggcugagaggaaaccaauuuuguaucaagauccucaauccuuauaugcccucuguggucgagacgcuggagcagaugcagcgcaagcacggcggcaugcuugugcggaacccucuguccagaaauagcacccaugaaauguacuggguuucuugcgggacaggaaacauuguguccgcggucaauaugaccagccgcaugcuccugaaccgguucacaauggcccacagaaaacccaccuaugagcgcgauguggaccugggcgcugggacgagacacguggccgucgaaccggagguugcuaaccucgauaucauuggacagcggaucgaaaauauuaagcaugagcacaaaucuaccuggcauuacgacgaggauaacccuuauaagacaugggccuaccacggcuccuaugaagugaaacccagcggguccgcuagcucuauggugaauggagucgugaagcugcuuaccaagcccugggacguuaucccuauggugacacaaaucgccaugaccgauacaacccccuuuggccagcagcgcgucuucaaagagaagguggacacgagaacaccuaaagcgaagcggggcaccgcccaaauuauggaaguuaccgcuaaauggcuguggggguuucucagcagaaacaagaagccgcggaucuguacacgcgaggaguucacgagaaaagugcgguccaaugccgcuauuggagccgucuuuguggacgagaaccaguggaacucugccaaggaggcgguugaagaugagcgcuucugggaccuggugcauagagaacgggagcuucacaaacagggcaagugcgcuaccugcgucuacaacaugauggggaaacgcgaaaagaagcugggagaguuuggcaaagccaaggggagcagagccaucugguacauguggcucggcgcucgguuccuggaguucgaagcccugggauuuaugaaugaggaucacugguucucccgcgaaaacucucucagcggcguggagggggagggacugcauaaacuuggcuauauucugagagacaucuccaagauccccgggggaaauauguacgcugaugacacagccggcugggauacccggauuacagaagacgaucuccagaacgaggcgaaaaucaccgacauuauggaaccugagcacgcccugcuugcuaagucuaucuuuaaacugacauaucaaaauaaggucgugcgcguucagagacccgccaagaacgggaccgugauggaugucauuagccggcgcgaccagagaggcuccggacaggugggcacguacgggcucaauaccuucacaaacauggaagcucaacugauccggcagauggagagcgagggaaucuuuucuccuuccgaacuggagacccccaaccucgccggcagagugcuggauuggcuugaaaaacaugggguugagcgccugaagcggauggcgauuagcggagacgacuguguggucaaaccgaucgaugacagauucgccacagcucucaccgcccugaaugauaugggcaaggugcgcaaagacauuccucagugggaacccucuaagggguggaacgauuggcagcaaguuccuuuuugcucccaccacuuccaucagcuuaucaugaaggacggccgggagauugugguccccuguagaaaucaggaugagcuggugggacgcgcucgggucagccagggcgccggguggucccucagagaaacggcuugccugggaaaaucuuaugcccaaauguggcagcugauguacuuucaccgccgggaccucagacuggcggccaacgcuaucuguagcgccgugccuguugauugggugcccacaucccgcaccacauggagcauucaugcccaccaucaguggaugaccacggaggacaugcuuucugucuggaaucggguguggaucgaagagaacccguggauggaagauaagacccacguuuccagcuggggcgacgugccuuaucuggggaaaagagaggaccaauggugcggaucucucaucggccugacagcucgggccaccugggcgacaaauauucaggucgcuaucaaccaggugagacgccuucuggggaaugagaacuaccucgauuacaugaccagcaugaagcgguucaaaaaugaauccgaccccgagggcgcccugugguga

SEQ ID NO: 19016 - RNA, 9879 nt, Artificial Sequence
  derived and/or modified CDS sequence (opt5) from DENV-1__FJ898385__SS-prME
agcgugaccaugcugcugaugcugaugcccaccgcccuugcuuuccaccugacgacccggggaggggaaccucauaugaucgucacaaagcaggaacggggaaaaucccuccuguuuaagaccucugccggcguuaacaugugcacccuuauugcgauggaccugggggaacucugugaagauaccaugacauacaaaugcccccgcaucaccgaggcugaacccgacgauguggacuguuggugcaaugccacggauaccugggugacauauggaaccuguagccagacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguucacagugguugugggaggcgucguggggauucucgcucagggcaaaaagaugauccggccgcaacccauggagcacaaauacucuuggaaaagcuggggcaaggccaagauuaucggggccgaugugcagaauaccaccuuuaucauugacggaccuaacacacccgaauguccugaugaccagagagcuuggaauaucugggaggucgaggauuauggcuucggcauuuuuaccacgaacaucuggcugaagcugcgcgacuccuacacacagguuugcgaucaccggcuuaugagcgcggccauuaaagacucuaaggcugugcaugccgauaugggguauuggaucgaauccgagaaaaaugaaaccuggaagcucgccagagcuagcuucaucgaggugaagacauguauuuggcccaaaucucacacccugugguccaacggaguccuggaaagcgagaugaucauuccgaagaucuacggcgggccuauuucucaacauaauuaucgccccggauacuucacacagaccgccggcccuuggcaccucgggaaacuggagcuugacuuugaucugugcgaaggaacgaccgugguuguggacgagcacugcggcaaccggggccccagccucagaacaaccacagucaccgggaagaucauccaugaaugguguugccgguccuguacgcugccuccccugcgcuucaaaggagaggauggcugcugguacgggauggagauuagaccggugaaggaaaaggaggaaaaucuuguuaaaagcauggugucugcgggauccggcgaggucgacagcuuuucccucgggcugcuguguaucucuauuaugaucgaagaggugaugcggagcagauggucccgcaagaugcucaugacaggaacccuggcuguuuuccuucugcucauuaugggccagcugacauggaacgaccugauccggcuuugcauuauggugggcgccaaugccucugauagaauggggaugggaaccaccuaucuggcucucauggccacauuuaaaaugcgcccuauguucgcggucggccugcucuuuagacggcugacgagccgcgaggugcuucugcucaccaucgggcugucccugguggcuucugucgaacuucccaacagccuggaggaacucggagacggccuggccauggggaucaugauucucaagcugcuuacagauuuccaaucccaccagcugugggccacccuccugagccugacauuuaucaaaaccacgcuuucucugcauuacgcuuggaagacaauggccaugauucucuccaucguuagccuguucccccucugucugucuaccaccucccagaagacaaccuggcuuccugugcugcugggaagccucggcugcaaaccgcugacaauguuucuuauugcugagaauaagaucuggggcagaaaaucuuggccccugaacgaagggaucauggccgugggagucguguccauucuccugagcucccuccugaagaacgacguuccucuugcgggcccccugaucgccgggggaaugcugauugcuuguuaugugaucagcggcucuagcgccgaucucucccuggagaaagcugccgaggucucuugggaagaggaagccgagcacagcggggcuucccauaauauucuuguggaaguucaggacgauggaacgaugaagaucaaagacgaggagcgggaugacacccugacaauccuccugaaggcgacccuccuggccgugucuggcgucuacccucuuagcauucccgcuacacuguucgugugguauuuuuggcaaaagaaaaagcagcgcuccggcguccugugggauaccccuucucccccggaaguggagagagccguucucgacgaugggaucuaccggauuaugcagcgcggacugcuuggcagaagccaggugggggucggaguguuccaagaaaacguuuuccacacgauguggcacgugacccggggcgccguccugauguaucaggggaaacgccucgagccuuccugggcuagcgugaagaaagaccugaucucuuacggaggcggcuggagacuccagggguccuggaauaugggagaggaagugcagguuauugccgucgagcccggcaagaacccuaagaaugugcaaacagcgcccgggaccuuuaaaacaccggaaggagaggugggcgcuaucgcccuggacuucaagccugggaccagcggaucucccauugucaaccgggaaggcaaaaucgugggccuuuacgggaauggaguugugacaacguccggcaccuaugucagcgccaucgcucaggccaaggcgucccaggaggggccucugcccgagauugaagaugagguguuuagaaaacgcaaccugacaaucauggaccuccaucccggaucuggcaagacccggagauaccugccugcuauuguucgcgaagccaucaagcggaaacuuagaacccugauucucgccccgacacgcguggucgcuagcgagauggccgaagcucugaaggggaugcccauccgguaucaaacgaccgccgugaaauccgagcacacaggcaaggagaucguugaucugaugugccaugcgaccuucacaaugagacuccuuagcccugugcgcguccccaauuacaacaugauuaucauggacgaagcccacuuuaccgauccuucuuccauugcugcccggggauauaucagcacgagagugggcaugggggaggcugccgccauuuucaugacagcuacacccccuggaucuguggaagcguuuccgcagagcaaugccgucauccaggacgaggaacgggauauccccgagcgcuccuggaacucuggcuacgaguggauuaccgacuucccugggaaaacaguuugguuugugcccagcaucaaguccggaaaugauauugcuaacugucugagaaagaauggcaaacgggugauccagcugucucgcaagaccuucgacacagaauaucagaaaaccaagaacaacgauugggacuacgucgugacgacagacauuagcgagaugggggccaauuuuagagccgaucggguuaucgacccuagacgcugccucaaacccgugauucugaaggauggcccggaacgggucauccuugcuggaccuaugcccgugaccguugccuccgcggcucagagacgcggccggaucgggagaaaccauaauaaggagggagaccaguacauuuauaugggccagccccugaacaaugaugaggaccacgcccacuggacagaagccaaaaugcuccuggauaacaucaauaccccugaggggauuauccccgcucuguucgaaccugagcgcgaaaagagcgccgcgauugacggagaguaccggcucagaggcgaggcccgcaaaacguucguggaacuuaugagaagaggggaucugccggucuggcugucuuauaagguggcuuccgagggcuuucaauacagcgaccgcagauggugcuucgauggagaacggaacaaucagguccucgaggaaaacauggacguggagaucuggaccaaagagggcgaacgcaagaaacugagaccccgguggcuugaugccagaacauauuccgacccucuggcucuccgcgaguuuaaggaguucgccgcugggcggagaucuguuagcggagaccugauccuggagauuggcaagcucccccagcaucuuacccagcgcgcccaaaaugcgcuggauaaccuggugaugcuccacaauuccgaacaagggggacgggccuacagacaugcuauggaggagcugccugacacaaucgaaacccuuaugcugcucgcccugauugcugugcugacaggcggcgucacccucuuuuuccuuucugggcggggacugggcaaaacgagcaucgggcugcucuguguuauggccuccagcgugcugcuuuggauggccucuguggagccccacuggauugcugcguccaucauccuggaauuuuuccucaugguccugcugauuccggagccugaucgccagagaacaccccaggacaaccaacucgccuaugugguuaucggacuucuguuuaugauucugaccguggcugccaaugagaugggccuccuggaaaccacaaagaaagaucuugggaucggacacgucgccguggagaaccaucaccaugcuaccaugcuggacgucgaucuccacccugccagcgcguggacacuguacgccguggcuacgaccauuaucacacccaugaugcggcauaccauugaaaacacaaccgccaauaucucucugacggcuaucgccaaccaggcggccauucucaugggccuugacaagggcuggccuaucuccaaaauggauauugggguuccccugcuggcucucggaugcuacagccaggugaauccgcugacccuuacagccgcuguccugaugcucguggcccacuaugcuaucauuggcccugggcugcaagccaaggcgacccgcgaggcccagaagagaacagcugccggaaucaugaaaaaccccaccguugacggcaucguggcuauugaucuggaccccgucguguacgaugccaaguucgaaaaacagcucgggcagaucaugcuucugauucuguguacgucucaaauccuccugaugcggacaaccugggcccuuugcgagagcauuacacuggcgaccggaccucucaccacacugugggagggcuccccgggcaaguuuuggaauacgaccaucgcugugucuauggccaacaucuuccgcgggagcuaucuggcuggagccggccucgccuuuucccuuaugaaaagccucgggggaggcagacgggggacaggagcucagggcgaaacccugggcgagaaguggaagcgccagcucaaucagcuguccaaaucugaguucaacauuuacaagagaagcgggaucauggagguugaccgguccgaagccaaagagggacuuaagagaggcgagacaacccgccacgcggucucucgggggacggccaaacugagaugguucguggaacgcaaucucgugaagcccgagggaaaggucauugaccugggcugugggcggggaggcuggagcuauuacugcgcuggccugaaaaagguuacagaagugaaaggguauaccaagggaggcccugggcaugaggaacccaucccuauggccaccuacggauggaaccucgugaaacuucacuccggcaaggaugucuuuuucacacccccugagaaaugugacacccugcugugcgauauuggggagucuagcccgaaucccacaaucgaagagggaagaacgcuccgcgugcugaagaugguugaaccuuggcuucggggcaaccaauuuuguauuaagauccugaaucccuacaugccuuccguggucgagacccucgagcagaugcagagaaaacauggcgggaugcuggugcgcaacccccugagcagaaauucuacacacgaaauguauuggguuuccugcggaaccggcaacaucgugagcgcugucaauaugacaucuagaaugcuccugaaccgcuucaccauggcccaccggaagccgacguacgagagagacguggaucuuggggcgggaacccgccauguggccgucgaaccugagguugcuaaccuggacauuaucggccagagaauugaaaauaucaaacacgagcauaaguccacauggcacuaugaugaggacaaccccuacaaaaccugggccuaucaugggagcuacgaagugaagcccucuggauccgcuagcuccauggugaauggcgucgugaagcuccugacaaaaccuugggauguuauucccauggugacccaaaucgccaugacagacaccacgccuuuuggccagcagcgggucuucaaggagaaaguggauacacgcaccccgaaggcuaaaagagggaccgcccaaaucauggaaguuacagcgcgguggcuuuggggauuucugagcagaaacaagaagccccggauuuguacgcgcgaggaguucaccagaaaagugcggucuaaugccgcuaucggcgccgucuuuguggacgagaaccaguggaauagcgcuaaggaggccguugaagacgagcgcuucugggaucucgugcagaaagaaagagagcugcacaagcaggggaaaugcgccacaugcgucuauaacaugaugggaaagcgggaaaagaaacugggcgaguuugggaaggcgaaaggcucccgcgcuauuugguacauguggcucggagccagauuccuggaguuugaagcccuuggcuucaugaaugaggaccacugguucucucgggaaaacagccuguccgggguggagggagagggccuccauaagcugggguacauccuucgcgauauuucuaaaaucccuggaggcaauauguaugcugacgauaccgccgggugggacacaagaaucaccgaagaugaccugcaaaacgaggcuaagauuacagauaucauggaacccgagcacgcccuccuggcgaccagcauuuuuaaacugacguaccagaauaaggucgugcggguucagcgcccugccaagaacggcaccgugauggacgucaucuccagacgggaucagcgcggaucuggccaaguggggacauauggacucaauaccuucacaaacauggaagcucagcugauuagacagauggagagcgagggcaucuuuucccccagcgaacuugagaucccgaaccuggccgaacgggugcucgacuggcuggagaaauacgggguugaaagacuuaagcgcauggcuauuucuggagaugacuguguggucaaaccuaucgacgaucgguucgccaccgcgcugacggcccucaaugacaugggcaaggugagaaaagauguuccccagugggagccuuccaagggguggaacgacuggcaacaggugcccuuuugcagccaucacuuccaccagcugauuaugaaggauggccgcgagaucgucgugccuugucggaaucaggacgaacuggucggacgggcucgcgugucucaaggcgccggguggucccuccgggagacagcuugccugggaaaaagcuaugcccagauguggcagcuuauguacuuucauagacgcgaucugcggcucgcugccaacgcgauuuguuccgccguucccguggacugggucccgaccucuagaacaaccuggagcauccacgcucaucaccaauggaugacgaccgaagauaugcuguccguguggaaucgcguuuggauugaggaaaacccuuggauggaggacaagacacaugugagcucuuggggcgauguccccuaucuugggaaacgggaggaccaguggugcggaucccugaucggccucaccgccagagccacaugggcuagcaauauccagguggccauuaaccaggugcggagacugaucgggaaugaaaacuaccuggacuacaugaccucuaugaagcgcuucaaaaaugagggcgaucccgaaggagcgcucugguga

SEQ ID NO: 19017 - RNA, 9879 nt, Artificial Sequence
  derived and/or modified CDS sequence (opt5) from DENV-1__GQ868608__SS-prME
uccgugaccaugcugcugaugcugaugcccaccgcccuugcuuuccaccugacgaccagaggaggggagccucauaugaucgucuccaagcaggaacggggaaaaucucuccuguuuaagacaagcgccggcguuaacaugugcacccuuauugccauggaccugggggaguucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaggcuuggcuuguccauaagcagugguuccuggaucucccucugcccuggacaagcggggcguccaccucucaagagacauggaaucgcaaagaccuucuggugaccuuuaagaccgcccacgcuaagaaacaggaagucgugguucucggaagccaggagggcgccaugcacacagcccugacgggggcuaccgaaauccaaacauccggaaccacaaccauuuucgccggccaucugaagugcagacucaaaauggauaagcugacgcuuaaagggaugagcuaugugauguguacaggcucuuucaagcuggagaaggaagucgcggagacccagcacggaaccgugcucguucagaucaaauacgagggcacagacgcuccgugcaagauuccuuuuuccacccaggaugaaaaaggggugacacaaaacggacggcugaucacggccaaucccaucgucaccgacaaggagaaaccugugaacauugaagccgagccgcccuucggcgagagcuauaucgugauuggggcuggagaaaaggcccugaaacuuucuugguuuaaaaagggcagcuccaucgggaaaauguucgaggcuacagccagaggcgcgcgccggauggccauucucggagauaccgcuugggacuuuggcucuaucgggggaguuuucacaagcgucggcaagcuggugcaucagaucuuugggaccgccuacggagugcuguucuccggcgucagcuggacgaugaaaauugggaucggcgugcuccugaccuggcuuggacucaauucuagauccacaagccucucuaugaccuguauugcuguuggccuggugacacuguaccuuggggucauggugcaggccgauuccggaugcguuaucaacuggaagggccgcgaacucaagugugggagcggaauuuuugugaccaaugagguccacacauggaccgaacaguauaaauuccaagcggacuccccuaagcggcugucugccgcuaucggcaaagccuggaaggagggggugugcggcauuagaagcgcuacgcgccuggagaacaucauguggaaacagaucuccaacgaacucaaucauauucugcuugagaacgacaugaaguuuacaguuguggucggagauguggccggcauccuggcccaggggaaaaagaugauucggccgcagcccauggaauacaaguauucuuggaaaagcuggggaaaggcuaaaaucauuggcgcggacgugcaaaaugccaccuucaucaucgaugggccuaacacccccgaguguccugacgaucagagagcuuggaauauuugggaagucgaggacuacggauuuggcaucuucacaaccaacauuuggcucaagcugcgcgauuccuauacgcagguuugcgaccaccggcugaugagcgccgccaucaaagauucuaaggcugugcacgccgacaugggcuacuggauugaguccgaaaagaaugagacauggaaacuugcgagagcuagcuucaucgaagugaagaccuguaucuggcccaaaucucauacacucugguccaacgggguccuggagagcgaaaugauuaucccgaagauuuauggaggcccuaucucucagcacaauuaccgccccggguacuuuacccaaacagccggaccuuggcaucugggcaaacucgagcuggauuucgaccuuugcgaggggaccacggugguuguggaugaacacugcggaaaccggggccccagccugagaaccacaaccgucacaggcaagauuauccacgagugguguugccgguccuguacccucccuccccugcgcuuuaagggggaagacggaugcugguauggcauggagaucagaccggugaaagagaaggaagagaaucugguuaaaagcauggugucugccggguccggagaagucgacagcuucucccuuggccuccuguguauuucuaucaugauugaggaagugaugcggagcagauggucccgcaagaugcugaugacggggacacucgcugucuuuuuccugcuuaucaugggacagcugaccuggaacgaucucauucggcugugcaucauggugggcgccaaugcgucugacagaaugggcauggggacaaccuaccuggcucuuauggccaccuuuaaaaugcgcccuauguucgccgucggacugcucuuuagacggcugacaagccgcgaggugcuccugcuuacgauuggccugucccucguggcuucugucgagcugcccaacagccuggaggaacuuggggauggacuggccaugggcaucaugauccucaagcugcucaccgacuuccagucccaucaacugugggcuacacuucugagccucaccuuuauuaagacaaccuucucucugcacuaugccuggaaaacgauggcgaugguucuguccaucgugagccuuuuuccccugugucucucuacaaccucccagaagaccacauggcugccugugcuccuggggagccuuggaugcaaaccgcugaccauguuccugauugccgaaaauaagaucuggggcagaaaaucuuggccccucaacgagggcauuauggcugucgggaucguguccauccugcuuagcucccugcucaagaacgauguuccucuggccggaccccucauugcuggcgggaugcugaucgccuguuacgugauuagcggaucuagcgccgaccuuucccuggaaaaagcugcggaggucucuugggaggaagaggccgaacauagcggcgcuucccacaauauccugguggagguucaggaugacgggacaaugaagauuaaggaugaagaacgggacgauaugcucacgauccugcuuaaagccacccugcucgccgugucuggagucuauccucugagcauccccgcuacacucuucgugugguacuuuuggcagaagaaaaagcaacgcuccggcguccugugggacaccccuucucccccggagguggaaagagccguucuugaugacggcauuuaucggaucaugcagcgcgggcugcugggaagaagccaggugggcgucgggguguuccaggagaacguuuuucauacaauguggcacgugacccggggagcgguccucauguaccaaggcaaacgccuggaaccuuccugggcuagcgugaagaaggaccuuauuucuuacgggggaggcuggagacugcagggcuccuggaauacgggggaggaggugcagguuaucgccgucgaacccggcaaaaauccuaagaaugugcagaccgcccccggcacauucaaaaccagcgagggggaagugggagcuauugcccucgauuuuaagccgggcacaucuggguccccuaucgucaaccgggagggaaaaauugugggccuguauggcaaugggguugugaccacaagcggaacguacgucuccgcgaucgcucaagccaaggccucucaggaaggcccccucccugagaucgaggacgaaguguucagaaagcgcaaccugaccauuauggaucuucaccccgggagcggaaaaacacggagauaucugcccgcuaucguucgcgaggccauuaagcggaaacugagaacccucauccuggcuccuacccgcguggucgccuccgaaauggcggaggcccuuaagggcaugccgauucgguaccagacaacggcugugaaaagcgaacauaccgggaaggagaucguugaccugaugugccacgccacauuuaccaugagacuccugucucccgugcgcgucccuaauuauaacaugaucauuauggaugaggcucauuucacagaccccuccagcaucgccgcccggggcuacauuucuaccagagugggaaugggcgaagcugcggccaucuuuaugacggcuacaccucccgggagcguggaggccuucccucaauccaaugccgucauucaggaugaggaacgggacaucccggaacgcucuuggaacagcggauaugaguggaucaccgauuuucccggcaagaccguuugguucgugccuuccauuaaaucugggaaugacaucgcuaacugucugagaaagaauggaaaacgggugauucagcucagccgcaagacauucgauaccgaguaccagaaaacaaagaacaacgacugggacuacgucgugaccacggauaucuccgaaaugggcgccaauuuuagagcggaccggguuauugaucccagacgcugccuuaagccugugauccugaaagacgggcccgagcgggucauucuggcuggcccgaugccugugacaguugccagcgccgcucaaagacgcggacggaucggcagaaaccacaauaaggaaggggaucaguauaucuacaugggacagccccucaacaaugacgaggaucaugcccacuggaccgaggcgaaaaugcugcuugacaacauuaauacacccgaaggcaucauuccugcccuguucgagcccgaacgcgagaagucugcugccaucgauggggaauaucggcucagaggagaggcucgcaaaaccuuuguggagcugaugagacggggcgaccugccugucuggcucuccuacaagguggccagcgaaggguuccaguauuccgaucgcagauggugcuuugacggcgagcggaacaaucaaguccuugaagagaacauggauguggaaauuuggacgaaagagggagagcgcaagaagcugagaccgcgguggcuggacgcuagaaccuacucugacccccucgcccugcgcgaguucaaagaguuugcggccggccggagaagcguuuccggggaucuuauccuggaaaucggaaagcucccucagcaccugacacagcgcgcucagaaugcccuggacaaccucgugaugcuucauaauucugagcaaggcgggcgggcuuauagacacgccauggaggaacugcccgauaccauugagacacugaugcuccuggcccuuaucgcugugcugaccggaggcgucacacucuucuuucugagcggccgggggcugggaaaaaccuccauuggccuccuuuguguuauggcgagcucugugcugcuguggauggccuccguggaaccucauuggaucgcugccagcauuauccucgaguucuuucugaugguccuucugauccccgaaccggaccgccagagaacgccucaggauaaccagcucgccuacgugguuauugggcugcuguucaugauccucacaguggcugccaaugagaugggacuucuggagaccaccaagaaagaccugggcauugggcacgucgcgguggaaaaccaccaucacgccgcuaugcucgaugucgaccugcaucccgccucugcuuggacacuuuacgccguggcgaccacaaucauuacgccuaugaugcggcacaccaucgagaacacaaccgccaauauuucccugacagcuaucgccaaccaagcugccauccucaugggacuggauaagggcuggcccauuagcaagauggacaucggcguuccucugcucgcucuugggugcuauucucaggugaauccccugacccugacggccgcgguccucaugcugguggcccauuacgcuauuaucggaccgggccuucaggccaaagcuacccgcgaagcccaaaagagaacagccgcggggauuaugaaaaacccuaccguugauggaaucguggcuaucgaccuggaucccgucguguaugacacaaaguuugagaaacagcucggccagauuaugcugcugauccucuguaccagccagauucuucugaugcggacgacaugggcccugugcgaauccaucacccucgcuacagggccccugaccacccuuugggagggaucuccuggcaaguucuggaauacaacgauugccgugagcauggccaacaucuuccgcggcuccuaccuggcuggggccggacucgcguuuagccugaugaagucccugggcgggggaagacggggcaccggggcccaaggagagacacucggcgaaaaauggaagcgccagcuuaaucagcugucuaaaagcgaguucaacaccuauaagagauccggcaucauggaaguugaccggucugaggcuaaagaagggcugaagagaggagagacaaccaagcacgccgucagccgcggcacggcuaaacuccggugguuuguggagagaaaucuggugaagccggaagggaaagucauugaucuuggauguggccgcgggggaugguccuacuauugcgccggccugaagaaaguuacagaggugaagggcuacaccaaagggggacccggccacgaggaaccuauccccauggcgaccuacggguggaaccucgugaagcugcauucuggaaaggacgucuucuuuauuccucccgaaaaaugugauacacugcucugcgacaucggcgagagcuccccuaauccgaccauugaggaagggcggacacuuagagugcugaagaugguugagcccuggcugcgcggaaaccaguucuguaucaaaauucucaauccuuauaugcccagcguggucgaaacgcuggagcaaaugcagcggaagcacggcggcaugcuugugagaaacccucugucucgcaauuccacccaugagauguacuggguuagcugcgggacaggaaacaucgugucugccgucaauaugaccucccggaugcuccugaacagauuuacaauggcucaccgcaaacccaccuaugaacgggauguggaccugggcgccgggacgagacacguggcugucgagccggaaguugccaaccucgauaucauuggacagcgcaucgagaauauuaagcaugaacacaagagcaccuggcauuacgacgaggauaacccuuauaaaacaugggcuuaccacggcucuuaugaggugaagcccuccgggagcgccuccagcauggugaauggagucgugaaacugcuuaccaagcccugggacguuaucccuauggugacacagauugcgaugaccgauacaacccccuucggccaacagagagucuuuaaagaaaagguggacacgcggacaccuaaggccaaacgcggcaccgcucagaucauggagguuaccgccaaguggcuguggggguuccucucuagaaacaaaaagccgcggaucuguacaagagaagaguuuacgcggaaagugcgcagcaaugcugccauuggagccgucuucguggacgaaaaccaauggaacuccgcgaaggaggcuguugaggaugaaagauuuugggaccuggugcaucgggagcgcgaacuucacaagcagggcaaaugcgcgaccugcgucuacaacaugauggggaagagagagaaaaagcugggagaguucggcaaagccaaggggucucgggcuaucugguacauguggcucggcgcccgcuuccuggaguuugaggcucugggauucaugaaugaagaucacugguuuagcagagagaacucccucucuggcguggaaggggagggacugcauaaacuuggcuauauucugcgggacaucagcaagauucccgggggaaauauguacgccgaugacacagcgggcugggauacccgcaucacagaggacgaucuccagaacgaagccaagaucaccgacauuauggagccugaacacgcucugcuugccaaauccaucuucaagcugacauaucagaauaaagucgugagaguucaacggcccgcuaagaacgggaccgugauggaugucauuucucgcagagaccagcggggcagcggacaggugggcacguacgggcucaauaccuuuacaaacauggaggcccagcugauccgccaaauggaauccgagggaauuuucagcccuucugagcuggaaacccccaaccucgcgggcagagugcuggauuggcuugagaaacaugggguugaacggcugaagagaauggccaucuccggagacgacuguguggucaagccgaucgaugaccgcuuugcuacagcccucaccgcucugaaugauaugggcaaagugcggaaggacauuccucagugggagcccagcaaaggguggaacgauuggcagcagguuccuuucugcucucaccacuuucaucaacuuaucaugaaggacggcagagaaauugugguccccugucgcaaucaggaugagcuggugggacgggccagagucucccagggcgcuggguggagccuccgcgagacggccugccugggaaaauccuaugcgcagauguggcaacugauguacuuccaccggagagaccuccgccuggccgcuaacgccaucuguucugccgugccuguugauugggugcccacaagccggaccacaugguccauucaugcucaccaucaguggaugaccacggaagacaugcuuagcgucuggaauagaguguggaucgaggaaaacccguggauggaggauaagacccacauuucuuccuggggcgacguuccuuaucuggggaagcgcgaagaccaguggugcggaagccucaucggccugacagcccgggcgaccugggcuacaaauauccaaguggccauuaaccaggucagacggcuuaucgggaaugagaacuaccuggauuacaugaccucuaugaaaagauuuaagaaugagauugaccccgaaggcgcccucugguga

SEQ ID NO: 19018 - RNA, 9879 nt, Artificial Sequence
  derived and/or modified CDS sequence (opt5) from DENV-1__GQ199774__SS-prME
agcgugaccaugcugcucaugcugaugcccaccgcccuugcuuuccaccugacgaccagaggaggggaaccucauaugaucguguccaagcaggaacggggaaagucucuccuguuuaagacgagcgccggcguuaacaugugcacccuuauugcgauggaccugggggagcucugugaagauaccaugaccuacaagugcccgcgcaucacagagguggaacccgacgauguggacuguuggugcaauaccacggauaccugggucacauauggaaccuguucccagacaggcgagcacagacgggacaagcgcucuguggcucuggccccucauguugggcugggacucgagaccagagccgaaacguggaugagcuccgagggcgcuuggaaacagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaagauaagcccacacuggacaucgaacugcucaaaaccgagguuacaaacccugcugugcugcggaaacuuugcauugaagccaaaaucuccaauaccacgacagauagccgcuguccgacccaaggagaggcgacccugguggaagaacaagacgccaacuucgucugcagacggacauuuguggaucgcggcuggggcaauggguguggacucuucggcaaggggucucugauuaccugcgcuaaguuuaaaugcguuacaaaacuugagggaaaaaucgugcaguacgaaaaccugaaguauuccgucaucgugacgguucacaccggcgaccagcaucaaguggggaaugagagcacagaacacggaaccauugccacaaucacaccccaggcuccuacgucugagauucagcucaccgacuacggcgcccugacacuggauuguucccccagaaccggccucgacuucaacgaaaugguccugcuuacaaugaaagaaaagagcuggcuggugcauaaacagugguuucucgaucugccucuucccuggaccuccggggccucuacgagccaagagacauggaaucggcaggaccugcucgucaccuucaagacagcucacgcgaagaaacaggaagugguugugcugggaucccaagagggcgccaugcacaccgcucugaccggggccacagaaauccagacgaccggaacaaccacaauuuuugccggccaucucaagugccgccugaaaauggauaaacuuacccugaaagggaugagcuaugucauguguacgggcucuuucaagcucgagaaggaaguggcugagacacagcacggaaccguucuggugcagaucaaauacgagggcaccgacgccccgugcaagaucccuuucuccacacaagaugaaaaaggggucacccagaacggaagacugauuacagcgaaucccaucgugacggacaaggagaaaccugugaacauugaagcugagccgcccuuuggcgagagcuauaucguuauuggggccggagaaaaggcccuuaagcucucuugguucaaaaagggcagcuccaucgggaaaauguuugaggcuaccgcccggggcgcuagacgcauggccauccugggagauacagcgugggacuucggcucuauugggggagucuuuaccagcgugggcaagcuggugcaucagaucuucgggacagccuacggaguccucuuuuccggcgugagcuggaccaugaaaauugggaucggcguucugcuuacguggcugggacucaauucucgguccaccagccugucuaugacauguauugcugugggccugaucacccuuuaccucggggucauggugcaggccgauuccggaugcguuauuaacuggaagggcagagaacugaagugugggagcggaaucuucgugacaaaugagguccacaccuggacagaacaauauaaauuucaggcugacuccccuaagcgccugucugccgcgaucggcaaagccugggaggagggggugugcggcauucggagcgcuaccagacucgaaaacaucauguggcgccagauuuccaacgagcugaaucauauccuucuggaaaacgacaugaaguucacgguuguggucggagauguggugggcauucucgcccaggggaaaaagaugguccggccgcaacccauggagcacaaauacucuuggaaaagcuggggaaaggcuaagaucaucggcgccgacguucagaauacaaccuuuauuaucgaugggccuaacacccccgaauguccugacgaucagagagccuggaauauuugggagguggaggacuauggauucggcaucuuuacaaccaacauuuggcugaagcugcgcgauuccuacacacaggugugcgaccaccggcuuaugagcgcugcgaucaaagauucuaaggccguccaugcugacaugggcuauuggaucgaauccgagaaaaaugaaacauggaagcucgccagagccagcuucauugaggugaagaccuguaucuggcccaaaucucacacacugugguccaacgggguucuggaaagcgagaugauuaucccgaagauuuacggaggcccuaucucucaacauaauuaucgccccggguacuucacccagacagcuggaccuuggcaccucggcaaacuggagcuugauuuugaccugugcgaagggaccacgguggucguggaugagcacugcggaaaccggggccccagccucagaaccacaaccguuacaggcaagaucauucaugaaugguguugccgguccuguacccugccuccccugcgcuucaaaggggaggacggaugcugguacggcauggagaucagaccggugcgggaaaaggaggaaaaucuugucaagagcauggugucugccggguccggagagguugacagcuuuucccucggccugcuguguauuucuaucaugauugaagaggugaugagaagccgcuggucccggaaaaugcucaugacggggacacuggcggucuucuuucuucugaucaugggacagcucaccuggaacgaucugauuagaucuugcaucauggugggcgcuaaugccagcgaccgcaugggcauggggacaaccuaucuggcccuuauggcuaccuucaagaugagaccuauguuugccgugggacuccuguuccggcgccugacauccagagagguccuccugcuuacgaucggccugucucucguugcgagcguggaacugcccaacucccuggaggaacuuggggauggacuggcuaugggcauuaugauccucaaacugcucaccgacuuucaaagcuaccagcugugggccacacuucugucucucaccuucauuaagacaaccuuuucccugcacuaugccuggaaaacgauggcuauggugcugagcaucgucucucuucugccccucugucuguccacaaccagccagaagaccacauggcucccugugcugcuugggucucugggaugcaagccgcugaccauguuccucauugccgagaauaaaaucuggggccggaaguccuggccccugaacgaaggcaucauggcuguugggauugugagcauccuucuguccagccuccugaaaaacgaugucccucucgccggaccccugauugcgggcgggaugcuuaucgccuguuacgugauuucuggaagcuccgcugaccugucucuggagaaggccgcugagguuagcugggaagaggaagccgagcauuccggcgccucucacaauauccucguggaaguccaggaugacgggacaaugaaaaucaaggaugaggagcgcgacgauacgcugaccauucuucugaaagcuacacuccuggcggugagcggagucuauccucucuccauccccgccacccuguuugugugguacuucuggcaaaagaagaaacagagaucuggcguucuuugggacacaccuagcccucccgaaguggagcgggcuguccuggaugacggcauuuaucgcaucaugcagagagggcugcucggacggucccaggugggcguugggguguuccaagaaaacgucuuucauaccauguggcacgugacgcgcggagccgugcugauguaccagggcaagagacuugagcccagcugggccucuguuaaaaaggaccugauuuccuacgggggaggcuggcggcuccagggcagcuggaauaccggggaggaaguccaggugaucgcuguggagcccggcaagaauccuaagaauguccaaacagcccccggcaccuucaagacaccggaaggggaggugggagcgauugcucuggauuuuaaaccuggcaccucugggucccccaucguuaacagagaaggaaagaucgugggccucuauggcaauggggucgugacaacgagcggaaccuacguuuccgccauugcccaggcuaaagccucucaggagggcccucugcccgagaucgaagacgagguguuccgcaagcggaaccuuacaauuauggaucugcaccccgggagcggaaaaaccagacgcuaucugccugcgaucguccgggaagcuauuaagagaaagcuccgcacccugauccuugccccgacacgggugguugccuccgagauggcugaagcccugaaaggcaugcccaucagauaccaaacgaccgcugucaagagcgagcauacagggcgcgagauugucgaccucaugugccacgccaccuuuacaaugcggcugcugucuccugugagagugcccaauuauaacaugaucauuauggaugaagcgcauuucaccgacccuuccagcaucgccgcucggggcuacauuucuacgcgcgucggaaugggcgaggccgcugccaucuuuaugacagccacacccccugggagcguugaggcuuucccgcaguccaaugcggugauccaggaugaggaaagagacauucccgagcggucuuggaacagcggauaugaguggaucaccgauuuuccuggcaaaacagugugguucguccccuccauuaagucugggaaugacaucgccaacugucuccgcaaaaauggaaagagagugauucagcuuagccggaagaccuuugauacagaauaccagaagaccaagaacaacgacugggacuacguugugacgacagauaucuccgagaugggcgcuaauuucagagccgaccgcgucauugauccucggagaugccugaaacccgugauccugaaggacgggccggaacgcguuauccucgccggcccuaugcccgugaccgucgcuagcgccgcgcagcggagaggacgcauuggccggaaccacaauaaagagggggaucaguauaucuacaugggacagccccugaacaaugacgaggaucaugcucacuggacagaagccaagaugcuucuggacaacauuaauaccccugagggcaucauucccgcccucuucgaaccugagagagaaaagucugcugccaucgauggggaguaucgccugagaggagaggcgcggaaaacguuuguggaacugaugcgcagaggcgaccucccggucuggcuuuccuacaagguggccagcgagggguuccaauauuccgaucggcgcuggugcuuugacggcgaaagaaacaaucagguucuggaggaaaacauggauguggagaucuggaccaaagagggagaacggaagaaacugagaccccgcuggcucgacgcucggacauacucugacccucuggcccuuagagaguucaaggaauuugcugccggccgccggagcguguccggggaucugauucucgagaucggaaaacugccccagcaccugacccagagagcucaaaaugcccucgacaaccuugucaugcugcauaauucugaacagggcgggcgggcguaucgccacgccauggaggagcugccugauacaauugaaacccucaugcugcuugcucugaucgccguucucacaggaggcgugacccuguucuuucugagcggcagagggcucggaaagacguccauuggccuucugugugugauggcuagcucugcccugcucuggauggccuccgucgagccccauuggaucgcugcgagcaucauucuggaguucuuucuuauggugcugcucaucccggagccugaccggcagcgcacaccccaggauaaccaacuggccuacguugugauugggcuccuguucaugauccuuaccgucgcugccaaugagaugggacugcuggaaaccacaaagaaagaccucggcauugggcacguggccgucgagaaccaccaucacgcuaccaugcuggauguggaccuucauccugccucugcguggacacuguacgccguugcuacgaccaucauuacacccaugaugagacacaccaucgaaaacacaaccgccaauaucucccucacggcuauugccaaccaggcggccauccugaugggacuggauaagggcuggccuauuagcaaaauggacaucggcgugccccuccuugcucuggggugcuauucucaggucaauccgcugacccucacagccgcugugcugaugcuuguugcccauuacgcuauuaucggaccuggccugcaagccaaggcgacccgggaggcccagaaacgcacagcugccgggaucaugaagaaccccaccguggauggaauugucgcuaucgaccucgaucccgugguguaugacgccaaguuugaaaaacagcugggccagauuaugcugcucauccuuuguacgagccaaauucugcugaugagaacaaccugggcccucugcgaguccaucacacuggcgaccgggccucuuaccacacugugggagggaucuccgggcaaguucuggaauacgaccaucgcuguuagcauggccaacauuuuucggggcuccuaccucgcuggggccggacuggccuucagccugaugaaaucccucggcgggggacgcagaggcacaggggcucagggagaaacccuuggcgagaaguggaaacggcagcugaaucagcugucuaagagcgaguucaacacauauaagagauccggcaucauggaggucgaccgcucugaagccaaagaggggcuccggagaggagagaccacgaagcacgcggugagccgcggcacagccaaacugcggugguuuguggaaagaaaucuugucaagcccgaggggaaaguuauugaucugggauguggccgcgggggaugguccuacuauugcgcuggccucaagaaggugaccgaagugaaaggcuacaccaaagggggaccuggccacgaggaacccaucccuauggccacauacggguggaaccuggucaaacugcauucuggaaaggacguguucuuuauucccccugagaaaugugauacccuccuuugcgacaucggcgagagcuccccgaaucccacaauugaagaggggcggacgcugagaguucugaagaugguggaaccuuggcuccgcggaaaccaauucuguaucaaaauccugaaucccuauaugccuagcgucguggagacccuugagcacaugcagcggaagcauggcggcaugcugguuagaaacccccucucucgcaauuccacacacgaaauguacugggugagcugcgggaccggaaacauugucucugcugugaauaugacaucccggaugcugcugaacagauuuaccauggcccaccgcaagccgacguaugagagagauguggaccucggcgcggggacccggcaugucgccguugaaccugagguggcuaaccuggauaucauuggacagcgcaucgaaaauauuaaacacgagcauaagagcacauggcacuacgacgaggauaaccccuauaaaaccugggccuaccauggcucuuaugaagugaagcccuccgggagcgcuuccagcauggucaauggagugguuaaacuucugacaaagccuugggacgugauccccauggucacccagaucgccaugacagauaccacgccuuucggccaacagagaguguuuaaggagaaaguugacacacggaccccgaaggcuaaaagaggcaccgcccagauuauggaagugacagcgcgguggcucuggggguuccugucucgcaacaagaaacccagaaucuguacgcgggaggaauuuacccgcaaggucagaagcaaugccgcuauuggagccguguucguugacgagaaccaauggaacuccgcuaaggaggccguggaagaugagcgguuuugggaccuuguccaccgcgaaagagagcugcacaaacagggcaagugcgccacaugcguguacaacaugauggggaaacgggaaaagaaacucggagaguucggcaaggcgaaggggucucgcgcuaucugguacauguggcugggcgccagauuucuggaguucgaagcccucggauucaugaaugaggaucauugguuuagccgggaaaacucccugucuggcgucgagggggagggacuucacaaacugggcuauauucuccgcgacaucagcaagaucccugggggaaauauguacgcugaugacaccgccggcugggauacaagaauuaccgaagacgaucugcagaacgaggcuaaaaucacagacauuauggaacccgagcaugcccuucuggcgaccuccaucuucaagcucacguaucagaauaaagugguucgggugcaacgcccugccaagaacgggaccgucauggaugugauuucuagacgggaccagagaggcagcggacaggugggcacauacgggcugaauaccuuuacaaacauggaagcucagcugauccgccaaauggaguccgagggaaucuucagccccucugaacucgagaccccgaaccuggccgaacggguucuugauuggcuggagaaauauggcguggaaagacucaagcgcauggcuauuuccggggacgacugugucgugaagccuaucgaugaccgguuugccacggcgcugacagcccuuaaugauaugggaaaaguuagaaaggacauuccccagugggagccuagcaaaggcuggaacgauuggcaacaggugcccuucugcucucaccacuuucaucaacugaucaugaaggacgggcgcgagauugucgugccuugucggaaucaggaugaacucgucggcagagcucgcgugucccagggagccggcuggagccugcgggagaccgcuugccuggggaaauccuacgcccagauguggcaacucauguauuuccacagacgcgaccugcggcuugcugccaacgcgaucuguucugccguucccguggauugggucccgacaagcagaaccacgugguccauucaugcucaccaucaguggaugaccacagaagacaugcugagcguguggaaucggguuuggaucgaggaaaacccuuggauggaggauaagacccacaucucuuccuggggagacgugcccuaccucggcaagagagaggaccaguggugcgggagccugauuggacuuacagcccgcgccaccugggcuacaaauauccaagucgccauuaaccaggugcggagacugaucggcaaugaaaacuaccucgauuauaugaccucuaugaaacgcuuuaagaaugagagcgaccccgaaggggcgcugugguga

SEQ ID NO: 19019 - RNA, 9879 nt, Artificial Sequence
  derived and/or modified CDS sequence (opt5) from DENV-1__GQ199775__SS-prME
agcgugaccaugcugcucaugcugaugcccaccgcccuugcuuuccaccugacgaccagaggaggggaaccucauaugaucguguccaagcaggaacggggaaagucucuccuguuuaagacgagcgccggaguuaacaugugcacccuuauugcgauggaccugggggaacucugugaagauaccaugaccuacaagugcccgcgcaucacagagguggaacccgacgauguggacuguuggugcaauaccacggauaccugggucacauauggaaccuguucccagacaggcgagcacagacgggacaagcgcucuguggcucuggccccucauguugggcugggacucgagaccagagccgaaacguggaugagcuccgagggcgcuuggaaacagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaagauaagcccacacuggacaucgaacugcucaaaaccgagguuacaaacccugcugugcugcggaaacuuugcauugaagccaaaaucuccaauaccacgacagauagccgcuguccgacccaaggagaggcgacccugguggaagaacaagacgccaacuucgucugcagacggacauuuguggaucgcggcuggggcaauggguguggacucuucggcaaggggucucugauuaccugcgcuaaguuuaaaugcguuacaaaacuugagggaaaaaucgugcaguacgaaaaccugaaguauuccgucaucgugacgguucacaccggcgaccagcaucaaguggggaaugagagcacagaacacggaaccauugccacaaucacaccccaggcuccuacgucugagauucagcucaccgacuacggcgcccugacacuggauuguucccccagaaccggccucgacuucaacgaaaugguccugcuuacaaugaaagaaaagagcuggcuggugcauaaacagugguuucucgaucugccucuucccuggaccuccggggccucuacgagccaagagacauggaaucggcaggaccugcucgucaccuucaagacagcucacgcgaagaaacaggaagugguugugcugggaucccaagagggcgccaugcacaccgcucugaccggggccacagaaauccagacgaccggaacaaccacaauuuuugccggccaucucaagugccgccugaaaauggauaaacuuacccugaaagggaugagcuaugucauguguacgggcucuuucaagcucgagaaggaaguggcugagacacagcacggaaccguucuggugcagaucaaauacgagggcaccgacgccccgugcaagaucccuuucuccacacaagaugaaaaaggggucacccagaacggaagacugauuacagcgaaucccaucgugacggacaaggagaaaccugugaacauugaagcugagccgcccuuuggcgagagcuauaucguuauuggggccggagaaaaggcccuuaagcucucuugguucaaaaagggcagcuccaucgggaaaauguuugaggcuaccgcccggggcgcuagacgcauggccauccugggagauacagcgugggacuucggcucuauugggggagucuuuaccagcgugggcaagcuggugcaucagaucuucgggacagccuacggaguccucuuuuccggcgugagcuggaccaugaaaauugggaucggcguucugcuuacguggcugggacucaauucucgguccaccagccugucuaugacauguauugcugugggccugaucacccuuuaccucggggucauggugcaggccgauuccggaugcguuauuaacuggaagggcagagaacugaagugugggagcggaaucuucgugacaaaugagguccacaccuggacagaacaauauaaauuucaggcugacuccccuaagcgccugucugccgcgaucggcaaagccugggaggagggggugugcggcauucggagcgcuaccagacucgaaaacaucauguggcgccagauuuccaacgagcugaaucauauccuucuggaaaacgacaugaaguucacgguuguggucggagauguggugggcauucucgcccaggggaaaaagaugguccggccgcaacccauggagcacaaauacucuuggaaaagcuggggaaaggcuaagaucaucggcgccgacguucagaauacaaccuuuauuaucgaugggccuaacacccccgaauguccugacgaucagagagccuggaauauuugggagguggaggacuauggauucggcaucuuuacaaccaacauuuggcugaagcugcgcgauuccuacacacaggugugcgaccaccggcuuaugagcgcugcgaucaaagauucuaaggccguccaugcugacaugggcuauuggaucgaauccgagaaaaaugaaacauggaagcucgccagagccagcuucauugaggugaagaccuguaucuggcccaaaucucacacacugugguccaacgggguucuggaaagcgagaugauuaucccgaagauuuacggaggcccuaucucucaacauaauuaucgccccggguacuucacccagacagcuggaccuuggcaccucggcaaacuggagcuugauuuugaccugugcgaagggaccacgguggucguggaugagcacugcggaaaccggggccccagccucagaaccacaaccguuacaggcaagaucauucaugaaugguguugccgguccuguacccugccuccccugcgcuucaaaggggaggacggaugcugguacggcauggagaucagaccggugcgggaaaaggaggaaaaucuugucaagagcauggugucugccggguccggagagguugacagcuuuucccucggccugcuguguauuucuaucaugauugaagaggugaugagaagccgcuggucccggaaaaugcucaugacggggacacuggcggucuucuuucuucugaucaugggacagcucaccuggaacgaucugauuagaucuugcaucauggugggcgcuaaugccagcgaccgcaugggcauggggacaaccuaucuggcccuuauggcuaccuucaagaugagaccuauguuugccgugggacuccuguuccggcgccugacauccagagagguccuccugcuuacgaucggccugucucucguugcgagcguggaacugcccaacucccuggaggaacuuggggauggacuggcuaugggcauuaugauccucaaacugcucaccgacuuucaaagcuaccagcugugggccacacuucugucucucaccuucauuaagacaaccuuuucccugcacuaugccuggaaaacgauggcuauggugcugagcaucgucucucuucugccccucugucuguccacaaccagccagaagaccacauggcucccugugcugcuugggucucugggaugcaagccgcugaccauguuccucauugccgagaauaaaaucuggggccggaaguccuggccccugaacgaaggcaucauggcuguugggauugugagcauccuucuguccagccuccugaaaaacgaugucccucucgccggaccccugauugcgggcgggaugcuuaucgccuguuacgugauuucuggaagcuccgcugaccugucucuggagaaggccgcugagguuagcugggaagaggaagccgagcauuccggcgccucucacaauauccucguggaaguccaggaugacgggacaaugaaaaucaaggaugaggagcgcgacgauacgcugaccauucuucugaaagcuacacuccuggcggugagcggagucuauccucucuccauccccgccacccuguuugugugguacuucuggcaaaagaagaaacagagaucuggcguucuuugggacacaccuagcccucccgaaguggagcgggcuguccuggaugacggcauuuaucgcaucaugcagagagggcugcucggacggucccaggugggcguugggguguuccaagaaaacgucuuucauaccauguggcacgugacgcgcggagccgugcugauguaccagggcaagagacuugagcccagcugggccucuguuaaaaaggaccugauuuccuacgggggaggcuggcggcuccagggcagcuggaauaccggggaggaaguccaggugaucgcuguggagcccggcaagaauccuaagaauguccaaacagcccccggcaccuucaagacaccggaaggggaggugggagcgauugcucuggauuuuaaaccuggcaccucugggucccccaucguuaacagagaaggaaagaucgugggccucuauggcaauggggucgugacaacgagcggaaccuacguuuccgccauugcccaggcuaaagccucucaggagggcccucugcccgagaucgaagacgagguguuccgcaagcggaaccuuacaauuauggaucugcaccccgggagcggaaaaaccagacgcuaucugccugcgaucguccgggaagcuauuaagagaaagcuccgcacccugauccuugccccgacacgggugguugccuccgagauggcugaagcccugaaaggcaugcccaucagauaccaaacgaccgcugucaagagcgagcauacagggcgcgagauugucgaccucaugugccacgccaccuuuacaaugcggcugcugucuccugugagagugcccaauuauaacaugaucauuauggaugaagcgcauuucaccgacccuuccagcaucgccgcucggggcuacauuucuacgcgcgucggaaugggcgaggccgcugccaucuuuaugacagccacacccccugggagcguugaggcuuucccgcaguccaaugcggugauccaggaugaggaaagagacauucccgagcggucuuggaacagcggauaugaguggaucaccgauuuuccuggcaaaacagugugguucguccccuccauuaagucugggaaugacaucgccaacugucuccgcaaaaauggaaagagagugauucagcuuagccggaagaccuuugauacagaauaccagaagaccaagaacaacgacugggacuacguugugacgacagauaucuccgagaugggcgcuaauuucagagccgaccgcgucauugauccucggagaugccugaaacccgugauccugaaggacgggccggaacgcguuauccucgccggcccuaugcccgugaccgucgcuagcgccgcgcagcggagaggacgcauuggccggaaccacaauaaagagggggaucaguauaucuacaugggacagccccugaacaaugacgaggaucaugcucacuggacagaagccaagaugcuucuggacaacauuaauaccccugagggcaucauucccgcccucuucgaaccugagagagaaaagucugcugccaucgauggggaguaucgccugagaggagaggcgcggaaaacguuuguggaacugaugcgcagaggcgaccucccggucuggcuuuccuacaagguggccagcgagggguuccaauauuccgaucggcgcuggugcuuugacggcgaaagaaacaaucagguucuggaggaaaacauggauguggagaucuggaccaaagagggagaacggaagaaacugagaccccgcuggcucgacgcucggacauacucugacccucuggcccuuagagaguucaaggaauuugcugccggccgccggagcguguccggggaucugauucucgagaucggaaaacugccccagcaccugacccagagagcucaaaaugcccucgacaaccuugucaugcugcauaauucugaacagggcgggcgggcguaucgccacgccauggaggagcugccugauacaauugaaacccucaugcugcuugcucugaucgccguucucacaggaggcgugacccuguucuuucugagcggcagagggcucggaaagacguccauuggccuucugugugugauggcuagcucugcccugcucuggauggccuccgucgagccccauuggaucgcugcgagcaucauucuggaguucuuucuuauggugcugcucaucccggagccugaccggcagcgcacaccccaggauaaccaacuggccuacguugugauugggcuccuguucaugauccuuaccgucgcugccaaugagaugggacugcuggaaaccacaaagaaagaccucggcauugggcacguggccgucgagaaccaccaucacgcuaccaugcuggauguggaccuucauccugccucugcguggacacuguacgccguugcuacgaccaucauuacacccaugaugagacacaccaucgaaaacacaaccgccaauaucucccucacggcuauugccaaccaggcggccauccugaugggacuggauaagggcuggccuauuagcaaaauggacaucggcgugccccuccuugcucuggggugcuauucucaggucaauccgcugacccucacagccgcugugcugaugcuuguugcccauuacgcuauuaucggaccuggccugcaagccaaggcgacccgggaggcccagaaacgcacagcugccgggaucaugaagaaccccaccguggauggaauugucgcuaucgaccucgaucccgugguguaugacgccaaguuugaaaaacagcugggccagauuaugcugcucauccuuuguacgagccaaauucugcugaugagaacaaccugggcccucugcgaguccaucacacuggcgaccgggccucuuaccacacugugggagggaucuccgggcaaguucuggaauacgaccaucgcuguuagcauggccaacauuuuucggggcuccuaccucgcuggggccggacuggccuucagccugaugaaaucccucggcgggggacgcagaggcacaggggcucagggagaaacccuuggcgagaaguggaaacggcagcugaaucagcugucuaagagcgaguucaacacauauaagagauccggcaucauggaggucgaccgcucugaagccaaagaggggcuccggagaggagagaccacgaagcacgcggugagccgcggcacagccaaacugcggugguuuguggaaagaaaucuugucaagcccgaggggaaaguuauugaucugggauguggccgcgggggaugguccuacuauugcgcuggccucaagaaggugaccgaagugaaaggcuacaccaaagggggaccuggccacgaggaacccaucccuauggccacauacggguggaaccuggucaaacugcauucuggaaaggacguguucuuuauucccccugagaaaugugauacccuccuuugcgacaucggcgagagcuccccgaaucccacaauugaagaggggcggacgcugagaguucugaagaugguggaaccuuggcuccgcggaaaccaauucuguaucaaaauccugaaucccuauaugccuagcgucguggagacccuugagcacaugcagcggaagcauggcggcaugcugguuagaaacccccucucucgcaauuccacacacgaaauguacugggugagcugcgggaccggaaacauugucucugcugugaauaugacaucccggaugcugcugaacagauuuaccauggcccaccgcaagccgacguaugagagagauguggaccucggcgcggggacccggcaugucgccguugaaccugagguggcuaaccuggauaucauuggacagcgcaucgaaaauauuaaacacgagcauaagagcacauggcacuacgacgaggauaaccccuauaaaaccugggccuaccauggcucuuaugaagugaagcccuccgggagcgcuuccagcauggucaauggagugguuaaacuucugacaaagccuugggacgugauccccauggucacccagaucgccaugacagauaccacgccuuucggccaacagagaguguuuaaggagaaaguugacacacggaccccgaaggcuaaaagaggcaccgcccagauuauggaagugacagcgcgguggcucuggggguuccugucucgcaacaagaaacccagaaucuggacgcgggaggaagucacccgcaaggugagaagcaaugccggaauuggcgcugggguuggagacgagaaccaauggaacuccgccaagaaaggcguggaggaugaacgguuuugggaccuuguccaccgcgagagagaacugcacaagcaggggaaaugugcuacaugcguguacaacaugaugggcaagcgggagaaaaagcucggagaguucggcaaggccaaagggucucgcgccaucugguacauguggcugggagcgagauuucuggaguucgaggcucucggcuuuaugaaugaagaucauugguucagccgggagaacucccugucuggggucgaaggagagggccuucacaagcugggguauauucuccgcgacaucagcaaaaucccuggcggaaauauguacgccgaugacaccgccggcugggauacaagaauuaccgaggacgaucugcagaacgaagcuaagaucacagacauuauggagcccgaacaugcccuucuggcuaccuccaucuucaaacucacguaucagaauaaggugguucgggugcaacgcccugccaaaaacgggaccgucauggaugugauuucuagacgggaccagagaggaagcggccagguggggacauacggacugaauaccuuuacaaacauggaggcgcagcugauccgccaaauggaauccgagggcaucuucagccccucugagcucgaaaccccgaaccuggccgagcggguucuugauuggcuggaaaaguaugggguggagagacucaagcgcauggcuauuuccggcgacgacugcgucgugaaaccuaucgaugaccgguuugccacggcucugacagcccuuaaugauaugggaaagguuagaaaagacauuccccagugggaaccuagcaagggcuggaacgauuggcaacaggugcccuucuguucucaccacuuucaucaacugaucaugaaagacgggcgcgagauugucgugccuugccggaaucaggaugagcucgucggcagagcgcgcgugucccagggcgccggguggagccugcgggaaaccgcuugucugggaaaguccuacgcccagauguggcaacucauguauuuccacagacgcgaccugcggcuugcugccaacgcuaucugcucugccguucccguggauugggucccgacaagcagaaccacgugguccauucaugcgcaccaucaguggaugaccacagaggacaugcugagcguguggaaucggguuuggaucgaagagaacccuuggauggaagauaagacccacaucucuuccuggggcgacgugcccuaccucgggaaaagagaggaccagugguguggcagccugauuggacuuacagcccgcgcuaccugggccacaaauauccaagucgccauuaaccaggugcggagacugaucggcaaugagaacuaccucgauuauaugaccucuaugaagcgcuuuaaaaaugaaagcgaccccgagggggcucugugguga

SEQ ID NO: 19020 - RNA, 9876 nt, Artificial Sequence
  derived and/or modified CDS sequence (opt5) from DENV-1__FJ882546__SS-prME
agcgugaccaugcugcucaugcugaugcccaccgcccuugcuuuccaccugacgaccagaggaggggaaccucauaugaucguguccaagcaggaacggggaaagucucuccuguuuaagaccagcgccggcguuaacaugugcacccuuauugcgauggaccugggggaacucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaagcucacaguuguggucggagauguggcuggcauucuggggcagggcaagaaaaugauccggccgcaacccauggaguacaaauauucuuggaaaagcuggggcaaggccaagauuaucggggccgacgcucagaauaccaccuucaucauugauggaccuaacacacccgaauguccugacgaucagagagcguggaauaucugggagguggaggacuacggcuuuggcauuuucaccacgaacaucuggcugaaacuucgcgauuccuauacacaggucugcgaccaccggcucaugagcgccgcuauuaaagauucuaaggccguucacgccgacaugggguacuggaucgaauccgagaaaaaugaaaccuggaagcuggcuagagccagcuuuaucgaggugaagacauguauuuggcccaaaucucauacccugugguccaacggagugcucgaaagcgagaugaucauuccgaagaucuauggcgggccuauuucucaacacaauuaccgccccggauacuucacacagaccgcgggcccuuggcaucuggggaaacuugagcuggauuucgaccucugcgaaggaacgaccgucgugguugaugagcacugcggcaaccggggccccagccugagaacaaccacagugaccgggaagaucauccacgaaugguguugccgguccuguacgcugccuccccuucgcuuuagaggagaggacggcugcugguaugggauggagauucggccggucaaagaaaaggaggaaaaucucgucaagagcaugguuucugcuggauccggcgagguggacagcuucucccuggggcugcucuguaucucuauuaugaucgaagaggucaugagaagccgcuggucccggaaaaugcugaugacaggaacccuugccguguuuuuccugcucauuaugggccagcugacauggaacgaucugaucagacuuugcauuaugguuggcgccaaugcuucugaccgcauggggaugggaaccaccuaccuggcccucauggcgacauuuaagaugagaccuauguucgcugugggccugcucuuucggcgccugacgagcagagagguccuucugcucaccaucgggcugucccugguggccucuguggaacuucccaacagccuggaggaacucggagauggccuggccauggggaucaugauucucaaacugcuuacagacuuccaaucccaucagcugugggcuacccuccugagccugacauuuaucaagaccacguucucucuucacuaugccuggaaaacaauggcuaugguccuguccauuguuagccucuuuccccugugucucucuaccaccucccagaagacaaccuggcugccugugcuucugggaagccugggcugcaagccgcucacaauguuccugaucgccgagaauaaaauuuggggccggaagucuuggccccuuaacgaagggaucauggcggugggaaucgucuccauucugcucagcucccugcucaaaaacgaugugccucuggccggcccccuuaucgcugggggaaugcugauugccuguuacguuaucagcggcucuagcgcugaccugucccucgagaaggccgccgaggugucuugggaagaggaagcugagcauagcggggcgucccacaauauucuggucgaagugcaggaugacggaacgaugaaaaucaaggaugaggagcgcgacgauacccuuacaauccugcucaaagccacccugcucgcuguuucuggcguguauccucugagcauucccgccacacuuuuugucugguacuucuggcaaaagaagaaacagagauccggcgugcugugggacaccccuucucccccggaagucgagcgggccgugcuggaugacgggaucuaucgcauuaugcagagaggacuccugggccggagccagguuggggugggagucuuccaagaaaacguguuucauacgauguggcacguuacccgcggcgcugugcuuauguaccaggggaagagacuggagccuuccugggccagcgucaaaaaggaccucaucucuuacggaggcggcuggcggcugagaggguccuggaauacaggagaggaaguccaggugauugcgguugagcccggcaaaaacccuaagaauguccagaccgcucccgggacauucaagaccccggaaggagaggugggcgccaucgcccucgauuuuaaaccugggacaagcggaucucccauugugaaccgcgaaggcaagaucgucggccuguaugggaauggagugguuacgaccuccggcacauacgugagcgcuaucgcccaagcgaaggcuucccaggaggggccucuucccgagauugaagacgaggucuuccggaagagaaaccugaccaucauggaucugcaccccggaucuggcaaaacccgccgguaucucccugccauugugagagaagccaucaagcgcaagcugcggacacuuauucuggcuccgacgagaguuguggccagcgagauggcugaagcccucaaagggaugcccauccgcuaccagaccacagcggucaaguccgagcauaccggcaaagagaucguggaccugaugugccacgccacauuuaccaugcggcugcucagcccuguuagagugcccaauuauaacaugauuaucauggaugaagcucauuucacggacccuucuuccauugccgcucggggauacaucagcacacgcgucggcaugggggaggccgccgcuauuuuuaugaccgcgacacccccuggaucuguggaagccuucccgcaaagcaaugcugugauccaggaugaggaaagagacauccccgagcgguccuggaacucuggcuaugaguggauuacagauuuuccugggaagaccgucugguucguucccagcaucaaauccggaaaugacauugccaacugucuucgcaagaauggcaagagagugauccagcugucucggaaaacauuugauaccgaauaccagaagacgaaaaacaacgacugggacuacguggucacaaccgauauuagcgagaugggggccaauuucagagcugaccgcgugaucgauccucggagaugccugaagcccguuauucucaaagacggcccggaacgcgugauccuggccggaccuaugcccgucacaguggcguccgcugcccaacggagaggccgcaucgggcggaaccacaauaaggagggagaucaguauauuuacaugggccagccccuuaacaaugacgaggaucaugcccacuggaccgaagcuaagaugcugcucgacaacaucaauacgccugaggggauuauccccgcccuguucgaaccugagagagaaaagagcgcggccguugauggagaguaucgccugagaggcgaggcucggaagaccuuuguggagcucaugcgcagaggggaccuuccggucuggcugucuuacaaaguggccuccgagggcuuccaguauagcgaucggcgcuggugcuuugacggagaaagaaacaaucaaguccuggaggaaaacauggauguggagauuuggacaaaggagggcgaacggaaaaagcucagaccccgcuggcuggacgcucggaccuacuccgacccucuugcccugagagaguucaaagaauuugcugccgggcgcaagucuguuagcggagaucucauccuggagaucggcaagcugccccagcaccucacacagcgggcgcagaaugcccuugacaaccuggugaugcugcauaauuccgaacaagggggacgggcuuaucggcacgccauggaggagcucccugauaccauugaaacacugaugcuucuggcucucaucgccgugcugaccggcggcgucacgcuguucuuucucucugggcgcggacuuggcaaaacaagcauugggcugcuguguguuauggccuccagcgugcuccuguggauggcuucuguggagccccauuggaucgcggccuccauuauccuugaguucuuucugaugguccuccugaucccggagccugacagacagcggacaccccaggauaaccagcuggcuuacgugguuauuggacuccuuuucaugauccugaccguggccgccaaugagaugggccugcucgaaacaaccaagaaagaccuggggauuggacacgucgcuguggagaaccaccaucacgccgcgaugcuugaugucgaccugcauccugccagcgcuuggacacucuacgccguggcuacgaccaucauuacacccaugaugcgccacaccaucgaaaacacaaccgccaauauuucucugacggcgaucgccaaccaagcugccauccugaugggccucgauaagggcuggccuauuuccaaaauggacaucgggguuccccuucuggcucugggaugcuauagccaggugaauccgcucacccugacagccgcuguccuuaugcugguggcccauuacgcgauuaucggcccugggcuccaggccaaggcuaccagagaggcccaaaagcggacagcugccggaauuaugaaaaaccccaccguugauggcaucguggccaucgaccuggaucccgucguguaugacgcgaaguuugaaaaacagcuggggcagauuaugcuccuuauccuguguacgucucagauucugcucaugcgcacaaccugggcucugugcgagagcaucacacuugccaccggaccucugaccacacucugggagggcuccccgggcaaguucuggaauacgaccauugcugugucuauggccaacaucuuuagagggagcuaccuggccggagcuggccuggccuucucccucaugaaaagccuugggggaggccggcgcgggacaggagcgcaaggcgaaacccugggcgagaaguggaagagacagcugaaucagcucuccaaaucugaguucaacacauauaagcggagcgggaucauggagguugacagauccgaagccaaagagggacugaagcgcggcgagaccacgaaacacgcugucucucgggggacagccaaacuuagaugguuuguggaacgcaaucuggugaagcccgagggaaaagucauugaucucggcugugggcggggaggcuggagcuacuauugcgcuggccugaagaaaguuaccgaagugaagggguacaccaaaggaggcccugggcacgaggaacccaucccuauggccacauacggauggaaccuggugaagcuccauuccggcaaagacgucuucuuuauucccccugagaagugugauacccuucugugcgacaucggggagucuagcccgaaucccacaauugaagagggaagaacgcugcgcgugcucaagaugguugaaccuuggcugcggggcaaccaguucuguaucaaaauucuuaaucccuauaugccuuccguggucgagacccuggagcaaaugcagagaaagcacggcgggaugcucgugcgcaacccccugagcagaaauucuacacaugaaauguacuggguuuccugcggaaccggcaacaucgugagcgcggucaauaugacaucuagaaugcugcucaaccgcuuuaccauggcccaccggaaaccgacguaugagagagauguggaccuggggaccggaacacgccacguggcugucgaaccugagguugccaaccuugauaucauuggccagagaaucgaaaauauuaagcaugagcacaaauccaccuggcauuacgacgaggauaaccccuauaagacaugggcuuaccacgggagcuaugaagugaagcccucuggauccgccagcuccauggugaauggcgucgugaaacugcucaccaagccuugggacguuauccccauggugacacagauugcuaugaccgagcugcaucuuggccaacagcgggucuucaaagaaaagguggauacgcgcacaccuagagccaaacgggggaccgcgcagaucauggagaugaccgccagauggcuguggggauuucucagccggaacaagaucccgcgcauuuguacaagagaagaguucacgcggaagguucgcucuaaugcugccaucggcgcuguguuugucgacgagaaccaauggaauagcgccaaagaagccguggaggacgaaagauucugggaucugguucaccgggagcgcgaacugcacaagcaggggaaaugcgcgaccugcguguacaacaugaugggaaagagagagaaaaagcucggcgaguuugggaaggcuaaaggcucccgggccauuugguacauguggcugggagcccgcuuccuugaauuugaggcucugggcuucaugaaugaagaccauugguucucuagagagaacagccucuccggggucgagggagaaggccugcacaaacuuggguauauccugcgggauauuucuaaaauccccggaggcaauauguacgccgacgauacagcugggugggacacccgcaucacagaggaugaccuccagaacgaagccaagauuaccgauaucauggagccugaacaugcgcugcuggccaaagcuauuuuuaagcucacauaucagaauaaaguggucagagugcaacggcccgccaagaacggcaccguuauggacgugaucagccgcagagaucagcggggauccggccaggucgggacguacggacugaauaccuucacaaacauggaggcucagcuuauuagacaaauggagucugaagagaucuuuagcccuuccgaacuggagacccccaaccucgccgaacgcgcgcuggacuggcuugagaaguauggcguggagcggcugaaaagaauggccaucagcggggaugacugugugguuaagccgauugacgaucgcuucgcuacagcccucaccgcucugaaugacaugggaaaagugcggaaggauaucccucagugggaacccucuaaaggcuggaacgacuggcagcaggucccuuuuugcucccaccacuuccaucaacugauuaugaaggaugggagagagaucgugguucccugucgcaaucaggacgaacucgugggccgggccagagucagccagggagcuggcuggucucugcgcgagacggccugccuugggaaguccuacgcgcagauguggcaacugauguauuuucaccggagagaucuccgccuggccgcuaacgccauuuguagcgccgugccugucgacugggugcccacaucccggaccacauggucuauccaugcucaccaucaguggaugaccacggaagauaugcuuagcguuuggaauagaguguggauugaggagaacccguggauggaagacaaaacccacaucuccagcugggaggaugucccuuaccugggaaagcgggaagaccaguggugcggcucucucaucgggcugacagccagagcgaccugggcuacaaauauucaaguggccaucaaccagguucgccggcugauuggaaaugagaacuaccucgacuauaugaccuccaugaaaagauucaagaaugagagcgaucccgaaggcgcccugugguga

SEQ ID NO: 19021 - RNA, 9879 nt, Artificial Sequence
  derived and/or modified CDS sequence (opt5) from DENV-1__KF921935__SS-prME
uccgugaccaugcugcucaugcugaugcccaccgcccuugcuuuccaccugacgaccagaggaggggagccucauaugaucguguccaagcaggaacggggaaaaucucuccuguuuaagacaagcgccggcguuaacaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuuccugacacaagaugaaaagggggugacgcagaacggacggcuuaucaccgcgaaucccauugucacagacaaagagaagccugugaacaucgaagcugagccgcccuuuggcgaguccuauauuaucauuggggccggagaaaaagcccucaagcugagcugguucaagaaaggcucuagcaucgggaagauguuugaggcuaccgccagaggcgcucgccggauggccauccugggagauacagcgugggacuucggcuccauugggggaguguuuaccucuguuggcaaacucguccaucagaucuucgggacggccuacggagugcuguuuagcggcguguccuggaccaugaagauugggaucggcguccuucugacauggcucggacugaauagcagaucuaccucccugagcaugacauguauugcugugggccuuguuacccucuaccugggggugaugguccaggccgauucuggaugcgugaucaacuggaaaggccgcgaacugaaguguggguccggaauuuucguuacaaaugaggugcacaccuggacggaacaauauaaguuucaggcugacagcccuaaacggcucuccgccgcgaucggcaaggccugggaggagggggucugcggcaucagaucugcuacacgccuggaaaacauuauguggaaacagaucagcaacgagcuuaaucauauucugcucgaaaacgacaugaaguucaccgugguugugggagaugucgccggcauccuggcucaggggaaagagaugauucggccgcaacccauggaauacaaguauuccuggaaaucuuggggaaaggccaagaucaucggcgccgacgugcagaauaccacauuuauuaucgaugggccuaacacccccgaguguccugacgaucagagagcuuggaauauuugggagguggaagacuacggauucggcaucuuuacgacaaacauuuggcugaaacuucgcgauagccacacccaggucugcgaccaccggcucauguccgcggccaucaaggauagcaaagcuguucaugccgacaugggcuauuggaucgagucugaaaagaaugagacauggaaacuggccagagcuuccuucauugaagugaagaccuguaucuggcccaagagccacacacuguggucuaacggggugcucgaguccgagaugauuaucccgaaaauuuacggaggcccuaucagccaacauaauuaucgccccggguacuucacccagacggccggaccuuggcaccugggcaaacuugaacuggauuuugaccucugcgaggggaccacagucgugguugaugaacacugcggaaaccggggccccucucugagaaccacaaccgugacgggcaaaaucauucaugagugguguugccggagcuguacacugccuccccuucgcuucagaggggaggacggaugcugguacggcauggaaauccggccggucaaggagaaagaagagaaucucgugaaguccaugguuagcgcggggucuggagaaguggacuccuuuagccugggccugcucuguauuuccaucaugauugaggaggucaugagaucucgcuggagccggaagaugcugaugaccgggacacuugcuguguucuuucugcucaucaugggacagcugaccuggaacgaucugauuagacuuugcaucaugguuggcgccaaugccuccgaccgcaugggcauggggaccacauaucuggcucucauggccacguucaaaaugagaccuauguuugcggugggacuccuguuccggcgccugaccucuagagaaguccuucugcucacaaucggccugagccugguggcuuccguggagcuucccaacucucuggaggaacucggggauggacuggccaugggcauuaugauccucaagcugcuuaccgacuuucaaagccaccagcugugggccacacuccugucccugaccuucauuaaaacgacauuuagccuucauuacgcuuggaagaccauggccaugguccugucuaucguuucccucuucccccugugucucagcaccacaucucagaaaaccacauggcugccugugcuucuggggucccugggaugcaagccgcucacgauguuucugauugcugaaaauaagaucuggggccggcgcagcuggccccuuaacgagggcaucauggccguggggauugucucuauccugcucuccagccugcucaaaaacgaugugccucuggcgggaccccuuauugccggcgggaugcugaucgcuuguuauguuauuuccggaagcucugccgaccugagccucgagaaggcugccgaaguguccugggaggaagaggccgaacacucuggcgcuagccauaauauccuggucgaggugcaggaugacgggaccaugaaaaucaaggaugaggaaagagacgauacacuuaccauucugcucaaagcgacacugcucgccguuuccggaguguacccucugucuauccccgcuacccuuuucgucugguauuucuggcaaaagaaaaagcagcggagcggcgugcugugggacacgccuagcccucccgaggucgaacgcgccgugcuggaugacggcauuuacagaaucaugcagcgggggcuccugggacgcucucagguuggcgugggggucuuucaagagaacguguuccacaccauguggcacguuacaagaggagccgugcuuauguaucagggcaagcggcuggagcccagcugggcuuccgucaaaaaggaccucauuagcuacgggggaggcuggagacugcagggcucuuggaauaccggggaagagguccaggugaucgccguugaacccggcaagaauccuaagaauguccaaacagcgcccggcaccuuuaaaacaccggagggggaagugggagcuauugcccucgauuucaagccuggcacguccgggagccccaucgugaaccgcgagggaaagaucgucggccuguacggcaauggggugguuaccacaucuggaaccuauguguccgccauugcucaggccaaagcgagccaggagggcccucuucccgaaaucgaggacgaagucuuucggaagagaaaccugaccauuauggaucugcaucccggguccggaaaaacacgccgguaccucccugcuaucgugagagaggccauuaagcgcaaacugcggacgcuuauccuggccccgaccagaguuguggcuucugaaauggccgaggcucucaagggcaugcccauccgcuaucaaacaaccgccgucaagagcgagcacacagggaaagaaauuguggaccugaugugccaugcgaccuucacgaugcggcugcucuccccuguuagagugcccaauuacaacaugaucauuauggaugaggcccacuuuacagacccuagcucuaucgcugcccggggcuauauuuccacccgcgucggaaugggcgaagcugccgccaucuucaugaccgcuacacccccugggagcguggaggcguuuccgcagucuaaugccgugauccaggaugaagagagagacauucccgagcggagcuggaacuccggauacgaauggaucaccgauuucccuggcaagacagucugguuuguucccucuauuaaaagcgggaaugacaucgcuaacugucuucgcaagaauggaaaaagagugauucagcugucccggaagaccuucgauacggaguaucaaaagaccaagaacaacgacugggacuacguggucaccacagauaucucugaaaugggcgccaauuucagagccgaccgcgugauugauccucggagaugccugaagcccguuauccucaaagacgggccggagcgcgugauccuggcuggcccuaugcccgucaccguggccagcgcggcucagcggagaggacgcauuggccggaaccauaauaaggagggggaucaguacaucuauaugggacagccccuuaacaaugacgaagaucacgcccacuggacggaggccaaaaugcugcucgacaacauuaauaccccugaaggcaucauucccgcucuguuugagccugaaagagagaaguccgccgcgaucgauggggaguaccgccugagaggagaagcccggaagacauucguugagcucaugcgcagaggcgaccuuccgguguggcugagcuauaaagucgcuucugaaggguuucaauacuccgaucggcgcuggugcuucgacggcgagagaaacaaucaggugcuggaagagaacauggaugucgagaucuggaccaaggaaggagagcggaaaaagcucagaccccgcuggcuggacgcccggacauauagcgacccucuugcucugagagaauuuaaagaguucgccgcuggccgccgguccgugucuggggaucucauucuggaaaucggaaagcugccccagcaucucacccagagagcccaaaaugcgcuugacaaccugguuaugcugcacaauagcgagcagggcgggcgggccuaccgccaugcuauggaggaacucccugauacaauugagacccugaugcuucuggcccucaucgcugugcugacgggaggcgugacacuguuuuuccucuccggcagagggcuuggaaaaaccucuauuggccugcugugugucauggccagcuccguucuccuguggauggccagcguggaaccccacuggaucgcugcgucuaucauucuugaguuuuuccugauggugcuccugaucccggagccugaccggcagcgcacaccccaggauaaccaacuggccuaugucgugauugggcuccuuuuuaugauccugacaguugcugccaaugaaaugggacugcucgagaccacaaagaaggaccugggcauugggcacguggccgucgaaaaccaucaccaugcugccaugcuugauguggaccugcacccugcguccgccuggacgcucuacgcugucgccaccacaaucauuacccccaugaugagacauacaaucgagaacaccacggcuaauaucagccugaccgccauugcgaaccaggccgcuauccugaugggacucgauaaaggcuggccuauuucuaagauggacaucggcgugccccuucuggcccuggggugcuacucccagguuaauccgcucacacugaccgcugccgugcuuaugcuggucgcucacuaugccauuaucggaccuggccuccaagcgaaagccacacgggaagcucagaagcgcaccgccgcugggaucaugaaaaaccccacgguggauggaauuguugccaucgaccuggaucccguggucuacgacgccaaguucgagaagcagcugggccagauuaugcuccuuauccuguguacaagccaaauucugcucaugagaaccacaugggcgcugugcgagucuaucacccuugcuaccgggccucugacaacgcucugggaaggaagcccgggcaaauuuuggaauaccacaaucgccguguccauggcuaacauuuuccggggcucuuaucuggccggggccggacuggcuuucagccucaugaagucccuuggcgggggacgcagaggcaccggggcccagggagagacacugggcgaaaaauggaagcggcagcugaaucagcucagcaaauccgaguuuaacaccuacaagagaucuggcaucauggaaguggaccgcagcgaggcgaaggaggggcugaaacggggagaaacgacaaagcacgccguuuccagaggcaccgcuaaacuucgcugguucgucgagcggaaucuggugaagcccgaagggaaagugauugaucucggauguggcagagggggauggucuuauuacugcgccggccugaagaaggucaccgagguuaaaggcuauacaaaagggggaccuggccaugaggaacccaucccuauggcuaccuacggguggaaccuggugaaacuccacagcggaaaggacguguuuuucauucccccugagaaaugugauacacuucugugcgacaucggcgaauccucuccgaaucccacgauugaggaagggcgcacccugcggguccucaagaugguggagccuuggcugagaggaaaccaauuuuguaucaaaauccuuaaucccuacaugccuagcguuguggagacacuggaacagaugcagcgcaagcauggcggcaugcucguccggaacccccuguccagaaauagcacccacgagauguauugggugucuugcgggacaggaaacauuguuuccgccgugaauaugaccagccgcaugcugcucaaccgguucacgauggcgcacagaaagccgaccuacgaacgcgaugucgaccugggcgccgggacaagacauguggcuguggagccugaaaucgccaaccuugauauuaucggacagcggauugagaauaucaaacacgagcauaagucuaccuggcacuaugacgaagauaaccccuacaaaacaugggcuuaucauggcuccuacgaggucaagcccagcgggucugccuccagcaugguuaauggaguggugaaacugcucaccaagccuugggacgucauccccauggugacacaaauugcuaugaccgauacgacaccuuuuggccagcagcgcguuuucaaggaaaaaguggacaccagaaccccgaaggccaaacggggcacagcgcaaaucauggaggucacggccaaguggcuguggggguuucuuuccagaaacaaaaagccccggauuuguacccgcgaagaguucacaagaaaggugcggagcaaugcugccaucggagcuguuuuuguggacgagaaccaguggaacucugccaaagaagccgucgaggaugaacgcuucugggaccuggugcacagagagcgggaacuccacaagcagggcaaaugcgcgaccugcguuuauaacaugauggggaagcgcgagaaaaagcugggagaguuuggcaaggcuaaagggagcagagccauuugguacauguggcugggcgcccgguuccucgaguucgaggcucugggauuuaugaaugaagaucauugguucucccgcgagaacucucuuagcggcguggagggggaaggacugcacaagcucggcuacauccugagagacaucuccaaaauuccugggggaaauauguaugccgaugacacagcuggcugggauacccggaucacagaggacgaucuucagaacgaagcccgcauuaccgacaucauggagcccgaacaugcgcugcucgccaagucuauuuuuaaacugacguaccaaaauaaggucgugagaguccagcggccugcuaaaaacgggaccgugauggauguuaucagccgcagagaccagcggggcuccggacaggugggcacauaugggcugaauaccuucacaaacauggaggcccaacucaucagacagauggagucugaaggaauuuuuagccccuccgagcuggaaaccccgaaccuugcugagcgcguccuggauuggcucgaaaaguacggcguggagcggcugaagagaauggccaucagcggggacgacugugugguuaaaccuauugaugaccgcuucgcgacggcccuuacagcucugaaugauaugggaaaggugcggaaagacaucccccagugggagccuucuaagggcuggaacgauuggcagcaaguccccuuuugcucccaccacuuccaucagcucauuaugaaagacgggagagaaaucgugguuccuugucgcaaucaggaugagcuggugggccgggccagagucagccagggagcuggcuggucucugcgcgaaaccgccugccucgggaaguccuaugcucaaauguggcagcugauguacuuucaccggagagaccuucgccuggccgcgaacgccauuuguagcgcugugcccgucgauuggaucccgacaucccggaccacguggucuauccaugcccaccaucaguggaugaccacagaggacaugcucagcguguggaauagaguuuggauugaagagaacccuuggauggaggauaagacccacaucuccagcuggggagacgugcccuaucugggcaaacgggaagaccaauggugcgggucucuuauuggacugacagccagagcuaccugggccacaaauauccaggucgcgauuaaccaggugcgccggcucaucggcaaugagaacuaccuggauuacaugaccuccaugaagagauucaaaaaugaaggggaccccgagggcgcucugugguga

SEQ ID NO: 19022 - RNA, 9879 nt, Artificial Sequence
  derived and/or modified CDS sequence (opt5) from DENV-1__GQ199776__SS-prME
agcgugaccaugcugcucaugcugaugcccaccgcccuugcuuuccaccugacgaccagaggaggggaaccucauaugaucgucuccaagcaggaacggggaaaaucucuccuguuuaagaccagcgccggcguuaacaugugcacccuuaucgcgauggaccugggggaacucugugaagauaccaugaccuacaaaugccccagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccaggccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucagaggggaggacggaugcugguauggcauggagauucggccggugaaagaaaaggaggaaaaucuuguuaagagcauggugucugcuggguccggagaggucgacagcuuuucccucggccugcuguguaucucuauuaugaucgaagaggugaugagaagccgcuggucccggagaaugcucaugacagggacccuggccguuuucuuucuucugauuaugggacagcucacauggaacgaucugauccgccugugcauuauggugggcgccaaugcuucugacagaaugggcauggggaccaccuaccuugcccugauggcgacauucaaaaugcggccuauguuugcugucggacuccuguuccgcagacucacgagccgggaggugcugcuucugaccaucggccucucccugguggccucugucgaacugcccaacagccuugaggaacugggggauggacucgccaugggcaucaugauucugaagcuccugacagacuuucaaucccaucagcuuugggcuacccugcucagccugacauucaucaaaaccacgcugucucuucacuaugccuggaagacaauggcuaugguucuguccauugugagccucuuuccccugugucucucuaccaccucccagaaaacaaccuggcugccugugcuucuggggagccugggaugcaagccgcucacaauguuccugaucgccgagaauaagauuuggggccgcagaucuuggccccuuaacgaaggcaucauggcggucgggaucguguccauucugcucagcucccugcucaaaaacgauguuccucuggccggaccccuuaucgcuggcgggaugcugauugccuguuacgugaucagcggaucuagcgcugaccugucccucgagaaggccgccgaggucucuugggaagaggaagcugagcauagcggcgcgucccacaauauucugguggaaguucaggaugacgggacgaugaaaaucaaggaugaggagcgggacgauacccuuacaauccugcucaaagccacccugcucgcugugucuggagucuauccucugagcauucccgccacacuuuuugugugguacuucuggcaaaagaaaaagcagcgcuccggcguccugugggacaccccuucucccccggaaguggagagagccguucuggaugacggcaucuaucggauuaugcagcgcgggcuccugggaagaagccaggugggcgucgggguguuccaagaaaacguuuuucauacgauguggcacgugacccggggagcuguccuuauguaccagggcaagagacuggagccuuccugggccagcgugaaaaaggaccucaucucuuacgggggaggcuggcgccugcagggcuccuggaauacaggggaggaagugcagguuauugcggucgagcccggcaagaacccuaagaaugugcaaaccgcucccggcacauucaaaaccccggaaggggaggugggagccaucgcccucgauuuuaagccuggcacaagcgggucucccauugucaaccgggaaggaaagaucgugggccuguauggcaaugggguugugacgaccuccggaacauacgucagcgcuaucgcccaggcgaaggcuucccaggagggcccucuucccgagauugaagacgagguguucagaaagcgcaaccugaccaucauggaucugcaccccgggucuggaaaaacccggagauaucucccugccauuguucgcgaagccaucaagcggaaacugagaacacuuauucuggcuccgacgcgcguggucgccagcgagauggcugaagcccucaagggcaugcccauccgguaccaaaccacagcggugaaguccgagcauaccgggaaagagaucguugaccugaugugccacgccacauuuaccaugagacugcucagcccugugcggguccccaauuauaacaugauuaucauggaugaagcucauuucacggacccuucuuccauugccgcucgcggcuacaucagcacaagagugggaaugggcgaggccgccgcuauuuuuaugaccgcgacacccccugggucuguggaagccuucccgcagagcaaugcugucauccaggaugaggaacgggacauccccgagcgcuccuggaacucuggauaugaguggauuacagauuuuccuggcaagaccguuugguucgugcccagcaucaaauccgggaaugacauugccaacugucuuagaaagaauggaaaacgggugauccagcugucuagaaagacauuugauaccgaauaccaaaagacgaaaaacaacgacugggacuacgucgugacaaccgauauuagcgagaugggcgccaauuuccgcgcugaccggguuaucgauccuagacgcugccugaagcccgugauucucaaagacgggccggaacgggucauccuggccggcccuaugcccgugacaguugcguccgcugcccagagacgcggacggaucggcagaaaccacaauaaggagggggaucaguauauuuacaugggacagccccuuaacaaugacgaggaucaugcccacuggaccgaagcuaaaaugcugcucgacaacaucaauacgccugagggcauuauccccgcccuguucgaaccugagcgcgaaaagagcgcggccauugauggggaguauagacugcggggagaggcucgcaagaccuuuguggaacucaugagacggggcgaccuuccggucuggcugucuuacaaaguggccuccgagggguuccaauauagcgaucgcagauggugcuuugacggcgaacggaacaaucagguccuggaggaaaacauggauguggagaucuggacaaaggagggagaacgcaagaaacuccgcccccgguggcuggacgcuagaaccuacuccgacccucuugcccugcgcgaguucaaagaauuugcugccggccggagaucuguuagcggggaucucauccuggagauuggaaagcugccccagcaccucacacagcgggcgcaaaaugcccuugacaaccuggugaugcugcauaauuccgaacagggcgggcgcgcuuauagacacgccauggaggagcucccugauaccaucgaaacacugaugcuucuggcucucauugccgugcugaccggaggcgucacgcuguucuuucucucuggccgggggcuuggaaaaacaagcaucggccugcuguguguuauggccuccagcgugcuccuguggauggcuucuguggagccccauuggauugcggccuccaucauccuugaguucuuucugaugguccuccugauuccggagccugaccgccagagaacaccccaggauaaccaacuggcuuacgugguuaucgggcuccuuuucaugauucugaccguggccgccaaugagaugggacugcucgaaacaaccaagaaggaccugggcaucgggcacgucgcuguggagaaccaccaucacgccgcgaugcuugaugucgaccugcauccugccagcgcuuggacacucuacgccguggcuacgaccauuaucacacccaugaugcggcacaccauugaaaacacaaccgccaauaucucucugacggcgaucgccaaccaggcugccauucugaugggacucgauaaaggcuggccuaucuccaagauggacauuggcguuccccuucuggcucuggggugcuauagccaggugaauccgcucacccugacagccgcuguccuuaugcugguggcccauuacgcgaucauuggaccuggccuccaagccaaagcuacccgcgaggcccagaagagaacagcugccgggaucaugaaaaaccccaccguugauggaaucguggccauugaccuggaucccgucguguaugacgcgaaguuugaaaagcagcugggccagaucaugcuccuuauucuguguacgucucaaauccugcucaugcggacaaccugggcucugugcgagagcauuacacuugccaccgggccucugaccacacucugggagggauccccgggcaaauucuggaauacgaccaucgcugugucuauggccaacaucuuucgcggcagcuaccuggccggggcuggacuggccuucucccucaugaaaagccuuggcgggggaagacggggcacaggggcgcagggagaaacccugggcgagaaauggaagagacagcugaaucagcucuccaaaucugaguucaacacauauaagcgcagcggcauuauggagguugaccgguccgaagccaaggaggggcugaaaagaggagagaccacgaagcacgcugucucucgcggcacagccaaacuucggugguuuguggaaagaaaucuggugaagcccgaggggaaagucaucgaucucggauguggccgcgggggauggagcuacuauugcgcuggccugaagaagguuaccgaagugaaaggcuacaccaaaggcgggccugggcacgaggaacccauuccuauggccacauacggguggaaccuggugaaacuccauuccggaaaggacgucuucuuuauucccccugagaaaugugauacccuucugugcgacauuggcgagucuagcccgaaucccacaaucgaagaggggcggacgcugagagugcucaagaugguugaaccuuggcugcgcggaaaccaauucuguauuaaaauccuuaaucccuauaugccuuccguggucgagacccuggagcagaugcagcggaagcacggcggcaugcucgugagaaacccccugagccgcaauucuacacaugaaauguacuggguuuccugcgggaccggaaacaucgugagcgcggucaauaugacaucucggaugcugcucaacagauuuaccauggcccaccgcaagccgacguaugagagagauguggaccugggcgcugggacccggcacguggucguugaaccugagguggccaaccuugauauuaucggacagcgcauugaaaauaucaaacaugagcacaaguccacauggcauuacgacgaggauaaccccuauaaaaccugggcuuaccacggcagcuaugaagugaagcccucuggguccgccagcuccauggucaauggagugguuaaacugcucacaaagccuugggacgugauucccauggucacccaaaucgcuaugacagauaccacgccuuucggccagcagagaguguuuaaggagaaaguugacacacggaccccgaaggccaaaagaggcaccgcgcaaaucauggaagugacagccaaguggcuguggggguuccuuagccggaacaaaaagccccgcauuuguacgagagaggaauuuacccggaagguccgcucuaaugcugccaucggagcuguguucguugacgagaaccaguggaauagcgccaaagaggccguggaagaugagagauuuugggaccugguccaucgggaacgcgagcuccacaagcagggcaaaugcgcgacaugcguguacaacaugauggggaagagagagaaaaagcugggagaguucggcaaggcuaaagggucccgggccauuugguacauguggcugggcgcccgcuuucucgaguucgaagcucugggauucaugaaugaggaucacugguuuucuagagaaaacagccuuuccggcgucgagggggagggacugcauaagcucggcuauauccugcgggacauuucuaaaaucccugggggaaauauguacgccgaugacaccgcuggcugggauacacgcaucaccgaagacgaucuucagaacgaggccagaauuacagacaucauggaacccgagcacgcgcugcucgccaagagcauuuucaaacugaccuaucaaaauaaggugguucgggugcagcgcccugcuaaaaacgggacggucauggaugugaucuccagacgggaccagagaggcucuggacaggugggcaccuacgggcugaauacauuuaccaacauggaagcccaacucauucgccagauggagagcgagggaaucuucucccccagcgaacuggagacaccgaaccuugcugaacggguucuggauuggcucgagaaguauggcguggaaagacugaagcgcauggccaucucuggggacgacugugucgugaaaccuauugaugaccgguuugcgaccgcccuuacggcucugaaugauaugggaaagguuagaaaagacaucccccagugggagccuuccaagggcuggaacgauuggcagcaagugcccuucugcagccaucacuuucaccagcucauuaugaaagacgggcgcgagaucgucgugccuugucggaaucaggaugaacuggucggcagagcccgcgugucucagggagcuggcuggucccugcgggagacagccugccucggaaagagcuacgcucaaauguggcagcugauguauuuccauagacgcgaccuucggcuggccgcgaacgccauuuguuccgcuguucccguggauuggaucccgaccucuagaacaaccuggagcauucacgcccaucaccaguggaugacgaccgaagacaugcucuccgucuggaaucggguguggaucgaggaaaacccuuggauggaggauaagacacauaucagcucuuggggagacguucccuaccugggcaaaagagaggaccaauggugcgggucccuuauuggacugaccgcccgcgcuacaugggccaccaauauccagguggcgauuaaccagguccggagacucaucggcaaugaaaacuaccuggauuauaugacaagcaugaagcgcuuuaaaaaugagucugaccccgaaggggcucugugguga

SEQ ID NO: 19023 - RNA, 9879 nt, Artificial Sequence
  derived and/or modified CDS sequence (opt5) from DENV-1__GQ199777__SS-prME
agcgugaccaugcugcucaugcugaugcccaccgcccuugcuuuccaccugacgaccagaggcggggaaccucauaugaucgucuccaagcaggaacggggaaaaucucuccuguuuaagaccagcgccggcguuaauaugugcacccuuauugcgauggaccugggggaacucugugaagauacaaugaccuacaaaugcccgagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugucauugggaccucuaucacccagaagggaaucauuuucauccuccugaugcuugugacaccuagcauggcgaugagaugcguuggcauugggucccgggauuuuguggagggacugagcggcgccacgugggucgacguggugcucgagcacgggucuugugucaccacaauggcuaaggauaaacccacccuggacaucgaacugcucaagacagagguuaccaacccugccgugcugcgcaaacuuugcauugaagcuaagaucuccaauacgacaaccgauagcagauguccgacccaaggagaggccacacugguggaagaacaggacgcgaacuucgucugccggcgcaccuuuguggauagaggcuggggcaauggguguggacucuucggcaaagggucucugauuacaugcgccaaguuuaagugcguuacgaaacuugagggaaagaucgugcaguacgaaaaccugaaauauuccgucaucgugaccguucacacaggcgaccagcaucaaguggggaaugagagcaccgaacacggaacaaccgcuacgauuacaccccaagccccuaccaccgagauccagcucacagacuacggcgcucugacccuggauuguucuccccggacgggccucgacuucaacgaaaugguccugcuuacaaugaaggagaaauccuggcuggugcauaagcagugguuucucgaucugccucuucccuggaccagcggggccuccacaucucaagagaccuggaaucgccaggaccugcucgucaccuucaaaacagcccacgcuaagaagcaggaagugguugugcugggaagccaagagggcgcgaugcacacggcccugaccggggcuacagaaauucagaccuccggaacaaccacgaucuuugccggccaucucaaaugcagacugaagauggauaaacuuacacugaaggggaugagcuaugucauguguaccggccucuucaaacuggagaaggaaguggccgagacccagcacggaacaguucuggugcagauuaaguacgagggcaccgacgcuccgugcaaaaucccuuucucuacacaagaugaaaagggggucacgcagaacggacggcuuaucaccgccaaucccauugugacagacaaagagaagccugugaacaucgaagcggagccgcccuuuggcgaguccuauauuaucauuggggcuggagaaaaagcccucaagcugagcugguucaagaaaggcucuagcaucgggaagauguuugaggccaccgcuagaggcgcccgccggauggcuauccugggagauacagccugggacuucggcuccauugggggaguuuuuaccucugucggcaaacucgugcaucagaucuucgggacggcguacggagugcuguuuagcggcgucuccuggaccaugaagauugggaucggcgugcuucugacauggcucggacugaauagcagaucuaccucccugagcaugacauguauugccguuggccuugugacccucuaccugggggucauggugcaggcugauucuggaugcguuaucaacuggaaaggccgcgaacugaaguguggguccggaauuuucgugacaaaugagguccacaccuggacggaacaauauaaguuucaggccgacagcccuaaacggcucuccgcugccaucggcaaggcgugggaggagggggugugcggcaucagaucugccacacgccuggaaaacauuauguggaaacagaucagcaacgagcuuaaucauauucugcucgaaaacgacaugaaguucaccguuguggucggagauguggcuggcauccuggcccaggggaaaaagaugauucggccgcaacccauggaguacaaauauuccuggaagucuuggggaaaggcuaaaaucaucggcgccgacgugcagaauaccacauuuauuaucgaugggccuaacacccccgaauguccugacgaucagagagccuggaauauuugggaggucgaggacuacggauucggcaucuuuacgacaaacauuuggcugaaacuucgcgauagcuauacccagguuugcgaccaccggcucauguccgcugcgaucaaagauagcaaggccgugcacgcugacaugggcuacuggaucgaaucugagaaaaaugaaacauggaagcuggccagagccuccuucauugaggugaagaccuguaucuggcccaaaagccauacacuguggucuaacgggguccucgaauccgagaugauuaucccgaagauuuauggaggcccuaucagccaacacaauuaccgccccggguacuucacccagacggcuggaccuuggcaucugggcaaacuugagcuggauuuugaccucugcgaagggaccacagugguuguggaugagcacugcggaaaccggggccccucucugagaaccacaaccgucacgggcaagaucauucacgaaugguguugccggagcuguacacugccuccccuucgcuucagaggggaggacggaugcugguauggcauggagauccggccggugaaagaaaaggaggaaaaucucguuaaguccauggugagcgccgggucuggagaggucgacuccuuuagccugggccugcucuguauuuccaucaugauugaagaggugaugagaucucgcuggagccggaaaaugcugaugaccgggacacuugcgguuuucuuucugcucaucaugggacagcugaccuggaacgaucugauuagacuuugcaucauggugggcgcuaaugccuccgaccgcaugggcauggggaccacauaccuggcccucauggcuacguucaagaugagaccuauguuugccgucggacuccuguuccggcgccugaccucuagagaggugcuucugcucacaaucggccugagccugguggcguccgucgaacuucccaacucucuggaggaacucggggauggacuggcuaugggcauuaugauccucaaacugcuugccgacuuucaaagccaucagcugugggccacccuccugucccugacauucauuaagaccacguuuagccuucacuaugcuuggaaaacaauggccaugguucugucuaucgugucccucuucccccugugucucagcaccaccucucagaagacaaccuggcugccugugcuucuggggucccugggaugcaagccgcucacaauguuucugauugcugagaauaaaaucuggggccggcgcagcuggccccuuaacgaaggcaucauggccgucgggauugugucuauccugcucuccagccugcucaagaacgauguuccucuggcgggaccccuuauugccggcgggaugcugaucgcuuguuacgugauuuccggaagcucugccgaccugagccucgagaaagcugccgaggucuccugggaagaggaagccgagcauucuggcgcuagccacaauauccugguggaaguucaggaugacgggacgaugaagaucaaagaugaggagagagacgauacccuuacaauucugcucaaggcgacccugcucgccguguccggagucuauccucugucuauccccgcuacacuuuucgugugguacuucuggcagaagaagaagcagcggagcggcguccugugggacaccccuagcccucccgaaguggagcgcgccguucuggaugacggcauuuauagaaucaugcagcgggggcuccugggacgcucucaggugggcgucgggguguuucaagaaaacguuuuccauacgauguggcacgugaccagaggagccguccuuauguaccagggcaaacggcuggagcccagcugggcuuccgugaagaaagaccucauuagcuacgggggaggcuggagacugcagggcucuuggaauacaggggaggaagugcagguuaucgccgucgagcccggaaagaacccuaaaaaugugcaaaccgcgcccggcacauuuaagaccccggaaggggaggugggagcuauugcccucgauuucaagccuggcacauccgggagccccaucgucaaccgcgaaggaaaaaucgugggccuguauggcaaugggguugugacgaccucuggaacauacgucuccgccauugcucaggccaaggcgagccaggagggcccucuucccgagaucgaagacgagguguuucggaaaagaaaccugaccauuauggaucugcaccccggguccggaaagacccgccgguaucucccugcuaucguuagagaagccauuaaacgccggcugagaacacuuauccuggccccgacgcgcguggucgcuucugagauggccgaagcucucaagggcaugcccauccgguaccaaaccacagccgugaaguccgagcauaccgggaaagagauuguugaccugaugugccacgcgacauucaccaugagacugcucuccccugugcggguccccaauuauaacaugaucauuauggaugaagcccauuuuacggacccuagcucuaucgcugcccgcggcuacauuuccacaagagugggaaugggcgaggcugccgccaucuucaugaccgcuacacccccugggagcguggaagcguuuccgcagucuaaugccgucauccaggaugaggaacgggacauucccgagcgcagcuggaacuccggauaugaguggaucacagauuucccuggcaagaccguuugguuugugcccucuauuaaaagcgggaaugacaucgcuaacugucuuagaaagaauggaaaacgggugauucagcuguccagaaagacauucgauaccgaauaccaaaagacgaaaaacaacgacugggacuacgucgugacaaccgauaucucugagaugggcgccaauuuccgcgccgaccggguuauugauccuagacgcugccugaagcccgugauccucaaagacgggccggaacgggucauccuggcuggcccuaugcccgugacaguugccagcgcggcucagagacgcggacggauuggcagaaaccacaauaaggagggggaucaguauaucuacaugggacagccccuuaacaaugacgaggaucaugcccacuggaccgaagccaaaaugcugcucgacaacauuaauacgccugagggcaucauucccgcucuguuugaaccugagcgcgaaaaguccgccgcgaucgauggggaguauagacugcggggagaggcccgcaagaccuucguggaacucaugagacggggcgaccuuccggucuggcugagcuacaaaguggcuucugagggguuucaauauuccgaucgcagauggugcuucgacggcgaacggaacaaucagguccuggaggaaaacauggauguggagaucuggacaaaggagggagaacgcaagaagcuccgcccccgguggcuggacgccagaaccuacagcgacccucuugcucugcgcgaguuuaaagaguucgccgcuggccggagauccguuucuggggaucucauucuggagaucggaaagcugccccagcaccucacacagcgggcccaaaaugcgcuugacaaccuggugaugcugcauaauagcgaacagggcgggcgcgccuauagacacgcuauggaggagcucccugauaccauugaaacacugaugcuucuggcccucaucgcugugcugaccggaggcgucacgcuguuuuuccucuccggccgggggcuuggaaaaacaucuauuggccugcuguguguuauggccagcuccgugcuccuguggauggccagcguggagccccauuggaucgcugcgucuaucauucuugaauuuuuccugaugguccuccugaucccggagccugaccgccagagaacaccccaggauaaccaacuggccuacgugguuauugggcuccuuuuuaugauccugaccguggcugccaaugagaugggacugcucgaaacaaccaagaaggaccugggcauugggcacgucgccguggagaaccaccaucacgcugccaugcuugaugucgaccugcauccugcguccgccuggacacucuacgcuguggccacgaccaucauuacacccaugaugcggcacaccaucgaaaacacaaccgcuaauaucagccugacggccauugcgaaccaggccgcuauccugaugggacucgauaaaggcuggccuauuucuaagauggacaucggcguuccccuucuggcccuggggugcuauucccaggugaauccgcucacccugacagcugccguccuuaugcugguggcucauuacgccauuaucggaccuggccuccaagcgaaagccacccgcgaggcucagaagagaacagccgcugggaucaugaaaaaccccaccguugauggaauuguggccaucgaccuggaucccgucguguaugacgccaaguucgaaaagcagcugggccagauuaugcuccuuauccuguguacgagccaaauucugcucaugcggacaaccugggcgcugugcgagucuaucacacuugcuaccgggccucugaccacacucugggagggaagcccgggcaaauuuuggaauacgaccaucgccguguccauggcuaacauuuuccgcggcucuuaccuggccggggccggacuggcuuucagccucaugaagucccuuggcgggggaagacggggcacaggggcccagggagaaacccugggcgagaaauggaagagacagcugaaucagcucagcaaauccgaauuuaacacauauaagcgcucuggcaucauggagguugaccggagcgaagcgaaggaggggcugaaaagaggagagaccacgaagcacgccgucucccgcggcacagcuaaacuucggugguucguggaaagaaaucuggugaagcccgaggggaaagucauugaucucggauguggccgcgggggauggucuuacuauugcgccggccugaagaagguuaccgaagugaaaggcuacaccaaagggggaccuggccacgaggaacccaucccuauggcuacauacggguggaaccuggugaaacuccauagcggaaaggacgucuuuuucauucccccugagaaaugugauacccuucugugcgacaucggcgaguccucuccgaaucccacaauugaagaggggcggacgcugagagugcucaagaugguugaaccuuggcugcgcggaaaccaauuuuguaucaaaauccuuaaucccuauaugccuagcguggucgagacccuggagcagaugcagcggaagcacggcggcaugcucgugagaaacccccugucccgcaauagcacacaugaaauguacuggguuucuugcgggaccggaaacauuguguccgccgucaauaugacaagccggaugcugcucaacagauucaccauggcgcaccgcaagccgacguaugagagagauguggaccugggcgccgggacccggcacguggcugucgaaccugagguugccaaccuugauaucauuggacagcgcaucgaaaauauuaaacaugagcacaagucuacauggcauuacgacgaggauaaccccuauaaaaccugggcuuaccacggcuccuaugaagugaagcccagcgggucugccuccagcauggugaauggagucgugaaacugcucacaaagccuugggacguuauccccauggugacccaaaucgcuaugacagauaccacgccuuuuggccagcagagagucuucaaggagaaaguggacacacggaccccgaaggccaaaagaggcaccgcgcaaauuauggaaguuacagccaaguggcuguggggguuucuuucccggaacaaaaagccccgcaucuguacgagagaggaguucacccggaaggugcgcagcaaugcugccauuggagcugucuuuguggacgagaaccaguggaacucugccaaagaggccguugaagaugagagauucugggaccuggugcaucgggaacgcgagcuccacaagcagggcaaaugcgcgacaugcgucuacaacaugauggggaagagagagaaaaagcugggagaguuuggcaaggcuaaagggagccgggccaucugguacauguggcugggcgcccgcuuccucgaguucgaagcucugggauuuaugaaugaggaucacugguucuccagagaaaacucucuuagcggcguggagggggagggacugcauaagcucggcuauauucugcgggacaucuccaaaaucccugggggaaauauguacgccgaugacaccgcuggcugggauacacgcauuaccgaagacgaucuucagaacgaggccagaaucacagacauuauggaacccgagcacgcgcugcucgccaagucuaucuuuaaacugaccuaucaaaauaaggucgugcggguucagcgcccugcuaaaaacgggacggugauggaugucauuagcagacgggaccagagaggcuccggacaggugggcaccuacgggcugaauacauucaccaacauggaagcccaacucauccgccagauggagucugagggaaucuuuagccccuccgaacuggagacaccgaaccuugcugaacgggugcuggauuggcucgagaaguauggcguugaaagacugaagcgcauggccauuagcggggacgacuguguggucaaaccuaucgaugaccgguucgcgaccgcccuuacggcucugaaugauaugggaaaggugagaaaagacauuccccagugggagccuucuaagggcuggaacgauuggcagcaaguucccuuuugcucccaucacuuccaccagcucaucaugaaagacgggcgcgagauuguggucccuugucggaaucaggaugaacuggugggcagagcccgcgucagccagggagcuggcuggucucugcgggagacagccugccucgggaaguccuacgcucaaauguggcagcugauguauuuucauagacgcgaccuucggcuggccgcgaacgccaucuguagcgcugugcccguugauuggauuccgaccuccagaacaaccuggucuauccacgcccaucaccaguggaugacgaccgaagacaugcucagcguguggaaucgggucuggaucgaggaaaacccuuggauggaggauaagacacauauuuccagcuggggagacgugcccuaccugggcaaaagagaggaccaauggugcgggucucuuaucggacugaccgcccgcgcuacaugggccaccaauauucagguugcgaucaaccaggugcggagacucauuggcaaugaaaacuaccuggauuauaugacauccaugaagcgcuucaaaaaugagagcgaccccgaaggggcucugugguga

SEQ ID NO: 19024 - RNA, 9879 nt, Artificial Sequence
  derived and/or modified CDS sequence (opt5) from DENV-1__GQ199778__SS-prME
agcgugaccaugcugcucaugcugaugcccaccgcccuugcuuuccaccugacgaccagaggaggggaaccucauaugaucguguccaagcaggaacggggaaaaucucuccuguuuaagacaagcgccggcguuaacaugugcacccuuauugcgauggaccugggggaacucugugaagauaccaugaccuacaaaugcccccgcaucacagaaaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagaggcuuggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaaguucacaguuguggucggagauguggcuggcauucucgcccaggggaaaaagaugauccggccgcaacccauggaguacaaauauucuuggaaaagcuggggaaaggccaagauuaucggcgcugacgugcagaauaccaccuuuaucauugaugggccuaacacacccgaauguccugacgaucagagagcguggaauaucugggaggucgaggacuacggauucggcauuuuuaccacgaacaucuggcugaagcugcgcgauuccuauacacagguuugcgaccaccggcuuaugagcgccgcuauuaaagauucuaaggccgugcacgccgacaugggcuacuggaucgaauccgagaaaaaugaaaccuggaagcucgcuagagccagcuucaucgaggugaagacauguauuuggcccaaaucucauacccugugguccaacgggguccuggaaagcgagaugaucauuccgaagaucuauggaggcccuauuucucaacacaauuaccgccccggguacuucacacaggcggcuggaccuuggcaucucggcaaacuggagcuugauuuugaccugugcgaagggaccacggugguuguggaugagcacugcggaaaccggggccccagccucagaaccacaaccgucacaggcaagaucauccacgaaugguguugccgguccuguacccugccuccccugcgcuucagaggggaggacggaugcugguauggcauggagauucggccgaucaaagaaaaggaggaaaaucuugucaagagcaugguuucugccggguccggagagguggacagcuuuucccucggccugcuguguauuucuaucaugauugaagaggucaugagaagccgcuggucccggagaaugcucaugacggggacacuggccguguucuuucuucugaucaugggacagcucaccuggaacgaucugauucgccugugcaucaugguuggcgcuaaugccucugacagaaugggcauggggacaaccuaccuugcgcugauggcuaccuucaaaaugcggccuauguuugccgugggacuccuguuccgcagacucacaagccgggagguccugcuucugacgaucggccucucccugguggccucuguggaacugcccaacagccuugaggaacugggggauggacucgcuaugggcauuaugauccugaagcuccugaccgacuuucaaucccaucagcuuugggccacacugcucagccugaccuucauuaaaacaaccuuuucucugcacuaugcuuggaagacgauggccaugguccuuuccaucguuagccuguucccccucugucugucuacaaccucccagaaaaccacauggcucccugugcugcuugggagccugggaugcaagccgcugaccauguuucucauugcggagaauaagaucuggggccgcagaucuuggccccugaacgaaggcaucauggccguggggauugucuccauccuucugagcucccuccugaaaaacgaugugccucucgcuggaccccugauugccggcgggaugcuuaucgcuuguuacguuauuagcggaucuagcgccgaccugucccuggagaaggccgcugaggugucuugggaagaggaagcggagcauagcggcgccucccacaauauccucgucgaagugcaggaugacgggacaaugaaaaucaaggaugaggagcgggacgauacgcugaccauucuucugaaagcuacacuccuggccguuucuggaguguauccucucagcauccccgccacccuguucgucugguacuucuggcaaaagaaaaagcagcgcuccggcgugcuuugggacacaccuucucccccggaagucgagagagcugugcuggaugacggcauuuaucggaucaugcagcgcgggcugcucggaagaagccagguuggcgugggggucuuucaagaaaacguguuccauaccauguggcacguuacgcggggagccgugcugauguaccagggcaagagacuugagccuuccugggcgagcgucaaaaaggaccugauuucuuacgggggaggcuggcgccuccagggcuccuggaauaccggggaggaaguccaggugaucgcuguugagcccggcaagaacccuaagaauguccaaacagcccccggcaccuuuaaaacaccggaaggggaggugggagccauugcucuggauuucaagccuggcaccagcgggucucccaucgugaaccgggaaggaaagaucgucggccucuauggcaauggggugguuacaacguccggaaccuacgugagcgccauugcgcaggcuaaagccucccaggagggcccucugcccgagaucgaagacgaggucuuuagaaagcgcaaccuuacaauuauggaucugcaccccgggucuggaaaaacccggagauaucugccugccaucgugcgcgaagcuauuaagcggaaacucagaacccugauccuugccccgacacgcguuguggcuagcgagauggccgaagcgcugaagggcaugcccauccgguaccaaacgaccgccgucaaguccgagcauacagggaaagagauuguggaccucaugugccacgcuaccuucacaaugagacugcugagcccuguucgggugcccaauuauaacaugaucauuauggaugaagcccauuuuaccgacccuucuuccaucgcugcccgcggcuacauuagcacgagagucggaaugggcgaggccgcugcgaucuucaugacagccacacccccugggucuguggaggcuuuuccgcagagcaaugccgugauccaggaugaggaacgggacauucccgagcgcuccuggaacucuggauaugaguggaucaccgauuucccuggcaagacagucugguuuguucccagcauuaaauccgggaaugacaucgccaacugucucagaaagaauggaaaacgggugauucagcuuucuagaaagaccuucgauacagaauaccaaaagaccaaaaacaacgacugggacuacguggucacgacagauaucagcgagaugggcgcuaauuuccgcgccgaccgggugauugauccuagacgcugccugaagcccguuauccugaaagacgggccggaacgggugauccucgcgggcccuaugcccgucaccguggcuuccgccgcccagagacgcggacggauuggcagaaaccacaauaaggagggggaucaguauaucuacaugggacagccccugaacaaugacgaggaucaugcucacuggacagaagccaaaaugcuucuggacaacauuaauaccccugagggcaucauucccgcgcucuuugaaccugagcgcgaaaagagcgccgcuaucgauggggaguauagacugcggggagaggcccgcaagacguucguugaacugaugagacggggcgaccucccgguguggcuuucuuacaaagucgcuuccgagggguuucaauauagcgaucgcagauggugcuucgacggcgaacggaacaaucaggugcuggaggaaaacauggaugucgagaucuggaccaaggagggagaacgcaagaagcugcgcccccgguggcucgacgccagaacauacuccgacccucuggcucuuagagaguuuaaagaguucgccgcgggccggagaucugugagcggggaucugauucucgagaucggaaagcugccccagcaccugacccagcgggcccaaaaugcucucgacaaccuuguuaugcugcauaauuccgaacagggcgggcgcgccuauagacacgcuauggaggagcugccugauacaauugaaacccucaugcugcuugcccugaucgccgugcucacaggaggcgugacccuguuuuuccugucuggccgggggcucggaaaaacgagcauuggccuucugugugucauggcuuccagcguucugcucuggauggcgucuguggagccccauuggaucgccgcuuccaucauucuggaauuuuuccuuauggugcugcucaucccggagccugaccgccagagaacaccccaggauaaccaacuggccuacgucgugauugggcugcucuuuaugauccuuaccguugccgcuaaugagaugggacugcuggaaaccacaaagaaggaccucggcauugggcacguggccgucgagaaccaccaucacgcggccaugcuggauguggaccuucauccugcuagcgccuggacccuguacgcugucgccacaacgaucauuacccccaugaugcggcacacaaucgaaaacaccacagcgaauaucucucucaccgccauugcuaaccaggccgcuauccugaugggacuggauaaaggcuggccuauuuccaagauggacaucggcgugccccuccuugcccuggggugcuauagccagguuaauccgcugacgcucaccgcugccgugcugaugcuugucgcgcauuacgccauuaucggaccuggccugcaagcuaaagccacacgcgaggcucagaagagaaccgccgccgggaucaugaaaaaccccacaguggauggaauuguugcgaucgaccucgaucccguggucuaugacgcuaaguucgaaaagcagcugggccagauuaugcugcucauccuuuguaccucucaaauucugcugaugcggacgacaugggcccucugcgagagcaucacccuggcuacagggccucuuaccacccugugggagggauccccgggcaaauuuuggaauacaacgaucgccgugucuauggccaacauuuuccgcggcagcuaccucgcuggggccggacuggcguucucccugaugaaaagccucggcgggggaagacggggcaccggggcccagggagaaacacuuggcgagaaauggaagagacagcugaaucagcuguccaaaucugaauuuaacaccuauaagcgcagcggcaucauggagguggaccgguccgaagcuaaggaggggcucaaaagaggagagacaaccaagcacgccguuucucgcggcacggcuaaacugcggugguucgucgaaagaaaucuugugaagcccgaggggaaagugauugaucugggauguggccgcgggggauggagcuacuauugcgccggccucaagaaggucacagaaguuaaaggcuacaccaaaggcgggccugggcacgaggaacccaucccuauggcgaccuacggguggaaccuggugaaacugcauuccggaaaggacguguuuuucauucccccugagaaaugugauacacuccuuugcgacaucggcgagucuagcccgaaucccaccauugaagaggggcggacacugagaguccugaagaugguggaaccuuggcuccgcggaaaccaauuuuguaucaaaauccugaaucccuauaugccuuccguuguggagacgcuugagcagaugcagcggaagcacggcggcaugcuggucagaaacccccucagccgcaauucuacccaugaaauguacuggguguccugcgggacaggaaacauuguuagcgccgugaauaugaccucucggaugcugcugaacagauucacaauggcucaccgcaagccgaccuaugagagagaugucgaccucggcgccgggacgcggcacguggcuguggaaccugaggucgccaaccuggauaucauuggacagcgcaucgaaaauauuaaacaugagcacaaguccaccuggcauuacgacgaggauaaccccuauaaaacaugggcuuaccacggcagcuaugaaguuaagcccucuggguccgccagcuccauggugaauggaguggucaaacuucugaccaagccuugggacgugauccccaugguuacacaaaucgcgaugaccgauacaaccccuuuuggccagcagagaguguucaaggagaaagucgacacgcggacaccgaaggccaaaagaggcaccgcucaaauuauggaagugaccgccaaguggcucuggggguuucugagccggaacaaaaagccccgcaucuguacaagagaggaguucacgcggaagguucgcucuaaugcugccauuggagccguguuugucgacgagaaccaguggaauagcgcgaaagaggcuguggaagaugagagauucugggaccuuguucaucgggaacgcgagcugcacaagcagggcaaaugcgcuaccugcguguacaacaugauggggaagagagagaaaaagcucggagaguuuggcaaggccaaagggucccgggcuaucugguacauguggcugggcgcccgcuuccuggaguucgaagcucucggauuuaugaaugaggaucacugguucucuagagaaaacagccuguccggcgucgagggggagggacuucauaagcugggcuauauucuccgggacaucucuaaaaucccugggggaaauauguacgccgaugacacagcgggcugggauacccgcauuacagaagacgaucugcagaacgaggccagaaucaccgacauuauggaacccgagcacgcccuucuggccaagagcaucuuuaaacucacauaucaaaauaaggugguccgggugcagcgcccugcuaaaaacgggaccguuauggaugugauuuccagacgggaccagagaggcucuggacaggucggcacguacgggcugaauaccuucacaaacauggaagcccaacugauccgccagauggagagcgagggaaucuuuucccccagcgaacucgagaccccgaaccuggcggaacgggugcuugauuggcuggagaaguauggcguggaaagacucaagcgcauggccauuucuggggacgacuguguugugaaaccuaucgaugaccgguucgcuacagcccugaccgcucuuaaugauaugggaaaggucagaaaagacauuccccagugggagccuuccaagggcuggaacgauuggcagcaagugcccuuuugcagccaucacuuccaccagcugaucaugaaagacgggcgcgagauuguugugccuugucggaaucaggaugaacucgucggcagagcccgcgugucucagggagcuggcuggucccugcgggagacggccugccugggaaagagcuacgcgcaaauguggcagcucauguauuuucauagacgcgaccugcggcuugccgcuaacgccaucuguuccgccguccccguggauuggauuccgacaucuagaaccacauggagcauccacgcucaucaccaguggaugaccacggaagacaugcuguccguuuggaaucggguguggaucgaggaaaacccuuggauggaggauaagacccauauuagcucuuggggagacguccccuaccucggcaaaagagaggaccaauggugcgggucccugaucggacuuacagcccgcgcgaccugggcuacaaauauucagguggccaucaaccagguucggagacugauuggcaaugaaaacuaccucgauuauaugaccagcaugaagcgcuucaaaaaugagucugaccccgaaggggcccugugguga

SEQ ID NO: 19025 - RNA, 9879 nt, Artificial Sequence
  derived and/or modified CDS sequence (opt5) from DENV-1__GQ199780__SS-prME
agcgugaccaugcugcugaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugccccagaaucacagaggcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacagaacaguauaaauuccaagccgacucuccuaagcggcugagcgcggccauuggcaaggcuugggaggagggggugugcggcaucagauccgccacccgccuggaaaacaucauguggaagcagauuucuaacgagcucaaucauauccugcuugaaaacgacaugaaauuuacgguuguggucggagauguggcuggcauucuggcccaggggaagaaaaugauccggccgcagcccauggaguacaaguauagcuggaaguccuggggaaaagccaagauuaucggcgcugacgugcaaaauacaaccuucaucauugaugggccuaacacccccgaauguccugacgaucagagagcguggaauaucugggaggucgaggacuacggauuuggcauuuucacaaccaacaucuggcucaaacugcgcgauagcuauacgcagguuugcgaccaccggcugaugucugccgcuauuaaggauuccaaagccgugcacgccgacaugggcuacuggaucgaaagcgagaagaaugaaacauggaaacuugcuagagccucuuucaucgaggugaaaaccuguauuuggcccaagucccauacacucuggagcaacgggguccuggaaucugagaugaucauuccgaaaaucuauggaggcccuauuagccagcacaauuaccgccccggguacuuuacccaaacagcgggaccuuggcaucugggcaagcucgagcuggauuucgaccuuugcgaagggaccacggugguuguggaugagcacugcggaaaccggggccccucccugagaaccacaaccgucacaggcaaaaucauccacgaaugguguugccggagcuguacccucccuccccugcgcuuuaagggggaggacggaugcugguauggcauggagauuagaccggugaaggaaaaagaggaaaaucugguuaagucuaugguguccgcugggagcggagaggucgacuccuucucucuuggccuccuguguaucagcauuaugaucgaagaggugaugcgguccagauggucucgcaaaaugcugaugacggggacacucgccgucuuuuuccugcuuauuaugggacagcugaccuggaacgaucucauccggcugugcauuauggugggcgccaaugcuagcgacagaaugggcauggggacaaccuaccuggcccuuauggcgaccuuuaagaugcgcccuauguucgcugucggacugcucuuuagacggcugacaucccgcgaggugcuccugcuuacgaucggccugucucucguggccagcgucgaacugcccaacucccuggaggaacuuggggauggacuggccaugggcaucaugauucucaaacugcucaccgacuuccagagccaucaacugugggcuacacuucugucucucaccuuuaucaagacaaccuucucccugcacuaugccuggaagacgauggcuaugguucugagcauugugucucuuuuuccccugugucucuccacaaccagccagaaaaccacauggcugccugugcuccuggggucucuuggaugcaagccgcugaccauguuccugaucgccgagaauaaaauuuggggcagaaaguccuggccccucaacgaaggcaucauggcggucgggaucgugagcauucugcuuuccgcccugcucaaaaacgauguuccucuggcuggaccccucaucgccggcgggaugcugauugcuuguuacgugaucagcggaucuagcgccgaccuuucccuggagaaggccgcugaggucucuugggaagaggaagcggagcauagcggcgccucccacaauauucugguggaaguucaggaugacgggacaaugaaaaucaaggaugaggagcgggacgauacgcucaccauccugcuuaaggcuacacugcucgccgugucuggagucuauccucugagcauucccgccacccucuucgugugguacuuuuggcagaaaaagaaacaacgcuccggcguccugugggacacaccuucucccccggaaguggagagagcuguucuugaugacggcaucuaucggauuaugcagcgcgggcugcugggaagaagccaggugggcgucgggguguuccaggaaaacguuuuucauaccauguggcacgugacgcggggagccguccucauguaccaaggcaagcgccuggagccuuccugggcgagcgugaaaaaggaccuuaucucuuacgggggaggcuggagacugcagggcuccuggaauaccggggaggaagugcagguuauugcugucgagcccggaaagaacccuaaaaaugugcagacagcccccggcaccuucaagacaagcgaaggggaggugggagccaucgcucucgauuuuaaaccgggcaccucuggguccccuauugucaaccgggaaggaaagaucgugggccuguauggcaaugggguugugacaacgagcggaaccuacgucuccgccaucgcgcaagcuaaagccucucaggagggcccccucccugagauugaagacgagguguucagaaagcgcaaccugacaaucauggaucuucaccccgggagcggaaagacccggagauaucugcccgccauuguucgcgaagcuaucaaacggaagcugagaacccucauucuggccccuacacgcguggucgcuuccgagauggccgaagcgcuuaaaggcaugccgauccgguaccagacgaccgccgugaaguccgagcauacagggaaagagaucguugaccugaugugccacgcuaccuuuacaaugagacuccugucucccgugcgcgucccuaauuauaacaugauuaucauggaugaagcccauuucaccgaccccuccagcauugcugcccggggcuacaucucuacgagagugggaaugggcgaggccgcugcgauuuuuaugacagccaccccucccgggagcguggaggcuuucccucaauccaaugccgucauccaggaugaagaacgggacaucccggagcgcucuuggaacagcggauaugaguggauuaccgauuuucccggcaagacaguuugguucgugccuuccaucaagucugggaaugacauugccaacugucugcgcaagaauggaaagcgggugauccagcucagccgcaaaaccuucgauacagaauaccagaagaccaaaaacaacgacugggacuacgucgugacgacagauauuuccgagaugggcgcuaauuuuagagccgaccggguuaucgaucccagacgcugccuuaagccugugauucugaaggacgggcccgaacgggucauccuggcgggcccgaugccugugaccguugcuagcgccgcccaaagacgcggacggaucggcagaaaccacaauaaagagggggaucaguauauuuacaugggacagccccucaacaaugacgaggaucaugcucacuggacagaagccaagaugcugcuugacaacaucaauacccccgagggcauuaucccugcgcuguucgaacccgagcgcgaaaaaucugccgcuauugauggggaguaucggcucagaggagaggcccgcaagacguuuguggaacugaugagacggggcgaccugccugucuggcucuccuacaaaguggcuagcgagggguuccaguauuccgaucgcagauggugcuuugacggcgaacggaacaaucaaguccuugaggaaaacauggauguggagaucuggaccaaggagggagaacgcaaaaagcugagaccgcgguggcuggacgccagaacauacucugacccccucgcucugcgcgaguucaaggaauuugccgcgggccggagaagcguuuccggggaucuuauccuggagauuggaaaacucccucagcaccugacccagcgcgcccagaaugcucuggacaaccucgugaugcuucauaauucugaacaaggcgggcgggccuauagacacgcuauggaggagcugcccgauacaaucgaaacccugaugcuccuggcccuuauugccgugcugacaggaggcgucacccucuucuuucugagcggccgggggcugggaaagacguccaucggccuccuuuguguuauggcuagcucugugcugcuguggauggcguccguggagccucauuggauugccgcuagcaucauccucgaguucuuucugaugguccuucugauucccgagccggaccgccagagaacaccucaggauaaccagcucgccuacgugguuaucgggcugcuguucaugauucucaccguggccgcuaaugagaugggacuucuggaaaccaccaagaaggaccugggcaucgggcacgucgccguggagaaccaccaucacgcggccaugcucgaugucgaccugcaucccgcuucugccuggacccuuuacgcuguggccacaacgauuaucaccccuaugaugcggcacacaauugaaaacaccacagcgaauaucucccugaccgccaucgcuaaccaagccgcuauucucaugggacuggauaaaggcuggcccaucagcaagauggacauuggcguuccucugcucgcccuugggugcuauucucaggugaauccccugacgcugaccgcugccguccucaugcugguggcgcauuacgccaucauuggaccgggccuucaggcuaaggccacacgcgaggcucagaagagaaccgccgccgggaucaugaagaacccuacaguugauggaaucguggcgauugaccuggaucccgucguguaugacgcuaaauuugaaaagcagcucggccagaucaugcugcugauucucuguaccagccagauccuucugaugcggacgacaugggcccugugcgaguccauuacccucgcuacagggccccugaccacccuuugggagggaucuccuggcaaauucuggaauacaacgaucgccgugagcauggccaacaucuuccgcggcuccuaccuggcuggggccggacucgcguuuagccugaugaagucccugggcgggggaagacggggcaccggggcccaaggagaaacacucggcgagaaguggaaacgccagcuuaaucagcugucuaagagcgaguucaacaccuauaaaagauccggcauuauggagguugaccggucugaagcuaaggaggggcugaaaagaggagagacaaccaagcacgccgucagccgcggcacggcuaagcuccggugguuuguggaaagaaaucuggugaaaccggaggggaaggucaucgaucuuggauguggccgcgggggaugguccuacuauugcgccggccugaaaaagguuacagaagugaaaggcuacaccaaagggggacccggccacgaggaaccuauucccauggcgaccuacggguggaaccucgugaaacugcauucuggaaaggacgucuucuuuaucccucccgagaagugugauacacugcucugcgacauuggcgagagcuccccuaauccgaccaucgaagaggggcggacacuuagagugcugaaaaugguugaacccuggcugcgcggaaaccaguucuguauuaagauccucaauccuuauaugcccagcguggucgagacgcuggagcaaaugcagcggaaacacggcggcaugcuugugagaaacccucugucucgcaauuccacccaugaaauguacuggguuagcugcgggacaggaaacaucgugucugccgucaauaugaccucccggaugcuccugaacagauuuacaauggcucaccgcaagcccaccuaugagcgggauguggaccugggcgccgggacgagacacguggcugucgaaccggagguugccaaccucgauauuaucggacagcgcauugaaaauaucaaacaugagcacaagagcaccuggcauuacgacgaggauaacccuuauaagacaugggcuuaccacggcucuuaugaagugaaacccuccgggagcgccuccagcauggugaauggagucgugaagcugcuuaccaaacccugggacguuauuccuauggugacacagaucgcgaugaccgauacaacccccuucggccaacagagagucuuuaaggagaaaguggacacgcggacaccuaaggccaagcgcggcaccgcucagaucauggaaguuaccgccaaauggcuguggggguuccucucuagaaacaagaaaccgcggauuuguacaagagaggaauuuacgcggaaggugcgcagcaaugcugccaucggagccgucuucguggacgagaaccaauggaacuccgcgaaagaggcuguugaagaugagagauuuugggaccuggugcaucgggaacgcgagcuucacaagcagggcaagugcgccacaugcgucuacaacaugauggggaaaagagaaaagaaacugggagaguucggcaaggccaaagggucucgggcuauuugguacauguggcucggcgcccgcuuccuggaguuugaagcucugggauucaugaaugaggaucacugguuuagcagagaaaacucccucucuggcguggagggggagggacugcauaaacuuggcuauauccugcgggacauuagcaaaauccccgggggaaauauguacgccgaugacacagcgggcugggauacccgcaucacagaagacgaucuccagaacgaggccaagauuaccgacaucauggaaccugagcacgcucugcuugccaaguccauuuucaaacugacauaucagaauaaggucgugagaguucaacggcccgcuaaaaacgggaccgugauggaugucaucucucgcagagaccagcggggcagcggacaggugggcacguacgggcucaauaccuuuacaaacauggaagcccagcugauucgccaaauggaguccgagggaaucuucagcccuucugaacuggagacccccaaccucgcgggcagagugcuggauuggcuugaaaagcaugggguugagcggcugaaaagaauggccaucuccggagacgacuguguggucaagccgauugaugaccgcuuugcuacagcccucaccgcucugaaugauaugggcaaggugcggaaagacguuccucagugggaacccagcaagggguggaacgauuggcaacaggugccuuucugcucucaccacuuucaucaacuuaucaugaaagacggcagagagauugucgugcccugucgcaaucaggaugagcuggucggacgggccagagugucccagggcgcuggguggagccuccgcgaaacggccugccugggaaaguccuaugcgcagauguggcaacugauguacuuccaccggagagaccuccgccuggccgcuaacgccaucuguucugccguuccuguggauuggguccccacaagccggaccacaugguccauucaugcucaccaucaguggaugaccacggaggacaugcuuagcguguggaauagaguuuggaucgaagagaacccguggauggaagauaaaacccacauuucuuccuggggcgacgugccuuaucuggggaagcgcgaggaccaguggugcggaagccucaucggccugacagcccgggcgaccugggcuacaaauauccaagucgccauuaaccaggugagacggcuuaucgggaaugagaacuaccuggauuacaugaccucuaugaagagauuuaaaaaugaaagcgaccccgagggcgcccucugguga

SEQ ID NO: 19026 - RNA, 9879 nt, Artificial Sequence
  derived and/or modified CDS sequence (opt5) from DENV-1__GQ199781__SS-prME
agcgugaccaugcugcucaugcugaugcccaccgcccuugcuuuccaccugacgacccggggcggggaaccucauaugaucgucaccaagcaggaacggggaaaaucccuccuguuuaagaccucugccggcguuaacaugugcacccuuauugcgauggaccugggggaacucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuauccagaacggacggcugauuacagcuaaucccaucgugacggacaaagagaagccugucaacauugaagccgagccgcccuuuggcgagagcuauaucgugauuggggugggagaaaaagcccuuaagcucucuugguucaagaaaggcagcuccaucgggaagauguuugaggcuaccgccagaggcgcucgccggauggccauccugggagauacagcgugggacuucggcucuauugggggaguuuuuaccagcgucggcaaacuggugcaucagaucuucgggacagccuacggagugcucuuuuccggcgucagcuggaccaugaagauugggaucggcgugcugcuuacguggcugggacucaauucuagauccaccagccugucuaugacauguauugcuguuggccuggugacccuuuaccucggggucauggugcaggccgauuccggaugcguuaucaacuggaaaggccgcgaacugaagugugggagcggaauuuucgugacaaaugagguccacaccuggacagaacaauauaaguuucaggcugacuccccuaaacggcugucugccgcgaucggcaaggccugggaggagggggugugcggcaucagaagcgcuacccgccucgaaaacauuauguggaaacagaucuccaacgagcugaaucauauucuucuggaaaacgacaugaaguucacgguuguggucggagauguggugggcauccucgcccaggggaaaaagaugauucggccgcaacccauggagcacaaauacucuuggaaaagcuggggaaaggcuaagaucaucggcgccgacgcccagaauacaaccuuuauuaucgaugggccuaacacccccgaauguccugacgaucagagagcuuggaauauuugggaggucgaggacuauggauucggcaucuuuacaaccaacauuuggcugaagcugcgcgauuccuacacgcaggcgugcgaccaccggcuuaugagcgccgcuaucaaagauucuaaggccguucaugccgacaugggcuauuggaucgaauccgagaaaaaugaaacauggaagcucgcuagagccagcuucauugaggugaagaccuguaucuggcccaaaucucacacacugugguccaacggggugcuggaaagcgagauggucauuccgaagaucuacggaggcccuauuucucaacauaauuaucgccccggguacuucacccagacagcgggaccuuggcaccucggcaaacuggagcuugauuuugaccugugcgaagggaccacggugguuguggaugagcacugcggaaaccggggccccagccucagaaccacaaccgucacaggcaagaucauccaugaaugguguugccgguccuguacccugccuccccugcgcuucaaaggggaggacggaugcugguacggcauggagauuagaccggugaaggaaaaggaggaaaaucuuguuaaaagcauggugucugcuggguccggagaggucgacagcuuuucccucggccugcuguguaucucuauuaugaucgaagaggugaugcggagcagauggucccgcaagaugcucaugacggggacacuggccguuuuccuucugcucauuaugggacagcugaccuggaacgaucugauccggcuuugcauuauggugggcgccaaugcuucugacagaaugggcauggggacaaccuaucuggcccucauggcgaccuuuaaaaugcgcccuauguucgcugucggacugcucuuuagacggcugacaagccgcgaggugcuucugcucacgaucggccugucccugguggccucugucgaacuucccaacagccuggaggaacucggggauggacuggccaugggcaucaugauucucaagcugcuuaccgacuuccaaucccaccagcugugggcuacacuccugagccugaccuuuaucaaaacaacccuuucucugcauuacgccuggaagacgauggcuaugguucucuccauugugagccuguucccccucugucugucuacaaccucccagaagaccacauggcuuccugugcugcuggggagccucggaugcaaaccgcugaccauguuucuuaucgccgagaauaagauuuggggcagaaaaucuuggccccugaacgaaggcaucauggcggucggggugguuuccauccuccugagcucccuccugaagaacgaugugccucuugccggaccccugauugcuggcgggaugcugaucgccuguuaugucauuagcggaucuagcgcugaccucucccuggagaaagccgccgaggugucuugggaagaggaagcugagcacagcggcgcgucccauaauauccuuguugaagugcaggaugacgggacaaugaagauuaaagaugaggagcgggacgauacgcugaccauccuccugaaggccacacuccuggcugucucuggaguguacccucuuagcauccccgccacccuguucgucugguauuuuuggcaaaagaaaaagcagcgcuccggcgugcugugggacacaccuucucccccggaaguugagagagccgugcucgaugacggcauuuaccggaucaugcagcgcgggcugcuuggaagaagccaggucggcguggggguuuuccaagaaaacguguuccacaccauguggcacgucacgcggggagcugugcugauguaucagggcaaacgccucgagccuuccugggccagcgugaagaaagaccugauuucuuacgggggaggcuggagacuccagggcuccuggaauaccggggaggaaguucaggucaucgcgguggagcccggaaagaacccuaagaaugugcaaacagcucccggcaccuuuaaaacaccggaaggggaggucggagccauugcccuggauuucaagccuggcaccagcgggucucccaucgugaaccgggaaggaaaaauuguuggccuuuacggcaaugggguggucacaacguccggaaccuaugugagcgcuaucgcccagacaaaggcgucccaggagggcccucugcccgagaucgaagacgagguuuuuagaaaacgcaaccugaccauuauggaucuccaucccgggucuggaaagacccggagauaccugccugcuaucauucgcgaagccaucaagcggaaacuuagaacacugauucucgccccgacgcgcguggucgcuagcgagauggccgaagcucugaagggcaugcccauccgguaucaaaccacagccgugaaauccgagcacaccgggaaggagaucguugaccugaugugccaugcgacauucaccaugagacuccuuagcccugugcgcguccccaauuacaacaugauuaucauggaugaagcccacuuuacggacccuucuuccauugcugcccggggcuauaucagcacaagagugggaaugggcgaggcugccgccauuuucaugaccgcuacacccccugggucuguggaagcguuuccgcagagcaaugccgucauccaggaugaggaacgggacauccccgagcgcuccuggaacucuggauacgaguggauuacagauuucccuggcaaaaccguuugguuugugcccagcaucaaguccgggaaugacauugcuaacugucugagaaagaauggaaaacgggugauccagcugucucgcaagacauucgauaccgaauaucagaagacgaagaacaacgacugggacuacgucgugacaaccgauauuagcgagaugggcgccaauuuuagagccgaccggguuaucgauccuagacgcugccucaaacccgugauucugaaggacgggccggaacgggucauccuugcuggcccuaugcccgugacaguugccuccgcggcucagagacgcggacggaucggcagaaaccauaauaaggagggggaucaguacauuuauaugggacagccccugaacaaugacgaggaucacgcccacuggaccgaagccaaaaugcuccuggacaacaucaauacgccugagggcauuauccccgcucuguucgaaccugagcgcgaaaagagcgccgcgauugauggggaguaccggcucagaggagaggcccgcaaaaccuucguggaacuuaugagacggggcgaccugccggucuggcugucuuauaagguggcuuccgagggguuucaauacagcgaucgcagauggugcuucgacggcgaacggaacaaucagguccucgaggaaaacauggauguggagaucuggacaaaagagggagaacgcaagaaacugagaccccgguggcuugacgccagaaccuauuccgacccucuggcucuccgcgaguuuaaggaguucgccgcuggccggagaucuguuagcggggaucugauccuggagauuggaaagcucccccagcaucuuacacagcgcgcccaaaaugcgcuggacaaccuggugaugcuccacaauuccgaacagggcgggcgggccuacagacaugcuauggaggagcugccugauaccaucgaaacacuuaugcugcucgcccugauugcugugcugaccggaggcgucacgcucuuuuuccuuucuggccgggggcugggaaaaacaagcaucggccugcucuguguuauggccuccagcgugcugcuuuggauggccucuguggagccccacuggauugcugcguccaucauccuggaauuuuuccucaugguccugcugauuccggagccugaccgccagagaacaccccaggauaaccaacucgccuaugugguuaucgggcuucuguuuaugauucugaccguggcugccaaugagaugggacuccuggaaacaaccaagaaagaccuuggcaucgggcacgucgccguggagaaccaucaccaugcuacaaugcuggaugucgaccuccacccugccagcgcguggacgcuguacgccguggcuaccacaauuaucacccccaugaugcggcauacaauugaaaacaccacggccaauaucucucugaccgcuaucgccaaccaggcggccauucucaugggacuugauaagggcuggccuaucuccaaaauggacauuggcguuccccugcuggcucucgggugcuacagccaggugaauccgcugacacuuaccgccgcuguccugaugcucguggcccacuaugcuaucauuggaccuggccugcaagccaaggcgacacgcgaggcccagaagagaaccgcugccgggaucaugaaaaaccccacgguugauggaaucguggcuauugaccuggaucccgucguguacgacgccaaguucgaaaaacagcucggccagaucaugcuucugauucuguguacaucucaaauccuccugaugcggaccacaugggcccuuugcgagagcauuacccuggcgaccgggccucucacaacgcugugggagggauccccgggcaaguuuuggaauaccacaaucgcugugucuauggccaacaucuuccgcggcagcuaucuggcuggggccggacucgccuuuucccuuaugaaaagccugggcgggggaagacggggcaccggggcucagggagaaacacugggcgagaaguggaagcgccagcucaaucagcuguccaaaucugaguucaacauuuacaagagaagcggcaucauggagguugaccgguccgaagccaaagaggggcuuaagagaggagagaccacgcgccacgcggucucucggggcacagccaaacugagaugguucguggaacgcaaucucgugaagcccgaggggaaggucauugaucugggauguggcagagggggauggagcuauuacugcgcuggccugaaaaagguuaccgaagugaaaggcuauaccaaagggggaccuggccaugaggaacccaucccuauggccacauacggguggaaccucgugaaacuucacuccggaaaggacgucuuuuucgcucccccugagaaaugugauacccugcugugcgacauuggcgagucuagcccgaaucccacaaucgaagaggggagaacgcuccgcgugcugaagaugguugaaccuuggcuucggggaaaccaauuuuguauuaagauccugaaucccuacaugccuuccguggucgagacccucgagcagaugcagagaaaacauggcggcaugcuggugcgcaacccccugagcagaaauucuacacacgaaauguauuggguuuccugcgggaccggaaacaucgugagcgccgucaauaugacaucuagaaugcuccugaaccgcuucaccauggcgcaccggaagccgacguacgagagagauguggaccuuggcgccgggacccgccauguggcugucgaaccugagguugccaaccuggauauuaucggacagagaauugaaaauaucaaacacgagcauaaguccacauggcacuaugacgaggauaaccccuacaaaaccugggcuuaucauggcagcuacgaagugaagcccucuggguccgccagcuccauggugaauggagucgugaagcuccugacaaaaccuugggacguuauucccauggugacccaaaucgcuaugacagauaccacgccuuuuggccagcagcgggucuucaaggagaaaguggacacacgcaccccgaaggccagacggggcaccgcgcaaaucauggaaguuacagccagauggcuuuggggguuucugagccggaacaaaaagccccgcauuuguacgagagaggaguucacccggaaggugcgcucuaaugcugccaucggagcugucuuuguggacgagaaccaguggaauagcgccaaagaggccguugaagaugagagauucugggaccucgugcagaaggaacgggagcugcacaaacagggcaagugcgcgacaugcgucuauaacaugauggggaaacgcgaaaagaagcugggagaguuuggcaaagcuaagggguccagagccauuugguacauguggcucggcgcccgguuccuggaguuugaagcucuuggauucaugaaugaggaucacugguucucucgcgaaaacagccuguccggcguggagggggagggacuccauaaacugggcuacauccuuagagacauuucuaagaucccugggggaaauauguaugccgaugacaccgcuggcugggauacacggaucaccgaagacgaucugcaaaacgaggccaaaauuacagacaucauggaacccgagcacgcgcuccuggccaccagcauuuuuaagcugacguaccagaauaaagucgugcgcguucagagaccugcuaagaacgggaccgugauggaugucaucucccggcgcgaccagagaggcucuggacaagugggcacauaugggcucaauaccuucacaaacauggaagcccagcugauucggcagauggagagcgagggaaucuuucuucccuccgaacuggagaccccgaaccucgcugaaagagugcuggauuggcuugagaagcauggcguugaacgccugaaacggauggccaucagcggggacgacuguguggucaagccuauugaugacagauucgcgacggcccucacagcucugaaugauaugggaaaagugcgcaaggacaucccccagugggagccuucuaaaggcuggaacgauuggcaacagguucccuuuugcucccaccacuuccaucagcugauuaugaaggacgggcgggagaucguggucccuuguagaaaucaggaugaacucgugggccgcgcccgggucagccaaggagcuggcuggucucugagagagaccgccugccuugggaaguccuacgcucagauguggcagcugauguauuuucaccgccgggaccucagacuggccgcgaacgccauuuguagcgcugugcccguugauugggugccgacaucccgcaccacguggucuauccaugcccaccaucaauggaugaccacagaagacaugcuuagcgucuggaaucggguguggauugaggaaaacccuuggauggaggauaaaacccacguuuccagcuggggagacgugcccuaccugggcaagagagaggaccaguggugcgggucucucaucggacugacagcccgggcuaccugggccuccaauauccaggucgcgauuaaccaggugagacgccugaucggcaaugaaaacuaucucgauuacaugacaagcaugaaacgguucaagaaugagggggaccccgaaggcgcucugugguga

SEQ ID NO: 19027 - RNA, 9879 nt, Artificial Sequence
  derived and/or modified CDS sequence (opt5) from DENV-1__GQ199782__SS-prME
agcgugaccaugcugcucaugcugaugcccacagcccuugcuuuccaccugacgaccagaggaggggaaccucauaugaucgugacaaagcaggaacggggaaaaucccuccuguuuaagaccucugccggcguuaacaugugcacacuuauugcgauggaccugggggaacucugugaagauaccaugacauacaaaugccccagaaucaccgaggcugaacccgacgauguggacuguuggugcaaugccacggauaccugggugacauauggaaccuguagccaaacaggcgagcacagacgggacaagcgcuccguggcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaggacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacauccagaauaccaccuuuaucauugaugggccuaacacacccgaauguccugacgaucagagagcuuggaauaucugggaggucgaggacuauggauucggcauuuuuaccacgaacaucuggcugcgccugcgggauuccuacacacagguuugcgaccacagacuuaugagcgcggccauuaaggauucuaaagcugugcaugccgacaugggcuauuggaucgaauccgagaagaaugaaaccuggaaacucgcccgcgcuagcuucaucgaggugaagacauguauuuggcccaagucucacacccugugguccaacgggguccuggaaagcgagaugaucauuccgaaaaucuacggaggcccuauuucucaacauaauuaucggcccggguacuucacacagaccgccggaccuuggcaccucggcaagcuggagcuugauuuugaccugugcgaagggacgaccgugguuguggaugagcacugcggaaacagaggccccagccuccggacaaccacagucaccggcaaaaucauccaugaaugguguugccgcuccuguacgcugccuccccugagauucaagggggaggacggaugcugguacggcauggagauucggccggugaaagaaaaggaggaaaaucuuguuaagagcauggugucugcgggguccggagaggucgacagcuuuucccucggccugcuguguaucucuauuaugguggaagagguuaugagaagccgcuggucccggaaaaugcucaugacagggacccuggcuguguuccuucugcucaucaugggacagcugacauggaacgaucugauuagacuuugcaucauggucggcgccaaugccucugaccgcaugggcauggggaccaccuaucuggcucucauggccacauuuaagauuagaccuauguucgcggugggacugcucgugcggcgccugacgagcagagagguccuucugcucaccaucggccugucccugguugcuucuguggaacuucccaacagccuggaggaacucggggauggacuggccaugggcaucaugauucucaaacugcuuacagacuuucaaucccaccagcugugggccacccuccugagccugacauucaucaagaccacgcuuucucugcauuacgcuuggaaaacaauggccauggugcucuccauugucagccuguuuccccucugucugucuaccaccucccagaagacaaccuggcuuccugugcugcuggggagccucggaugcaagccgcugacaauguuccuuaucacggagaauaaaauuuggggccggaagucuuggccccugaacgaaggcaucauggcuguugggguggucuccauccuccugagcucccuccugaaaaacgaugugccucuugccggaccccugauugcgggcgggaugcugaucgccuguuauguuauuagcggaucuagcgcugaccucucccuggagaaggccgcugaggugucuugggaagaggaagccgagcacagcggcgccucccauaauauccuugucgaagugcaggaugacgggaccaugaaaauuaaggaugaggagcgcgacgauacacugaccauccuccugaaagcuacacuccuggcggucucuggaguguacccucuuagcauccccgccacccuguuuguuugguauuucuggcaaaagaagaaacagagauccggcgugcugugggacacgccuucucccccggaagucgagcgggcugugcucgaugacggcauuuaccgcaucaugcagagagggcugcuuggacggagccagguuggcgugggggucuuucaagaaaacguguuccacaccauguggcacgugacacgcggagccguucugauguaucagggcaagagacucgagccuuccugggccagcgucaaaaaggaccugauuucuuacgggggaggcuggcggcuccagggcuccuggaauaccggggaggaaguccaggugaucgcugucgagcccggcaagaacccuaagaaugugcaaacagcccccggcaccuucaagacaccggaaggggagguuggagcgauugcucuggauuuuaaaccuggcacgagcgggucucccaucgugaacagagaaggaaagauugucggccuuuacggcaauggggugguuaccacauccggaaccuaugugagcgccaucgcccaggcuaaagccucccaggagggcccucugcccgagaucgaagacgaggucuuccgcaagcggaaccugaccauuauggaucuccaucccgggucuggaaaaacaagacgcuaccugccugcgaucgugcgggaagcuauuaagagaaaacuucgcacgcugauccucgccccgacccggguuguggccagcgagauggcugaagcccugaaaggcaugcccauuagauaucaaacaaccgcugucaaguccgagcacacagggaaagagaucguggaccugaugugccaugccaccuuuacgaugcgccuccuuagcccugugcggguccccaauuacaacaugaucauuauggaugaagcgcacuucacagacccuucuuccaucgccgcuagaggcuauauuagcacccggguuggaaugggcgaggccgcugccaucuuuaugaccgccacacccccugggucuguggaggcuuucccgcagagcaaugcggugauucaggaugaggaacgcgacauccccgagagauccuggaacucuggauacgaguggaucaccgauuuuccuggcaagacagucugguucgugcccagcauuaaauccgggaaugacaucgccaacugucugcggaagaauggaaagcgcguuauucagcugucuagaaaaaccuuugauacggaauaucaaaagaccaagaacaacgacugggacuacguggucaccacagauaucagcgagaugggcgcuaauuuccgggccgacagagugauugauccucgccggugccucaagcccguuauccugaaagacgggccggaaagagugauucuugccggcccuaugcccgucaccguggcuuccgccgcgcagcgccggggaagaaucggccgcaaccauaauaaggagggggaucaguacaucuauaugggacagccccugaacaaugacgaggaucacgcucacuggacggaagccaagaugcuccuggacaacauuaauaccccugagggcaucauucccgcccuguuugaaccugagcgggaaaagagcgcugccaucgauggggaguacagacuccgcggagaggcgagaaagacauucgucgagcuuaugcggcgcggcgaccugccgguguggcugucuuauaaaguugccuccgagggguuccaauacagcgauagacgguggugcuuugacggcgaacgcaacaaucaggugcucgaggaaaacauggauguggagauuuggaccaaggagggagaacgcaaaaagcugcggcccagauggcuugacgcucgcacauauuccgacccucuggcccuccgggaguucaaagaauuugcugccggcagacgcucugucagcggggaucugauccuggagaucggaaagcucccccagcaucuuacccagcgggcucaaaaugcccuggacaaccugguuaugcuccacaauuccgaacagggcgggagagcguaccggcaugccauggaggagcugccugauacaauugaaacccuuaugcugcucgcucugaucgccgugcugacgggaggcgugacacucuucuuucuuucuggccgcgggcugggaaagaccagcauuggccugcucugugucauggcuuccagcgugcugcuuuggauggccucuguugagccccacuggaucgccgcuuccauuauccuggaguucuuucucauggugcugcugaucccggagccugacagacagcggacaccccaggauaaccaacucgcguaugucgugauugggcuucuguucaugauccugacagucgccgcuaaugagaugggacuccuggaaaccaccaaaaaggaccuuggcauugggcacguggccguugagaaccaucaccaugccacgaugcuggauguggaccuccacccugcuagcgccuggacccuguacgcggucgccacaaccaucauuacacccaugaugcgccauaccaucgaaaacacgaccgcuaauauuucucugacagccaucgcuaaccaggccgcgauccucaugggacuugauaaaggcuggccuauuuccaagauggacaucggcgugccccugcuggcccucgggugcuacagccagguuaauccgcugacccuuacagcugccgugcugaugcucgucgcucacuaugccauuaucggaccuggccugcaagcuaaagccaccagagaggcgcagaagcggacggccgcugggauuaugaagaaccccacaguggauggaaucguggccaucgaccuggaucccguugucuacgacgcuaaauuugaaaagcagcucggccagauuaugcuucugauccuguguaccucucaaauucuccugaugcgcacaaccugggcccuuugcgagagcaucacccuggccacagggccucucacgacccugugggagggauccccgggcaaauucuggaauacaaccauugcggugucuauggcuaacaucuuuagaggcagcuaucuggccggggcuggacucgccuucucccuuaugaaaagccugggcgggggacggcgcggcacaggggcccagggagaaacccugggcgagaaauggaagagacagcucaaucagcuguccaagucugaauuuaacaucuacaaacggagcggcauuauggagguggacagauccgaagcuaaggaggggcuuaaacgcggagagacgacacggcacgccgucucuagaggcaccgcgaagcugcgcugguucguugaacggaaucucgugaaacccgaggggaaggugaucgaucugggauguggcagagggggauggagcuauuacugcgccggccugaagaaagucaccgaagugaagggcuauacaaaagggggaccuggccaugaggaacccauuccuauggcuaccuacggguggaaccucguuaaacuucacuccggaaaagacguguucuuuacacccccugagaagugugauacgcugcugugcgacaucggcgagucuagcccgaaucccaccauugaagaggggcgcacacuccggguccugaaaaugguggaaccuuggcuuagaggaaaccaauucuguaucaagauucugaaucccuacaugccuuccguuguggagacccucgagcagaugcagcgcaagcauggcggcaugcugguccggaacccccugagcagaaauucuacacacgaaauguauuggguguccugcgggaccggaaacaucgugagcgccgucaauaugacgucucgcaugcuccugaaccgguuuaccauggcucacagaaaaccgacauacgagcgcgauguugaccuuggcgccgggaccagacauguggcgguggaaccugaggucgccaaccuggauaucauuggacagcggaucgaaaauaugaagcacgagcauaaauccacauggcacuaugacgaggauaaccccuacaagaccugggcuuaucauggcagcuacgaagugaaacccucuggguccgccagcuccaugguuaauggaguggucaagcuccugacaaagccuugggacgugauucccaugguuacccaaaucgcuaugacggauacaaccccuuucggccagcagcgcguguuuaaagagaaggucgacaccagaacaccgaaagccaagcggggcacggcucaaauuauggaagugaccgccagauggcuuuggggguuccugagccggaacaaaaagccccgcaucuguacaagagaggaauuuacccggaagguucgcucuaaugcggccaucggagcuguguucgucgacgagaaccaguggaauagcgccaaagaggcuguggaagaugagagauuuugggaccucguccagaaggaacgggagcugcacaaacagggcaagugcgccacaugcguguauaacaugauggggaaacgcgaaaagaagcugggagaguucggcaaagccaagggguccagagcgauuugguacauguggcucggcgcucgguuucuggaguucgaagcccuuggauuuaugaaugaggaucacugguucucucgcgaaaacagccuguccggcguugagggggagggacuccauaaacugggcuacauccuuagagacauuucuaagaucccugggggaaauauguaugccgaugacaccgcuggcugggauacacggauuaccgaagacgaucugcaaaacgaggccaaaaucacggacaucauggaacccgagcacgcucuccuggccaccagcauuuucaagcugacauaccagaauaaagugguccgcgugcagagaccugcgaagaacgggaccgugauggauguuaucucccggcgcgaccagagaggcucuggacaagugggcacauaugggcucaauaccuuuacgaacauggaagcccagcugauucggcagauggagagcgagggaaucuuccuucccuccgaacuggagacaccgaaccucgcugaaagaguccuggauuggcuugagaaguacggcguggaacgccugaaacggauggccauuagcggggacgacuguguugugaagccuaucgaugacagauuugcuaccgcccucacagcgcugaaugauaugggaaaaguccgcaaggacaucccccagugggagccuucuaaaggcuggaacgauuggcaacaggugcccuucugcucccaucacuuucaccagcugauuaugaaggacgggcgggagaucgucgugccuuguagaaaucaggaugaacucguuggccgcgcccgggugagccaaggagcuggcuggucucugagagagaccgccugccuugggaaguccuaugcucagauguggcagcugauguacuuccaucgccgggaccucagacuggccgcuaacgccauuuguagcgcgguccccguggauuggguuccgacgucccgcaccacauggucuauccacgcccaucaccaauggaugaccacagaagacaugcuuagcguguggaaucgggucuggauugaggaaaacccuuggauggaggauaaaacccauguguccagcuggggagacgugcccuaucugggcaagagagaggaccaguggugcgggucucucaucggacugacagcucgggccaccugggccuccaauauucagguugcuaucaaccaggucagacgccugaucggcaaugaaaacuaccucgauuacaugacgagcaugaaacgguuuaagaaugagggggaccccgaaggcgcccugugguga

SEQ ID NO: 19028 - RNA, 9879 nt, Artificial Sequence
  derived and/or modified CDS sequence (opt5) from DENV-1__GQ199783__SS-prME
agcgugaccaugcugcugaugcugaugcccacagcccuugcuuuccaccugacgacccggggcggggaaccucauaugaucgugaccaagcaggaacggggaaagucccuccuguuuaagaccucugccggcguuaauaugugcacacuuauugcgauggaccugggggaacucugugaagauaccaugacauacaagugcccgcgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuuguuacaccuucuauggcuaugagaugcgugggcauugggagccgggauuuuguugagggaacguccggcgccaccuggguggacgucgugcuggagcacgggagcugugugacaaccauggcuaaggauaaacccacacucgacaucgaacugcugaagaccgaggucacgaacccugccguucuccgcaaacugugcauugaagcgaagaucucuaauacaaccaccgauuccagauguccgacacaaggagaggccacccuuauggaagaacaagacgcuaacuucgugugccggcgcacauuuguggauagaggcuggggcaauggguguggacuguucggcaaagggagccucauuacgugcgccaaguuuaagugcgucaccaaacuggagggaaagaucgugcaguacgaaaaccuuaaauauucuguuaucgugacaguccacaccggcgaccagcaucaaguggggaaugaguccacagaacacggaaccacggcuaccauuacaccccaggccccuaccagcgagauccagcugacagacuacggcgcccucacccuggauuguucuccccggacgggccuggacuucaacgaaaugguucuccugacaaugaaggagaaauccuggcuugugcauaagcagugguuucuggaucucccucugcccuggaccagcggggcuuccacaucucaagagaccuggaaucgccaggaccuucuggucaccuucaaaacagcgcacgccaagaagcaggaaguggucgugcucggaagccaagagggcgcuaugcacacggcccugaccggggccacagaaauucagaccuccggaacaaccacgaucuuugcuggccaucugaaaugcagacucaagauggauaaacugacacuuaaggggaugagcuauguuauguguaccggcucuuucaaacuggagaaggaaguggccgagacccagcacggaacaguccucgugcagauuaaguacgagggcaccgacgcgccgugcaaaaucccuuucuccacacaagaugaaaaggggguuacgcagaacggacggcugaucaccgcuaaucccauugugacagacaaagagaagccugucaacaucgaagccgagccgcccuuuggcgagagcuauauugugaucggggccggagaaaaagcucugaaacuuucuugguucaagaaaggcagcuccauugggaagauguuugaggccaccgcuagaggcgcccgccggauggcgauccucggagauacagccugggacuucggcucugucgggggaguuuuuaccagcgucggcaaacuggugcaucagaucuucgggacggcuuacggagugcuguuuuccggcgucagcuggaccaugaagauugggaucggcgugcuccugacauggcuuggacucaauucuagauccaccagccucucuaugacauguauugccguuggccuggugacccuguaccuuggggucauggugcaggcugauuccggaugcguuaucaacuggaaaggccgcgaacucaagugugggagcggaauuuucgugacaaaugagguccacaccuggacggaacaauauaaguuucaggccgacuccccuaaacggcugucugcggccaucggcaaggcuugggaggagggggugugcggcauuagaagcuccacacgccuggaaaacaucauguggaaacagaucucuaacgagcucaaucauauucugcuugaaaacgacaugaaguucaccguuguggucggagauguggugggcauccuggcccaggggaaaaagaugauucggccgcaacccauggagcacaaauacagcuggaaguccuggggaaaggcuaaaaucauuggcgccgacguccagaauaccacauuuaucaucgaugggccuaacacccccgaauguccugacgaucagagagccuggaauauuugggagguugaggacuauggauucggcaucuuuacgacaaacauuuggcucaagcugcgcgauagcuacacccaggugugcgaccaccggcugaugucugcugcgaucaaagauuccaaggccgugcaugcugacaugggcuauuggauugaaagcgagaaaaaugaaacauggaaacuugccagagccucuuucaucgaggucaagaccuguaucuggcccaaaucccacacacucuggagcaacggggugcuggaaucugagaugauuaucccgaagauuuacggaggcccuaucagccaacauaauuaucgccccggguacuucacccagacggcuggaccuuggcaccugggcaaacucgagcuggauuuugaccuuugcgaagggaccacaguuguggucgaugagcacugcggaaaccggggccccucccugagaaccacaaccgugacgggcaagauuauccaugaaugguguugccggagcuguacacucccuccccugcgcuucaaaggggaggacggaugcugguacggcauggagaucagaccgguuaaggaaaaggaggaaaaucuggugaaaucuauggucuccgccgggagcggagagguggacuccuuuucucuuggccuccuguguauuagcaucaugauugaagagguuaugcgguccagauggucucgcaagaugcugaugaccgggacacucgcgguguuccugcuucugaucaugggacagcucaccuggaacgaucugauucggcugugcaucauggucggcgcuaaugccagcgacagaaugggcauggggaccacauaucuugcccugauggcuacguuuaaaauucgcccuauguucgccgugggacuccuguuuagacggcucaccucccgcgaggugcugcuucugacaaucggccucucucuggucgcgagcguugaacugcccaacucccuugaggaacugggggauggacucgcuaugggcaucaugauucugaagcuccugaccgacuuccaaagccaccagcuuugggccacacugcucucucugaccuuuaucaaaacgacacugucccuucaucacgccuggaagaccauggcuauggugcugagcauugugucucucuucccccugugucucuccaccacaagccagaagaccacauggcugccuguccuucuggggucucugggaugcaaaccgcucacgauguuucugaucaccgagaauaagauuuggggcagaaaauccuggccccuuaacgaaggcaucauggccguggggguugugagcauccugcucuccagccugcucaagaacgaugucccucuggcuggaccccuuauugccggcgggaugcugaucgcguguuacgugauuucuggaagcuccgccgaccugucucucgagaaagcugccgagguuagcugggaagaggaagcugagcauuccggcgccucucacaauauccugguggaaguccaggaugacgggacaaugaagauuaaagaugaggagcgggacgauacccuuacaauccugcucaaggccacccugcucgcugugagcggagucuauccucuguccauccccgcgacgcuuuucgugugguacuuuuggcaaaagaaaaagcagcgcucuggcguucugugggacaccccuagcccucccgaaguggagagagccguccuggaugacggcauuuaucggaucaugcagcgcgggcuccugggaagaucccaggugggcguugggguguuccaagaaaacgucuuccacacaauguggcaugugacccggggagcugugcuuauguaccagggcaaacgccuggagcccagcugggccucuguuaagaaagaccucauuuccuaugggggaggcuggagacugcagggcagcuggaauacaggggaggaaguccaggugaucgccguggagcccggaaagaacccuaagaauguccaaaccgcucccggcacauuuaaaacgccggaaggggaggugggagccauugcgcucgauuucaagccuggcaccucugggucccccaucguuaaccgggaaggaaaaauugugggccuguacggcaauggggucgugacaaccagcggaaccuacguuuccgcuaucgcccagacaaaggccucucaggagggcccucuucccgagaucgaagacgagguguuuagaaaacgcaaccugacgauuauggaucugcaccccgggagcggaaagacccggagauaucucccugcuaucguccgcgaagccauuaagcggaaacugagaacacuuauccuggcgccgacccgcgugguugcuuccgagauggccgaagcccucaagggcaugcccauucgguaccaaacaaccgcugugaaaagcgagcauacggggaaggagaucgucgaccugaugugccacgccacauucaccaugagacugcucucuccugugcgcgugcccaauuauaacaugaucauuauggaugaagcucauuuuaccgacccuuccagcaucgccgcgcggggcuacauuucuacaagagucggaaugggcgaggccgcugccaucuucaugaccgcuacacccccugggagcguugaagccuuuccgcaguccaaugccgugauucaggaugaggaacgggacauccccgagcgcucuuggaacagcggauaugaguggaucaccgauuucccuggcaaaacggugugguuuguccccuccauuaagucugggaaugacaucgcuaacugucuuagaaagaauggaaaacgggugauucagcugagccgcaagacauucgauaccgaauaccagaagaccaagaacaacgacugggacuauguugugaccacggauaucuccgagaugggcgcgaauuuuagagccgaccgggucauugauccuagacgcugccugaaacccgugauccucaaggacgggccggaacggguuauucuggcuggcccuaugcccgugaccgucgccagcgccgcucagagacgcggacggaucggcagaaaccacaauaaggagggggaucaguacaucuacaugggacagccccuuaacaaugacgaggaucacgcccauuggacagaagcgaaaaugcugcucgacaacauuaauaccccugagggcaucauucccgcucuguucgaaccugagcgcgaaaagucugccgccaucgauggggaguaucggcugagaggagaggcucgcaaaacauucguggaacucaugagacggggcgaccuuccggucuggcuguccuacaagguggccagcgagggguuucaauauuccgaucgcagauggugcuucgacggcgaacggaacaaucagguucuggaggaaaacauggauguggagauuuggaccaaagagggagaacgcaagaaacucagaccccgguggcuggacgcgagaacauacucugacccucuugcccugcgcgaguuuaaggaguucgcugccggccggagaagcguguccggggaucucauccuggagaucggaaagcugccccagcaccucacccagcgcgcucaaaaugcccuugacaaccuggucaugcugcauaauucugaacagggcgggcgggcuuauagacacgccauggaggagcucccugauacgauugaaacacugaugcuucuggcgcucaucgccguucugaccggaggcgugacccuguuuuuccucagcggccgggggcuuggaaaaacauccauuggccugcugugugugauggcuagcucuguccuccuguggauggccuccguggagccccacuggaucgcugccagcauuauccuugaauuuuuccugaugguucuccugaucccggagccugaccgccagagaacaccccaggauaaccaacuggccuacguggucauugggcuccuuuuuaugauccugacaguggcugcgaaugagaugggacugcucgaaacgaccaagaaagaccugggcauugggcaugucgccguggagaaccaccaucacgcuacaaugcuugauguugaccugcauccugccucugccuggacccucuaugcuguggccacaaccaucauuacgcccaugaugcggcacaccaucgaaaacacaaccgcgaauauuucccugacagccaucgcuaaccaggccgcuauccugaugggacucgauaagggcuggccuauuagcaaaauggacaucggcgucccccuucuggcccuggggugcuacucucaggugaauccgcucacccugacggcggccguucuuaugcugguggcucacuacgccauuaucggaccuggccuccaagcuaaggccacacgcgaggcucagaagagaaccgccgcggggauuaugaaaaaccccacagucgauggaaucguggccaucgaccuggaucccgugguuuaugacgcuaaguucgaaaaacagcugggccagauuaugcuccuuauccuguguaccagccaaauucugcucaugcggaccacaugggcccugugcgaguccaucacgcuugcuaccgggccucugacaacccucugggagggaucuccgggcaaguuuuggaauacaaccauugccgucagcauggccaacaucuuccgcggcuccuaccuggcgggggcuggacuggccuuuagccucaugaaaucccuuggcgggggaagacggggcacgggggcucagggagaaacacugggcgagaaguggaagcgccagcugaaucagcucucuaaaagcgaguucaacaucuauaagagauccggcauuauggagguggaccggucugaagccaaagaggggcugaagagaggagagaccacccgccaugccgugagccggggcacagcuaaacuuagaugguucgucgaacgcaaucugguuaagcccgaggggaaggugaucgaucucggauguggcagagggggaugguccuacuauugcgccggccugaaaaaggugaccgaagucaaaggcuacacaaaagggggaccuggccacgaggaacccauuccuauggcgacguauggguggaaccuggugaaacuccauucuggaaaggacgucuuuuucacacccccugagaaaugugauacacuucugugcgacaucggcgagagcuccccgaaucccaccauugaagaggggagaacacugcgcgugcucaagauggucgaaccuuggcugcggggaaaccaauuuuguaucaagauucuuaaucccuacaugccuagcgugguugagacccuggagcagaugcagagaaaacacggcggcaugcucgugcgcaacccccugucuagaaauuccacgcacgaaauguacugggucagcugcgggaccggaaacaucgugucugccgugaauaugacauccagaaugcugcucaaccgcuucaccauggcucaucggaagccgacauaugagagagaugucgaccugggcgccgggacccgccacguugcuguggaaccugagguggccaaccuugauaucauuggacagagaaucgaaaauauuaaacaugagcacaagagcacauggcauuacgacgaggauaaccccuauaaaaccugggcguaccacggcucuuaugaagucaagcccuccgggagcgccuccagcauggugaauggaguugugaagcugcucacgaaaccuugggacgucauccccauggugacacaaauugcuaugaccgauaccacaccuuuuggccagcagcggguuuucaaggagaaaguggacacgcgcaccccgaaggccaaaagaggcacagcucaaaucauggaagucaccgcccgguggcuguggggguuucuuucuagaaacaagaagccccggaucuguacacgcgaggaguucaccagaaaagugcggagcaaugcugccauuggagcgguuuuuguggacgagaaccaguggaacuccgccaaggaggcugucgaagaugagcgcuucugggaccuggugcagaaagaaagagagcuccacaagcagggcaaaugcgccacaugcgucuacaacaugauggggaagcgggaaaagaaacugggagaguuuggcaaggcuaaagggucucgcgccaucugguauauguggcugggcgccagauuccucgaguuugaagcgcugggauucaugaaugaggaucauugguucagccgggaaaacucccuuucuggcguggagggggagggacugcacaagcucggcuacauucugcgcgacaucagcaaaauuccugggggaaauauguacgcugaugacaccgccggcugggauacgagaaucaccgaagacgaucuucaaaacgaggccaagaucacagacauuauggaacccgagcaugcucugcucgccaccuccaucuuuaaacugacauaucagaauaagguugugcggguccagcgcccugcuaagaacgggaccgugauggaugugauuucuagacgggaccagcgcggcagcggacaaguuggcacguacgggcugaauacauucaccaacauggaagcccagcucaucagacagauggaguccgagggaauuuuucugcccagcgaacuugagacaccgaaccuggcggaacgggugcucgauuggcuggagaaauauggcgucgaaagacuuaagcgcauggccaucucuggggacgacugugugguuaaaccuaucgaugaccgguucgcuaccgcccugacggcucucaaugauaugggaaaggugagaaaagacauuccccagugggagccuuccaagggcuggaacgauuggcaacagguccccuuuugcagccaccacuuccaucagcugaucaugaaggacgggcgcgagauuguggucccuugucggaaucaggaugaacuggugggcagagcccgcguuucucaaggagcgggcuggucccuccgggagaccgccugccuggggaaaagcuacgcucagauguggcagcuuauguauuuucacagacgcgaccugcggcucgccgcuaacgccaucuguuccgcugugcccgucgauugggugccgacaucuagaaccacauggagcauucaugcccaccaucaauggaugaccacagaagacaugcuguccguuuggaaucgcguguggaucgaggaaaacccuuggauggaggauaagacccacgucagcucuuggggagacgugcccuaccuuggcaaacgggaggaccaguggugcgggucccugauuggacucacggcgagagccacaugggcuagcaauauccagguggccaucaaccagguucggagacugauuggcaaugaaaacuaucuggauuacaugaccucuaugaagcgcuucaaaaaugagggggaccccgaaggcgcccucugguga

SEQ ID NO: 19029 - RNA, 9879 nt, Artificial Sequence
  derived and/or modified CDS sequence (opt5) from DENV-1__GQ199784__SS-prME
agcgugaccaugcugcugaugcugaugcccaccgcccuugcuuuccaccugacgacccggggcggggaaccucauaugaucgucacaaagcaggaacggggaaagucccuucuguuuaagaccucugccggcguuaacaugugcacccuuauugcgauggaccugggggaacucugugaagauaccaugacauacaagugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaagcagauucagcggguugaaaccugggcucugcgccaccccggcuucacagugaucgcccuuuuucuggcgcaugucauugggaccuccaucacccagaagggaaucauuuucauccuccugaugcuugugacaccuucuauggccaugagaugcguuggcauugggagccgggauuuuguggagggacuguccggcgcuacgugggucgacguggugcucgagcacgggagcugugucaccacaauggccaaggauaagcccacccuggacaucgaacugcucaagacagagguuaccaacccugcugugcugcgcaaacuuugcauugaagccaagaucucuaauacgacaaccgauuccagauguccgacccaaggagaggcgacacugauggaagaacaagacgccaacuucgugugccggcgcaccuuugucgauagaggcuggggcaauggguguggacucuucggcaaagggagccugauuacaugcgcuaaguuuaagugcgugacgaaacuugagggaaagaucguucaguacgaaaaccugaaauauucugugaucgucaccgugcacacaggcgaccagcaucaaguugggaaugaguccaccgaacacggaacaaccgccacgauuacaccccaggcuccuacaagcgagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggccuccaccucucaagagacauggaaucgccaggaccugcucgugaccuucaaaaccgcucacgcgaagaagcaggaagucgugguucugggaagccaagagggcgccaugcacacagcucugacgggggccaccgaaauucagacauccggaaccacaaccaucuuugccggccaucucaaaugcagacugaagauggauaaacuuacgcugaaggggaugagcuaugugauguguacaggcucuuucaaacucgagaaggaagucgcugagacccagcacggaaccgugcugguucagauuaaguacgagggcacagacgccccgugcaaaaucccuuucuccacccaagaugaaaagggggugacacagaacggacggcugaucacggcgaaucccauugucaccgacaaagagaagccugugaacaucgaagcugagccgcccuuuggcgagagcuauauugugaucggggccggagaaaaagcccuuaagcucucuugguucaagaaaggcagcuccauugggaagauguuugaggcuacagccagaggcgcucgccggauggccauccugggagauaccgcgugggacuucggcucuaucgggggaguuuuuacaagcgucggcaaacuggugcaucagauuuucgggaccgccuacggagugcucuuuuccggcgucagcuggacgaugaagaucgggcugggcgugcuucugaccuggcucggacucaauucuagauccacaagccugucuaugaccuguauugcuguuggccuugugacacucuaccugggggucauggugcaggccgauuccggaugcguuaucaacuggaaaggccgcgaacugaagugugggagcggaauuuucgugaccaaugagguccacacauggaccgaacaauauaaguuucaggcugacuccccuaaacggcucucugccgcgaucggcaaggccugggaggagggggugugcggcauuagaagcgcuacgcgccuggaaaacaucauguggaaacagaucuccaacgagcuuaaucauauucugcucgaaaacgacaugaaguucacaguuguggucggagauguggugggcauccuggcccaggggaaaaagaugauucggccgcaacccauggagcacaaauacucuuggaaaagcuggggaaaggcuaagaucauuggcgccgacguccagaauaccaccuuuaucaucgaugggccuaacacacccgaauguccugacgaucagagagccuggaauauuugggagguugaggacuauggauucggcaucuuuaccacgaacauuuggcugaaacuucgcgauucccacacacaggugugcgaccaucggcucaugagcgcugcgaucaaagauucuaaggccgugcacgcugacaugggcuacuggauugaauccgagaaaaaugaaaccuggaagcuggccagagccagcuucaucgaggucaagacauguaucuggcccaaaucucauacccugugguccaacggggugcucgaaagcgagaugauuaucccgaagauuuauggaggcccuaucucucaacacaauuaccgccccggguauuucacacagaccgcuggaccuuggcaccugggcaaacuugagcuggauuuugaccucugcgaagggacgaccguuguggucgaugagcauugcggaaaccggggccccagccugagaacaaccacagugaccggcaagauuauccacgaaugguguugccgguccuguacgcugccuccccuucgcuucaaaggggaggacggaugcugguacggcauggagaucagaccgguuaaggaaaaggaggaaaaucucgugaaaagcauggucucugccggguccggagagguggacagcuuuucccugggccugcucuguauuucuaucaugauugaagagguuaugcggagcagauggucccgcaagaugcugaugacagggacccuugcgguguuccugcuccugaucaugggacagcugacauggaacgaucuuauucggcugugcaucauggucggcgcuaaugccucugacagaaugggcauggggaccaccuaccucgcccugauggcuacauuuaaaaugcgcccuauguucgccgugggacuccuguuuagacggcuuacgagccgcgaggugcugcuccugaccauuggccugucccuugucgcgucuguugaacugcccaacagccucgaggaacugggggauggacucgcuaugggcaucaugauccugaaacuucugacagacuuccaaucccaucagcucugggccacccugcugagccuuacauuuauuaaaaccacgcugucucuccacuaugccuggaagacaauggcuauggugcuguccaucgugagccucuucccccugugucuuucuaccaccucccagaagacaaccuggcugccuguccugcucgggagccugggaugcaaaccgcuugccauguuucugauugcugagaauaagaucuggggcagaaaaucuuggccccucaacgaaggcauuauggccguggggguuguguccauccugcucagcucccugcuuaagaacgaugucccucuggcgggaccccugaucgccggcgggaugcucauugcuuguuacgugaucagcggaucuagcgccgaccugucccuugagaaagcugccgagguuucuugggaagaggaagccgagcauagcggcgcuucccacaauauucugguggaaguccaggaugacgggacaaugaagaucaaagaugaggagcgggacgauacgcucaccauucugcucaaggcgacacugcuugccgugucuggagucuauccucugagcauccccgcuacccuguucgugugguacuuuuggcaaaagaaaaagcagcgcuccggcguucucugggacacaccuucucccccggaaguggagagagccguccuggaugacggcaucuaucggauuaugcagcgcgggcuucugggaagaagccaggugggcguugggguguuccaagaaaacgucuuccacaccauguggcaugugacgcggggagccgugcucauguaccagggcaaacgccuggagccuuccugggcuagcguuaagaaagaccucaucucuuaugggggaggcuggagacugcagggcuccuggaauaccggggaggaaguccaggugauugccguggagcccggaaagaacccuaagaauguccaaacagcgcccggcaccuuuaaaacaccggaaggggaggugggagcuaucgcccuugauuucaagccuggcaccagcgggucucccauuguuaaccgggaaggaaaaaucgugggccuguacggcaauggggucgugacaacguccggaaccuacguuagcgccauugcucaggccaaggcgucccaggagggcccucugcccgagaucgaagacgagguguuuagaaaacgcaaccucacaaucauggaucugcaccccgggucuggaaagacccggagauaucuuccugcuauuguccgcgaagccaucaagcggaaacugagaacccucauucuggccccgacacgcgugguugcuagcgagauggccgaagcucugaagggcaugcccauccgguaccaaacgaccgccgugaaauccgagcauacagggaaggagauugucgaccucaugugccacgcgaccuucacaaugagacuucugagcccugugcgcgugcccaauuauaacaugaucaucauggaugaagcccauuuuaccgacccuucuuccauugcugcccggggcuacaucagcacgagagucggaaugggcgaggcugccgccauuuucaugacagcuacacccccugggucuguugaagcguuuccgcagagcaaugccgugauccaggaugaggaacgggacauucccgagcgcuccuggaacucuggauaugaguggaucaccgauuucccuggcaaaacagugugguuuguccccagcaucaaguccgggaaugacauugcuaacugucugagaaagaauggaaaacgggugauccagcucucucgcaagaccuucgauacagaauaccagaagaccaagaacaacgacugggacuauguugugacgacagauauuagcgagaugggcgccaauuuuagagccgaccgggucaucgauccuagacgcugccugaaacccgugauucuuaaggacgggccggaacggguuauccuggcuggcccuaugcccgugaccgucgccuccgcggcucagagacgcggacggauuggcagaaaccacaauaaggagggggaucaguacaucuacaugggacagccccucaacaaugacgaggaucacgcccauuggacagaagccaaaaugcugcuggacaacaucaauaccccugagggcauuauccccgcucucuucgaaccugagcgcgaaaagagcgccgcgauugauggggaguaucggcuuagaggagaggcccgcaaaacguucguggaacugaugagacggggcgaccugccggucuggcucucuuacaagguggcuuccgagggguuucaauauagcgaucgcagauggugcuucgacggcgaacggaacaaucagguucuggaggaaaacauggauguggagaucuggaccaaagagggagaacgcaagaaacuuagaccccgguggcuggacgccagaacauacuccgacccucucgcucugcgcgaguuuaaggaguucgccgcuggccggagaucugugagcggggaucugauucucgagaucggaaaacuuccccagcaccugacccagcgcgcccaaaaugcgcuggacaaccucgucaugcugcauaauuccgaacagggcgggcgggccuauagacacgcuauggaggagcuuccugauacaaucgaaacccugaugcuccuggcccugauugcuguucucacaggaggcgugacccucuuuuuccugucuggccgggggcugggaaaaacgagcaucggccuccugugugugauggccuccagcguccuucuguggauggccucuguggagccccacuggauugcugcguccaucauucucgaauuuuuccugaugguucugcucaucccggagccugaccgccagagaacaccccaggauaaccaacuugccuacguggucaucgggcugcuguuuaugauucucaccguggcugccaaugagaugggacugcuugaaaccacaaagaaagaccugggcaucgggcaugucgccguggagaaccaccaucacgcuaccaugcucgauguugaccugcauccugccagcgcguggacacuguaugccguggcuacgaccauuaucacacccaugaugcggcacaccauugaaaacacaaccgccaauaucucucucacggcuauugccaaccaggcggccauccuuaugggacuggauaagggcuggccuaucuccaaaauggacauuggcgucccccugcucgcucuggggugcuacagccaggugaauccgcuuacccugacagccgcuguucucaugcugguggcccacuacgcuaucauuggaccuggccugcaagccaaggcgacccgcgaggcccagaagagaacagcugccgggaucaugaaaaaccccaccgucgauggaauuguggcuaucgaccucgaucccgugguuuaugacgccaaguucgaaaaacagcuuggccagaucaugcugcugauucucuguacgucucaaauccugcuuaugcggacaaccugggcccugugcgagagcauuacacucgcgaccgggccucugaccacacugugggagggauccccgggcaaguuuuggaauacgaccaucgcugucucuauggccaacauuuuccgcggcagcuaccucgcuggggccggacuugccuuuucccugaugaaaagccugggcgggggaagacggggcacaggggcucagggagaaacccucggcgagaaguggaagcgccagcugaaucagcuuuccaaaucugaguucaacaucuauaagagaagcggcaucauggagguggaccgguccgaagccaaagaggggcugaagagaggagagacaacccgccaugcggugucucggggcacggccaaacucagaugguucgucgaacgcaaucugguuaagcccgaggggaaggugauugaucugggauguggcagagggggauggagcuacuauugcgcuggccucaaaaaggugacagaagucaaaggcuacaccaaagggggaccuggccacgaggaacccaucccuauggccaccuauggguggaaccuugugaaacugcauuccggaaaggacguguuuuucacacccccugagaaaugugauacccugcucugcgacauuggcgagucuagcccgaaucccacaaucgaagaggggagaacgcugcgcguucuuaagauggucgaaccuuggcugcggggaaaccaauuuuguauuaagauccucaaucccuacaugccuuccgugguugagacccuggagcagaugcagagaaaacacggcggcaugcuggugcgcaacccccucagcagaaauucuacacacgaaauguacugggucuccugcgggaccggaaacauugugagcgcugugaauaugacaucuagaaugcugcuuaaccgcuucaccauggcccaucggaagccgacguaugagagagaugucgaccugggcgcggggacccgccacguugccguggaaccugagguggcuaaccucgauaucaucggacagagaauugaaaauaucaaacaugagcacaaguccacauggcauuacgacgaggauaaccccuauaaaaccugggccuaccacggcagcuaugaagucaagcccucuggguccgcuagcuccauggugaauggaguugugaagcugcuuacaaaaccuugggacgucauucccauggugacccaaaucgccaugacagauaccacgccuuuuggccagcagcggguuuucaaggagaaaguggacacacgcaccccgaaggcuaaaagaggcaccgcccaaauuauggaagucacagcgcgguggcuguggggguuucucagcagaaacaagaagccccggaucuguacgcgcgaggaguucaccagaaaagugcggucuaaugccgcuaucggagccguuuuuguggacgagaaccaguggaauagcgcuaaggaggccgucgaagaugagcgcuucugggaccuggugcagaaagaaagagagcugcacaagcagggcaaaugcgccacaugcgucuacaacaugauggggaagcgggaaaagaaacucggagaguuuggcaaggcgaaagggucccgcgcuauuugguauauguggcugggcgccagauuccuugaguuugaagcccugggauucaugaaugaggaucauugguucucucgggaaaacagccucuccggcguggagggggagggacugcacaaacuuggcuacauccugcgcgacauuucuaaaaucccugggggaaauauguacgcugaugacaccgccggcugggauacaagaauuaccgaagacgaucuccaaaacgaggcucggaucacagacaucauggaacccgagcaugcccugcuggcgaccagcauuuuuaagcucacguaucagaauaaaguugugcgcguccagagaccugccaagaacgggaccgugauggaugugaucucccggcgcgaccagagaggcucuggacaaguuggcacauacgggcugaauaccuucacaaacauggaagcucagcuuauucggcagauggagagcgagggaaucuuucugcccuccgaacucgagacccagaaccuggccgaaagagugcuugauuggcuggagaaguauggcgucgaacgccucaaacggauggcuauuagcggggacgacugugugguuaagccgaucgaugacagauucgccacggcgcugacagcccugaaugauaugggaaaagugcgcaaggacaucccucaaugggagcccucuaaaggcuggaacgauuggcagcaggucccuuuuugcucccaccacuuccaucagcucauuaugaaggacgggcgggagaucgugguccccuguagaaaucaagaugaacuggugggccgcgcucggguuagccagggagccggcuggucucuuagagagaccgcuugccuggggaaguccuacgcccagauguggcaacucauguauuuucaccgccgggaccugagacuugcugccaacgcgauuuguagcgccgugccugucgauugggugcccacaucccgcaccacguggucuauccaugcucaccaucaguggaugaccacagaagacaugcugagcguuuggaaucggguguggauugaggaaaacccguggauggaggauaaaacccacgucuccagcuggggagacgugccuuaccucggcaagagagaggaccaguggugcgggucucugaucggacugacagcccgggccaccugggcuuccaauauucagguggccaucaaccaaguuagacgccucaucggcaaugaaaacuaucuggauuacaugacaagcaugaaacgguucaagaaugagggggaccccgaaggcgcgcuuugguga

SEQ ID NO: 19030 - RNA, 9879 nt, Artificial Sequence
  derived and/or modified CDS sequence (opt5) from DENV-1__GQ199785__SS-prME
agcgugaccaugcugcucaugcugaugcccacggcccuugcuuuccaccugacgaccagaggcggggaaccucauaugaucgucuccaagcaggaacggggaaagucucuccuguuuaagaccagcgccggcguuaauaugugcacccuuaucgcgauggaccugggggagcucugugaagauacaaugaccuacaagugcccgagaaucacagagguggaacccgacgauguggacuguuggugcaauaccacggauaccugggucacauauggaaccuguucccaaacaggcgagcaccggcgggacaagcgcucuguggcucuggccccucauguugggcugggacucgagaccagagccgaaacguggaugagcuccgagggcgcuuggaagcagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaggauaagcccacacuggacaucgaacugcucaaaaccgagguuacaaacccugcugugcugcggaaacuuugcauugaagccaaaaucuccaauaccacgacagauagccgcuguccgacccaaggagaggcgacccugguggaagaacaggacgccaacuucgucugcagacggacauuuguggaucgcggcuggggcaauggguguggacucuucggcaaggggucucugauuaccugcgcuaaguuuaaaugcguuacaaaacuugagggaaaaaucgugcaguacgaaaaccugaaguauuccgucaucgugacgguucacaccggcgaccagcaucaaguggggaaugagagcacagaacacggaaccacagccaccauuacgccccaggcuccuaccucugagauccagcucacagacuacggcgcccugacccuggauuguucccccagaacaggccucgacuucaacgaaaugguccugcuuaccaugaaagaaaaguccuggcuggugcauaaacagugguuucucgaucugccucuucccuggacguccggggccucuacaagccaagagaccuggaaucggcaggaccugcucgucacauucaagaccgcucacgcgaagaaacaggaagugguugugcugggaucccaagagggcgccaugcacaccgcucugacaggggccacggaaauucagaccagcggaacaaccacaaucuuugccggccaucucaagugccgccugaaaauggauaaacuuacccugaaagggaugucuuaugucauguguacgggcuccuucaagcucgagaaggaaguggcugagacacagcacggaaccguucuggugcagauuaaauacgagggcaccgacgccccgugcaagaucccuuucagcacacaagaugaaaaaggggucacccagaacggaagacugaucacagcgaaucccauugugacggacaaggagaaaccugugaacaucgaagcugagccgcccuuuggcgagucuuauauuguuaucggggccggagaaaaggcccuuaagcucagcugguucaaaaagggcuccucuauugggaaaauguuugaggcuaccgcccggggcgcuagacgcauggccauccugggagauacagcgugggacuucggcagcaucgggggagucuuuaccuccgugggcaagcuggugcaucagauuuucgggacagccuacggaguccucuuuagcggcgugucuuggaccaugaaaaucgggauuggcguucugcuuacguggcugggacucaauucccggagcaccucucuguccaugacauguaucgcugugggccuggucacccuuuaccucggggugaugguucaggccgauagcggaugcgugauuaacuggaagggcagagaacugaaguguggguccggaaucuucgucacaaaugaggugcacaccuggacagaacaauauaaauuucaggcugacucuccuaagcgccugagcgccgcgauuggcaaagccugggaggaggggguuugcggcauccgguccgcuaccagacucgaaaacaucauguggcgccagauuucuaacgagcugaaucauauccuucuggaaaacgacaugaaguucacgguggucgugggagauguggucggcauucucgcccaggggaaaaagaugauccggccgcaacccauggagcacaaauacagcuggaaguccuggggaaaggcuaaaauuaucggcgccgacguucagaauacaaccuuuaucauugaugggccuaacacccccgaauguccugacgaucagagagccuggaauaucugggagguggaggacuauggauucggcauuuuuacaaccaacaucuggcugaagcugcgcgauagcuacacacaggugugcgaccaccggcuuaugucugcugcgauuaaagauuccaaggccguccaugcugacaugggcuauuggaucgaaagcgagaaaaaugaaacauggaagcucgccagagccucuuucaucgaggugaagaccuguauuuggcccaaaucccacacacuguggagcaacgggguucuggaaucugagaugaucauuccgaagaucuacggaggcccuauuagccaacauaauuaucgccccggguacuucacccagacagcuggaccuuggcaccucggcaaacuggagcuugauuuugaccugugcgaagggaccacgguggucguggaugagcacugcggaaaccggggccccucccucagaaccacaaccguuacaggcaagaucauccaugaaugguguugccggagcuguacccugccuccccugcgcuucaaaggggaggacggaugcugguacggcauggagauuagaccggugaaggaaaaggaggaaaaucuugucaaaucuaugguguccgccgggagcggagagguugacuccuuuucucucggccugcuguguaucagcauuaugaucgaagaggugaugcgguccagauggucucgcaagaugcucaugacggggacacuggcggucuucuuucuucugauuaugggacagcucaccuggaacgaucugauccggagcugcauuauggugggcgcuaaugccuccgacagaaugggcauggggacaaccuaucuggcccuuauggcuaccuucaaaaugcgcccuauguuugccgugggacuccuguucagacggcugacaucucgcgagguccuccugcuuacgaucggccugagccucguugcguccguggaacugcccaacagccuggaggaacuuggggauggacuggcuaugggcaucaugauucucaagcugcucaccgacuuucaaucuuaccagcugugggccacacuucugucccucaccuucaucaaaacaaccuuuagccugcacuaugccuggaagacgauggcuauggugcugucuauugucucccuucugccccucugucugagcacaaccucucagaagaccacauggcucccugugcugcuugggucccugggaugcaaaccgcugaccauguuccucaucgccgagaauaagauuuggggcagaaaaagcuggccccugaacgaaggcaucauggcuguugggaucguguccauucuucugagcucucuccugaagaacgaugucccucucgccggaccccugaucgcgggcgggaugcuuauugccuguuacgugaucagcggauccucugcugaccugagccuggagaaagccgcugagguuuccugggaagaggaagccgagcauucuggcgccagccacaauauucucguggaaguccaggaugacgggacaaugaagaucaaagaugaggagcgggacgauacgcugaccauccuucugaaggcuacacuccuggcgguguccggagucuauccucucucuauucccgccacccuguuugugugguacuucuggcaaaagaaaaagcagcgcagcggcguucuuugggacacaccuagcccucccgaaguggagagagcuguccuggaugacggcaucuaucggauuaugcagcgcgggcugcucggaagaagccaggugggcguugggguguuccaagaaaacgucuuucauaccauguggcacgugacgcggggagccgugcugauguaccagggcaaacgccuugagcccucuugggccuccguuaagaaagaccugaucagcuacgggggaggcuggagacuccagggcucuuggaauaccggggaggaaguccaggugauugcuguggagcccggaaagaacccuaagaauguccaaacagcccccggcaccuucaaaacaccggaaggggaggugggagcgaucgcucuggauuuuaagccuggcaccuccgggagccccauuguuaaccgggaaggaaaaaucgugggccucuauggcaauggggucgugacaacguccggaaccuacguuucugccaucgcccaggcuaaggccagccaggagggcccucugcccgagauugaagacgagguguucagaaaacgcaaccuuacaaucauggaucugcaccccggguccggaaagacccggagauaucugccugcgauuguccgcgaagcuaucaagcggaaacucagaacccugauucuugccccgacacgcgugguugccagcgagauggcugaagcccugaagggcaugcccauccgguaccaaacgaccgcugugaaaucugagcauacagggagagagaucgucgaccucaugugccacgccaccuuuacaaugcgccugcuguccccugugcgggugcccaauuauaacaugauuaucauggaugaagcgcauuucaccgacccuagcucuauugccgcuagaggcuacaucagcacgcgggucggaaugggcgaggccgcugccauuuuuaugacagccacacccccuggguccguugaggcuuucccgcagucuaaugcggugauccaggaugaggaacgcgacauccccgagagaagcuggaacuccggauaugaguggauuaccgauuuuccuggcaagacagugugguucguccccucuaucaaaagcgggaaugacauugccaacugucuccggaagaauggaaagcgcgugauccagcuuuccagaaaaaccuuugauacagaauaccaaaagaccaaaaacaacgacugggacuacguugugacgacagauauuagcgagaugggcgcuaauuuccgggccgacagagucaucgauccucgccggugccugaagcccgugauucugaaagacgggccggaaagaguuauccucgccggcccuaugcccgugaccgucgcuucugccgcgcagcgccggggaagaaucggccgcaaccacaauaaggagggggaucaguauauuuacaugggacagccccugaacaaugacgaggaucaugcucacuggacagaagccaagaugcuucuggacaacaucaauaccccugagggcauuauccccgcccucuucgaaccugagcgggaaaaauccgcugccauugauggggaguauagacugcgcggagaggcgagaaagacguuuguggaacugaugcggcgcggcgaccucccggucuggcuuagcuacaaaguggccuccgagggguuccaauauucugauagacgguggugcuuugacggcgaacgcaacaaucagguucuggaggaaaacauggauguggagaucuggaccaaggagggagaacgcaagaagcugcggcccagauggcucgacgcucgcacauacagcgacccucuggcccuucgggaguucaaagaauuugcugccggcagacgcuccgugucuggggaucugauccucgagauuggaaagcugccccagcaccugacccagcgggcucaaaaugcccucgacaaccuugucaugcugcauaauagcgaacagggcgggagagcguaucggcacgccauggaggagcugccugauacaaucgaaacccucaugcugcuugcucugauugccguucucacaggaggcgugacccuguucuuucuguccggcaaggggcucggaaaaacgagcaucggccuucugugugugauggcuucuuccgcccugcucuggauggccagcgucgagccccauuggauugcugcgucuaucauccuggaguucuuucuuauggugcugcucauuccggagccugaccgccagagaacaccccaggauaaccaacuggccuacguugugaucgggcuccuguucaugauucuuaccgucgcugccaaugagaugggacugcuggaaaccacaaagaaagaccucggcaucgggcacguggccgucgagaaccaccaucacgcuaccaugcuggauguggaccuucauccugccuccgcguggacacuguacgccguugcuacgaccauuaucacacccaugaugcggcacaccauugaaaacacaaccgccaauaucagccucacggcuaucgccaaccaggcggccauucugaugggacuggauaagggcuggccuaucucuaaaauggacauuggcgugccccuccuugcucuggggugcuauagccaggucaauccgcugacccucacagccgcugugcugaugcuuguugcccauuacgcuaucauuggaccuggccugcaagccaaggcgacccgcgaggcccagaagagaacagcugccgggaucaugaaaaaccccaccguggauggaaucgucgcuauugaccucgaucccgugguguaugacgccaaguuugaaaaacagcugggccagaucaugcugcucauucuuuguacgucccaaauccugcugaugcggacaaccugggcccucugcgagucuauuacacuggcgaccgggccucuuaccacacugugggagggaagcccgggcaaguucuggaauacgaccaucgcuguuuccauggccaacaucuuucgcggcagcuaccucgcuggggccggacuggccuucucccugaugaaaucucucggcgggggaagacggggcacaggggcucagggagaaacccuuggcgagaaguggaagcgccagcugaaucagcugagcaaauccgaguucaacacauauaagagaucuggcauuauggaggucgaccggagcgaagccaaagaggggcucagacgcggagagaccacgaagcacgcggugucccggggcacagccaaacugagaugguuuguggaacgcaaucuugucaagcccgaggggaagguuaucgaucugggauguggcagagggggauggucuuacuauugcgcuggccucaaaaaggugaccgaagugaaaggcuacaccaaagggggaccuggccacgaggaacccauuccuauggccacauacggguggaaccuggucaaacugcauagcggaaaggacguguucuuuauucccccugagaaaugugauacccuccuuugcgacauuggcgaguccagcccgaaucccacaaucgaagaggggagaacgcugcgcguucugaagaugguggaaccuuggcuccggggaaaccaauucuguauuaagauccugaaucccuauaugccuucugucguggagacccuugagcagaugcagagaaaacacggcggcaugcugguucgcaacccccucucccggaauagcacacaugaaauguacugggugucuugcgggaccggaaacaucgucuccgcugugaauaugacaagcagaaugcugcugaaccgcuuuaccauggcccaccggaagccgacguaugagagagauguggaccucggcgcggggacccgccacgucgccguugaaccugagguggcuaaccuggauauuaucggacagagaauugaaaauaucaaacaugagcacaagucuacauggcauuacgacgaggauaaccccuauaaaaccugggccuaccacggcuccuaugaagugaagcccagcggguccgcuagcucuauggucaauggagugguuaaacuucugacaaaaccuugggacgugauucccauggucacccaaaucgccaugacagauaccacgccuuucggccagcagcggguguuuaaggagaaaguugacacacgcaccccgaaggcuaaaagaggcaccgcccaaaucauggaagugacagcgaaguggcucuggggguuccugagccggaacaagaaacccagaauuuguacgcgggaggaauuuacccgcaaggucagauccaaugccgcuaucggagccguguucguugacgagaaccaguggaacucugcuaaagaggccguggaagaugagcgguuuugggaccuuguccaucgcgaaagagagcugcacaagcagggcaaaugcgccacaugcguguacaacaugauggggaagcgggaaaagaaacucggagaguucggcaaggcgaaagggagccgcgcuauuugguacauguggcugggcgccagauuucuggaguucgaagcccucggauucaugaaugaggaucacugguuuucccgggaaaacucucugagcggcgucgagggggagggacuucauaagcugggcuauauccuccgcgacauuuccaaaaucccugggggaaauauguacgcugaugacaccgccggcugggauacaagaaucaccgaagacgaucugcagaacgaggcuaagauuacagacaucaugaaacccgaacacgcccuucuggcgaccucuauuuucaagcucacguaucaaaauaaggugguucgggugcagcgcccugccagaaacgggaccgucauggaugugaucagccggcgcgaccagagaggcuccggacaggugggcacauacgggcugaauaccuuuacaaacauggaggcucaacugauucggcagauggaaagcgagggaaucuucucucccuccgagcucgaaaccccgaaccuggccgagagaguucuugauuggcuggaaaaacauggcguggagcgccucaagcggauggcuaucagcggggacgacugugucgugaaaccuauugaugacagauuugccacggcgcugucugcccuuaaugauaugggaaagguucgcaaagacaucccccagugggaaccuuccaagggcuggaacgauuggcagcaagugcccuucugcagccaccacuuucaucagcugauuaugaaggacgggcgggagaucgucgugccuuguagaaaucaggaugagcucgucggccgcgcucgggugucccagggagccggcuggucucugagagaaacagcuugccuggggaaaagcuaugcccaaauguggcagcucauguacuuccaccgccgggaccugagacuugcugccaacgcgauuuguuccgccguucccguggauugggucccgaccagccgcacaaccuggucuauccaugcucaccaucaguggaugacgaccgaggacaugcuguccguguggaaucggguuuggauugaagagaacccuuggauggaagauaagacacacaucagcucuuggggagacgugcccuaucucggcaaaagagaggaccaauggugcgggagccugaucggacuuaccgcccgggccacaugggcuaccaauauucaggucgccaucaaccaggugagacgccugauuggcaaugagaacuaccucgauuacaugacauccaugaagcgguuuaaaaaugaaucugaccccgagggggcgcugugguga

SEQ ID NO: 19031 - RNA, 9879 nt, Artificial Sequence
  derived and/or modified CDS sequence (opt5) from DENV-1__GQ199786__SS-prME
agcgugaccaugcugcucaugcugaugcccacagcccuugcuuuccaccugacgaccagaggcggggaaccucauaugaucgucuccaagcaggaacgggggaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuugggagccugggaugcaagccgcugacgauguuucucaucgcugagaauaaaauuuggggccggcgcucuuggccccugaacgaaggcaucauggccgucgggaucguguccauucuucugagcucccuccugaagaacgauguuccucucgcgggaccccugaucgccggcgggaugcuuauugcuuguuacgugaucagcggaucuagcgccgaccugucccuggagaaagcugccgaggucucuugggaagaggaagccgagcauagcggcgcuucccacaauauucucguggaaguucaggaugacgggaccaugaagaucaaagaugaggagagagacgauacacugaccauccuucugaaggcgacacuccuggccgugucuggagucuauccucucagcauucccgcuacccuguucgugugguacuucuggcagaagaagaagcagcgguccggcguccuuugggacacgccuucucccccggaaguggagcgcgccguucuggaugacggcaucuauagaauuaugcagcgggggcugcucggacgcagccaggugggcgucgggguguuucaagaaaacguuuuccauaccauguggcacgugacaagaggagccguccugauguaccagggcaaacggcuugagccuuccugggcuagcgugaagaaagaccugaucucuuacgggggaggcuggagacuccagggcuccuggaauaccggggaggaagugcagguuauugccgucgagcccggaaagaacccuaaaaaugugcaaacagcgcccggcaccuuuaagacaccggaaggggaggugggagcuaucgcccuggauuucaagccuggcacgagcgggucucccauugucaaccgcgaaggaaaaaucgugggccucuauggcaaugggguugugaccacauccggaaccuacgucagcgccaucgcucaggccaaggcgucccaggagggcccucugcccgagauugaagacgagguguuucggaaaagaaaccuuaccaucauggaucugcaccccgggucuggaaagacacgccgguaucugccugcuauuguuagagaagccaucaaacgcaagcuccggacgcugauucuugccccgaccagaguggucgcuagcgagauggccgaagcucugaagggcaugcccauccgcuaccaaacaaccgccgugaaauccgagcauacagggaaggagaucguugaccucaugugccacgcgaccuucacgaugcggcugcugagcccugugagaguccccaauuauaacaugauuaucauggaugaagcccauuuuacagacccuucuuccauugcugcccggggcuacaucagcacccgcgugggaaugggcgaggcugccgccauuuucaugaccgcuacacccccugggucuguggaagcguuuccgcagagcaaugccgucauccaggaugaggaaagagacauccccgagcgguccuggaacucuggauaugaguggauuaccgauuucccuggcaaaacaguuugguuugugcccagcaucaaguccgggaaugacauugcuaacugucuccgcaaaaauggaaagagagugauccagcuuucucggaagaccuucgauacggaauaccagaaaaccaagaacaacgacugggacuacgucgugaccacagauauuagcgagaugggcgccaauuucagagccgaccgcguuaucgauccucggagaugccugaaacccgugauucugaaggacgggccggaacgcgucauccucgcuggcccuaugcccgugaccguugccuccgcggcucagcggagaggacgcaucggccggaaccacaauaaagagggggaucaguauauuuacaugggacagccccugaacaaugacgaggaucaugcccacuggacggaagccaagaugcuucuggacaacaucaauaccccugagggcauuauccccgcucucuuugaaccugagagagaaaagagcgccgcgauugauggggaguaucgccugagaggagaggcccggaaaacauucguggaacugaugcgcagaggcgaccucccggucuggcuuucuuacaagguggcuuccgagggguuucaauauagcgaucggcgcuggugcuucgacggcgaaagaaacaaucagguccuggaggaaaacauggauguggagaucuggaccaaagagggagaacggaagaaacugagaccccgcuggcucgacgcccggacauacuccgacccucuggcucuuagagaguuuaaggaguucgccgcuggccgccggucuguuagcggggaucugauccucgagauuggaaaacugccccagcaccugacccagagagcccaaaaugcgcucgacaaccuugugaugcugcauaauuccgaacagggcgggcgggccuaucgccacgcuauggaggagcugccugauacaaucgaaacccucaugcugcuugcccugauugcugugcucacgggaggcgucauccuguuuuuccugucuggcagagggcucggaaagacaagcauuggccuucuguguguuauggccuccagcgugcugcucuggauggccucuguggagccccauuggaucgcugcguccaucauucuggaauuuuuccuuaugguccugcucaucccggagccugaccggcagcgcacaccccaggauaaccaacuggccuacgugguuauugggcugcucuuuaugauccuuaccguggcugccaaugagaugggacugcuggaaacaaccaagaaagaccucggcauugggcacgucgccguggagaaccaccaucacgcugccaugcuggaugucgaccuucauccugcgagcgccuggacacuguacgcuguggccacgaccaucauuacacccaugaugagacacaccaucgaaaacacaaccgcuaauaucucucucacggccauugcgaaccaggccgcuauccugaugggacuggauaagggcuggccuauuuccaaaauggacaucggcguuccccuccuugcccuggggugcuauagccaggugaauccgcugacccucacagcugccguccugaugcuuguggcucauuacgccauuaucggaccuggccugcaagcgaaggccacccgggaggcucagaaacgcacagccgcugggaucaugaagaaccccaccguugauggaauuguggccaucgaccucgaucccgucguguaugacgccaaguucgaaaaacagcugggccagauuaugcugcucauccuuuguacgucucaaauucugcugaugagaacaaccugggcgcucugcgagagcaucacacuggcuaccgggccucuuaccacacugugggagggauccccgggcaaguuuuggaauacgaccaucgccgugucuauggcuaacauuuuccggggcagcuaccucgccggggccggacuggcuuucucccugaugaaaagccucggcgggggacgcagaggcacaggggcccagggagaaacccuuggcgagaaguggaaacggcagcugaaucagcuguccaagucugaauuuaacacauauaagagaagcggcaucauggagguugaccgcuccgaagcgaaagaggggcucaagcggggagagaccacgaaacacgccgucucuagaggcacagcuaagcugcgcugguucguggaacggaaucuugugaaacccgaggggaaggucauugaucugggauguggcagagggggauggagcuacuauugcgccggccucaagaaaguuaccgaagugaagggcuacaccaaagggggaccuggccacgaggaacccaucccuauggcuacauacggguggaaccuggugaagcugcauuccggaaaagacgucuuuuucauucccccugagaagugugauacccuccuuugcgacaucggcgagucuagcccgaaucccacaauugaagaggggcgcacgcugcgggugcugaaaaugguugaaccuuggcucagaggaaaccaauuuuguaucaagauccugaaucccuauaugccuuccguggucgagacccuugagcagaugcagcgcaagcacggcggcaugcuggugcggaacccccucagcagaaauucuacacaugaaauguacuggguuuccugcgggaccggaaacauugugagcgccgucaauaugacaucucgcaugcugcugaaccgguucaccauggcgcacagaaaaccgacguaugagcgcgauguggaccucggcgccgggaccagacacguggcugucgaaccugagguugccaaccuggauaucauuggacagcggaucgaaaauauuaagcaugagcacaaauccacauggcauuacgacgaggauaaccccuauaagaccugggcuuaccacggcagcuaugaagugaaacccucuggguccgccagcuccauggugaauggagucgugaaacuucugacaaagccuugggacguuauccccauggugacccaaaucgcuaugacagauaccacgccuuuuggccagcagcgcgucuucaaagagaagguggacacaagaaccccgaaagccaagcggggcaccgcgcaaauuauggaaguuacagccaaauggcucuggggguuucugagcagaaacaagaagccccggaucuguacgcgcgaggaguucaccagaaaagugcggucuaaugcugccauuggagcugucuuuguggacgagaaccaguggaauagcgccaaggaggccguugaagaugagcgcuucugggaccuugugcauagagaacgggagcugcacaaacagggcaagugcgcgacaugcgucuacaacaugauggggaaacgcgaaaagaagcucggagaguuuggcaaagcuaagggguccagagccaucugguacauguggcugggcgcccgguuccuggaguucgaagcucucggauuuaugaaugaggaucacugguucucucgcgaaaacagccuguccggcguggagggggagggacuucauaaacugggcuauauucucagagacaucucuaagaucccugggggaaauauguacgccgaugacaccgcuggcugggauacacggauuaccgaagacgaucugcagaacgaggcccgcaucacagacauuauggaacccgagcacgcgcuucuggccagaagcaucuuuaaacucaccuaucaaaauaaggucgugcggguucagcgcccugcuaaaaacgggacggugauggaugucauuuccagacgggaccagagaggcucuggacaggugggcaccuacgggcugaauacauucaccaacauggaagcccaacugauccgccagauggagagcgagggaaucuuuucccccagcgaacucgagacaccgaaccuggcugaacgggugcuugauuggcuggagaaguauggcguugaaagacucaagcgcauggccauuucuggggacgacuguguggucaaaccuaucgaugaccgguucgcgaccgcccugacggcucuuaaugauaugggaaaggugagaaaagacauuccccagugggagccuuccaagggcuggaacgauuggcagcaaguucccuuuugcagccaucacuuccaccagcugaucaugaaagacgggcgcgagauuguggucccuugucggaaucaggaugaacucgugggcagagcccgcgucucucagggagcuggcuggucccugcgggagacagccugccugggaaagagcuacgcucaaauguggcagcucauguauuuucauagacgcgaccugcggcuugccgcgaacgccaucuguuccgcugugcccguugauuggauuccgaccucuagaacaaccuggagcauccacgcccaucaccaguggaugacgaccgaagacaugcuguccguguggaaucgggucuggaucgaggaaaacccuuggauggaggauaagacacauauuagcucuuggggagacgugcccuaccucggcaaaagagaggaccaauggugcgggucccugaucggacuuaccgcccgcgcuacaugggccaccaauauucagguugcgaucaaccaggugcggagacugauuggcaaugaaaacuaccucgauuauaugacaagcaugaagcgcuucaaaaaugagucugaccccgaaggggcucugugguga

SEQ ID NO: 19032 - RNA, 9879 nt, Artificial Sequence
  derived and/or modified CDS sequence (opt5) from DENV-1__GQ199787__SS-prME
agcgugaccaugcugcucaugcugguccccaccgcccuugcuuuccaccugacgacccggggcggggaaccucauaugaucguuacaaagcaggaacggggaaagucccuucuguuuaagaccucugccggcgugaacaugugcacccuuauugcgauggaccugggggaacucugugaagauaccaugacauacaagugcccccgcaucaccgaggcugaacccgacgauguggacuguuggugcaaugccacggauaccuggguuacauauggaaccuguagccaaacaggcgagcaccggcgggacaagcgcuccguggcccuggcuccucauguugggcugggacucgagaccagaacggaaacauggaugucuagcgagggcgccuggaaacagauucagcggguggaaaccugggcucugcgccaccccggcuucacagucaucgcccuuuuucuggcgcaugccauugggaccuccaucacccagaagggaaucauuuucauccuccugaugcuugugacaccuucuauggcuaugagaugcguuggcauugggagccgggauuuuguggagggacuguccggcgccacgugggucgacguggugcucgagcacgggagcugugucaccacaauggcuaaggauaaacccacccuggacaucgaacugcucaagacagagguuaccaacccugccgugcugcgcaaacuuugcauugaagcgaagaucucuaauacgacaaccgauuccagauguccgacccaaggagaggccacacugauggaagaacaagacgcuaacuucgugugccggcgcaccuuugucgauagaggcuggggcaauggguguggacucuucggcaaagggagccugauuacaugcgccaaguuuaagugcgugacgaaacuugagggaaagaucguucaguacgaaaaccugaaauauucugugaucgucaccgugcacacaggcgaccagcaucaaguugggaaugaguccaccgaacacggaacaaccgcuacgauuacaccccaggccccuacaagcgagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugauccagaacggacggcugauuacagcuaaucccaucgucacggacaaagagaagccugugaacauugaagccgagccgcccuuuggcgagagcuauaucgugauugggguuggagaaaaagcccuuaagcucucuugguucaagaaaggcagcuccaucgggaagauguuugaggcuaccgccagaggcgcucgccggauggccauccugggagauacagcgugggacuucggcucuauugggggagucuuuaccagcgugggcaaacuggugcaucagaucuucgggacagccuacggaguccucuuuuccggcgugagcuggaccaugaagauugggaucggcguucugcuuacguggcugggacucaauucuagauccaccagccugucuaugacauguauugcugugggccuggucacccuuuaccucggggugaugguucaggccgauuccggaugcgugaucaacuggaaaggccgcgaacugaagugugggagcggaauuuucgucacaaaugaggugcacaccuggacagaacaauauaaguuucaggcugacuccccuaaacggcugucugccgcgaucggcaaggccugggaggaggggguuugcggcaucagaagcgcuacccgccucgaaaacauuauguggaaacagaucuccaacgagcugaaucauauucuucuggaaaacgacaugaaguucacgguggucgugggagauguggucggcauccucgcccaggggaaaaagaugauucggccgcaacccauggagcacaaauacucuuggaaaagcuggggaaaggcuaagaucaucggcgccgacguucagaauacaaccuuuauuaucgaugggccuaacacccccgaauguccugacgaucagagagccuggaauauuugggagguggaggacuauggauucggcaucuuuacaaccaacauuuggcugaagcugcgcgauuccuacacgcaggcuugcgaccaccggcuuaugagcgcggccaucaaagauucuaaggcugugcaugccgacaugggcuauuggaucgaauccgagaaaaaugaaacauggaagcucgccagagcuagcuucauugaggucaagaccuguaucuggcccaaaucucacacacugugguccaacggggugcuggaaagcgagaugguuauuccgaagaucuacggaggcccuauuucucaacauaauuaucgccccggguacuucacccagacagccggaccuuggcaccucggcaaacuggagcuugauuuugaccugugcgaagggaccacgguggucguggaugagcacugcggaaaccggggccccagccucagaaccacaaccguuacaggcaagaucauccaugaaugguguugccgguccuguacccugccuccccugcgcuucaaaggggaggacggaugcugguacggcauggagauuagaccggugaaggaaaaggaggaaaaucuugucaaaagcauggugucugcgggguccggagagguugacagcuuuucccucggccugcuguguaucucuauuaugaucgaagaggugaugcggagcagauggucccgcaagaugcucaugacggggacacuggcugucuuccuucugcucauuaugggacagcugaccuggaacgaucugauccggcuuugcauuauggugggcgccaaugccucugacagaaugggcauggggacaaccuaucuggcucucauggccaccuuuaaaaugcgcccuauguucgcggugggacugcucuuuagacggcugacaagccgcgagguccuucugcucacgaucggccugucccugguugcuucuguggaacuucccaacagccuggaggaacucggggauggacuggccaugggcaucaugauucucaagcugcuuaccgacuuccaaucccaccagcugugggccacacuccugagccugaccuuuaucaaaacaacccuuucucugcauuacgcuuggaagacgauggccauggugcucuccauugucagccuguucccccucugucugucuacaaccucccagaagaccacauggcuuccugugcugcuggggagccucggaugcaaaccgcugaccauguuucuuaucgcugagaauaagauuuggggcagaaaaucuuggccccugaacgaaggcaucauggccguugggguggucuccauccuccugagcucccuccugaagaacgaugugccucuugcgggaccccugauugccggcgggaugcugaucgcuuguuauguuauuagcggaucuagcgccgaccucucccuggagaaagcugccgaggugucuugggaagaggaagccgagcacagcggcgcuucccauaauauccuugucgaagugcaggaugacgggacaaugaagauuaaagaugaggagcgggacgauacgcugaccauccuccugaaggcgacacuccuggccgucucuggaguguacccucuuagcauccccgcuacccuguuccugugguauuuuuggcaaaagaaaaagcagcgcuccggcguucucugggacacaccuucucccccggaaguggagagagccguccuggaugacggcauuuaccggaucaugcagcgcgggcuucugggaagaagccaggugggcguugggguguuccaagaaaacgucuuccacaccauguggcacgugacgcggggagccgugcucauguaucagggcaaacgccuggagccuuccugggcuagcguuaagaaagaccucauuucuuacgggggaggcuggagacugcagggcuccuggaauaccggggaggaaguccaggugaucgccguggagcccggaaagaacccuaagaauguccaaacagcgcccggcaccuuuaaaacaccggaaggggaggugggagcuauugcccuugauuucaagccuggcaccagcgggucucccaucguuaaccgggaaggaaaaauugugggccuguacggcaauggggucgugacaacguccggaaccuauguuagcgccaucgcucaggccaaggcgucccaggagggcccucugcccgagaucgaagacgagguguuuagaaaacgcaaccucacaauuauggaucugcaucccgggucuggaaagacccggagauaccuuccugcuaucguccgcgaagccauuaagcggaaacugagaacccucauccuggccccgacacgcgugguugcuagcgagauggccgaagcucugaagggcaugcccauucgguaucaaacgaccgccgugaaauccgagcacacagggaaggagaucgucgaccucaugugccaugcgaccuucacaaugagacuucugagcccugugcgcgugcccaauuacaacaugaucauuauggaugaagcccacuuuaccgacccuucuuccaucgcugcccggggcuauauuagcacgagagucggaaugggcgaggcugccgccaucuucaugacagcuacacccccugggucuguugaagcguuuccgcagagcaaugccgugauucaggaugaggaacgggacauccccgagcgcuccuggaacucuggauacgaguggaucaccgauuucccuggcaaaacagugugguuuguccccagcauuaaguccgggaaugacaucgcuaacugucugagaaagaauggaaaacgggugauucagcucucucgcaagaccuucgauacagaauaucagaagaccaagaacaacgacugggacuacguugugacgacagauaucagcgagaugggcgccaauuuuagagccgaccgggucauugauccuagacgcugccugaaacccgugauccuuaaggacgggccggaacggguuauucuggcuggcccuaugcccgugaccgucgccuccgcggcucagagacgcggacggaucggcagaaaccauaauaaggagggggaucaguacaucuauaugggacagccccucaacaaugacgaggaucacgcccacuggacagaagccaaaaugcugcuggacaacauuaauaccccugagggcaucauucccgcucucuucgaaccugagcgcgaaaagagcgccgcgaucgauggggaguaccggcuuagaggagaggcccgcaaaacguucguggaacugaugagacggggcgaccugccggucuggcucucuuauaagguggcuuccgagggguuucaauacagcgaucgcagauggugcuucgacggcgaacggaacaaucagguucuggaggaaaacauggauguggagauuuggaccaaagagggagaacgcaagaaacuuagaccccgguggcuggacgccagaacauauuccgacccucucgcucugcgcgaguuuaaggaguucgccgcuggccggagaucugugagcggggaucugauccucgagaucggaaaacuuccccagcaucugacccagcgcgcccaaaaugcgcuggacaaccucgucaugcugcacaauuccgaacagggcgggcgggccuacagacaugcuauggaggagcuuccugauacaauugaaacccugaugcuccuggcccugaucgcuguucucacaggaggcgugacccucuuuuuccugucuggccgggggcugggaaaaacgagcauuggccuccugugugugauggccuccagcguccuucuguggauggccucuguggagccccacuggaucgcugcguccauuauccucgaauuuuuccugaugguucugcucaucccggagccugaccgccagagaacaccccaggauaaccaacuugccuauguggucauugggcugcuguuuaugauccucaccguggcugccaaugagaugggacugcuugaaaccacaaagaaagaccugggcauugggcacgucgccguggagaaccaucaccaugcuaccaugcucgauguugaccugcacccugccagcgcguggacacuguacgccguggcuacgaccaucauuacacccaugaugcggcauaccaucgaaaacacaaccgccaauauuucucucacggcuaucgccaaccaggcggccauccuuaugggacuggauaagggcuggccuauuuccaaaauggacaucggcgucccccugcucgcucuggggugcuacagccaggugaauccgcuuacccugacagccgcuguucucaugcugguggcccacuaugcuauuaucggaccuggccugcaagccaaggcgacccgcgaggcccagaagagaacagcugccgggauuaugaaaaaccccaccgucgauggaaucguggcuaucgaccucgaucccgugguuuacgacgccaaguucgaaaaacagcuuggccagauuaugcugcugauccucuguacgucucaaauucugcuuaugcggacaaccugggcccugugcgagagcaucacacucgcgaccgggccucugaccacacugugggagggauccccgggcaaguuuuggaauacgaccauugcugucucuauggccaacaucuuccgcggcagcuaucucgcuggggccggacuugccuuuucccugaugaaaagccugggcgggggaagacggggcacaggggcucagggagaaacccucggcgagaaguggaagcgccagcugaaucagcuuuccaaaucugaguucaacaucuacaagagaagcggcauuauggagguggaccgguccgaagccaaagaggggcugaagagaggagagacaacccgccacgcggugucucggggcacggccaaacucagaugguucgucgaacgcaaucugguuaagcccgaggggaaggugaucgaucugggauguggcagagggggauggagcuauuacugcgcuggccucaaaaaggugacagaagucaaaggcuauaccaaagggggaccuggccaugaggaacccauuccuauggccaccuacggguggaaccuugugaaacugcacuccggaaaggacgucuuuuucacacccccugagaaaugugauacccugcucugcgacaucggcgagucuagcccgaaucccacaauugaagaggggagaacgcugcgcgugcuuaagauggucgaaccuuggcugcggggaaaccaauuuuguaucaagauucucaaucccuacaugccuuccgugguugagacccuggagcagaugcagagaaaacauggcggcaugcuggugcgcaacccccucagcagaaauucuacacacgaaauguauugggucuccugcgggaccggaaacaucgugagcgcugugaauaugacaucuagaaugcugcuuaaccgcuucaccauggcccaccggaagccgacguacgagagagaugucgaccugggcgcggggacccgccauguugccguggaaccugagguggcuaaccucgauaucauuggacagagaaucgaaaauauuaaacacgagcauaaguccacauggcacuaugacgaggauaaccccuacaaaaccugggccuaucauggcagcuacgaagucaagcccucuggguccgcuagcuccauggugaauggaguugugaagcugcuuacaaaaccuugggacgucauccccauggugacccaaauugccaugacagauaccacgccuuuuggccagcagcggguuuucaaggagaaaguggacacacgcaccccgaaggcuaaaagaggcaccgcccaaaucauggaagucacagcgcgguggcuguggggguuucucagcagaaacaagaagccccggaucuguacgcgcgaggaguucaccagaaaagugcggucuaaugccgcuauuggagccguuuuuguggacgagaaccaguggaauagcgcuaaggaggccgucgaagaugagcgcuucugggaccuggugcagaaagaaagagagcugcacaagcagggcaaaugcgccacaugcgucuauaacaugauggggaagcgggaaaagaaacucggagaguuuggcaaggcgaaagggucccgcgcuaucugguacauguggcugggcgccagauuccuugaguuugaagcccugggauucaugaaugaggaucacugguucucucgggaaaacagccucuccggcguggagggggagggacugcauaaacuuggcuacauucugcgcgacaucucuaaaauuccugggggaaauauguaugcugaugacaccgccggcugggauacaagaaucaccgaagacgaucuccaaaacgaggcuaagaucacagacauuauggaacccgagcacgcccugcuggcgaccagcaucuuuaaacucacguaccagaauaagguugugcggguccagcgcccugccaagaacgggaccgugauggaugugauuuccagacgggaccagcgcggcucuggacaaguuggcacauaugggcugaauaccuucacaaacauggaagcucagcuuaucagacagauggagagcgagggaauuuuucugcccuccgaacucgagaccccgaaccuggccgaacgggugcuugauuggcuggagaaacauggcgucgaaagacucaagcgcauggcuaucagcggggacgacugugugguuaaaccuaucgaugaccgguucgccacggcgcugacagcccugaaugauaugggaaaggugagaaaagacauuccccagugggagccuucuaagggcuggaacgauuggcaacagguccccuuuugcucccaccacuuccaucagcucaucaugaaggacgggcgcgagauuguggucccuugucggaaugaagaugagcuggugggcagagcucgcguuagccagggagccggcuggucucuucgggaaaccgcuugccuggggaaauccuacgcccaaauguggcagcucauguauuuucacagacgcgaccugcggcuugcugccaacgcgaucuguagcgccgugcccgucgauugggugccgacauccagaaccacguggucuauucaugcucaccaucaguggaugaccacagaggacaugcugagcguuuggaaucgcguguggaucgaagagaacccuuggauggaggauaagacccacgucuccagcuggggagacgugcccuaccucggcaaacgggaagaccaauggugcgggucucugauuggacugacagccagagccaccugggcuuccaauauccagguggccaucaaccagguucggagacucauuggcaaugagaacuaucuggauuacaugacaagcaugaagcgcuucaaaaaugaaggggaccccgagggcgcgcuuugguga

SEQ ID NO: 19033 - RNA, 9879 nt, Artificial Sequence
  derived and/or modified CDS sequence (opt5) from DENV-1__GQ199788__SS-prME
agcgugaccaugcugcucaugcugaugcccaccgcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucucucacauuuauuaagaccacguucucccugcacuaugccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuacgugauuucuggaagcuccgcugaccuuucucuggagaaggccgccgaggucagcugggaagaggaagcugagcauuccggcgcgucucacaauauccugguggaaguucaggaugacgggacgaugaaaauuaaggaugaggagcgggacgauacccucacaauccugcuuaaggccacccugcucgcugugagcggagucuauccucuguccauccccgccacacucuucgugugguacuuuuggcagaaaaagaaacaacgcucuggcguccugugggacaccccuuccccucccgaaguggagagagccguucuugaugacggcauuuaucggaucaugcagcgcgggcugcugggaagaucccaggugggcgucgggguguuccaggaaaacguuuuucauacgauguggcacgugacccggggagcuguccucauguaccaaggcaagcgccuggagcccagcugggccucugugaaaaaggaccuuauuuccuacgggggaggcuggagacugcagggcagcuggaauacaggggaggaagugcagguuaucgcggucgagcccggaaagaacccuaaaaaugugcagaccgcucccggcacauucaagaccucugaaggggaggugggagccauugcccucgauuuuaaaccgggcacauccgggagcccuaucgucaaccgggaaggaaagauugugggccuguauggcaaugggguugugacgaccuccggaacauacgucucugcuaucgcccaagcgaaagcuagccaggagggcccccucccugagaucgaagacgagguguucagaaagcgcaaccugaccauuauggaucuucaccccggguccggaaagacccggagauaucugcccgccaucguucgcgaagccauuaaacggaagcugagaacacucauccuggcuccuacgcgcguggucgccagcgagauggcugaagcccuuaaaggcaugccgauucgguaccagaccacagcggugaagucugagcauaccgggaaagagaucguugaccugaugugccacgccacauuuaccaugagacuccugucccccgugcgcgucccuaauuauaacaugaucauuauggaugaagcucauuucacggaccccagcucuaucgccgcucggggcuacauuagcacaagagugggaaugggcgaggccgccgcuaucuuuaugaccgcgaccccucccggguccguggaagccuucccucaaucuaaugcugucauucaggaugaggaacgggacaucccggagcgcagcuggaacuccggauaugaguggaucacagauuuucccggcaagaccguuugguucgugccuucuauuaagagcgggaaugacaucgccaacugucugcgcaagaauggaaagcgggugauucagcucucccgcaaaacauucgauaccgaauaccagaagacgaaaaacaacgacugggacuacgucgugacaaccgauaucagcgagaugggcgccaauuuuagagcugaccggguuauugaucccagacgcugccuuaagccugugauccugaaggacgggcccgaacgggucauucuggccggcccgaugccugugacaguugcgucugcugcccaaagacgcggacggaucggcagaaaccacaauaaagagggggaucaguauaucuacaugggacagccccucaacaaugacgaggaucaugcccacuggaccgaagcuaagaugcugcuugacaacauuaauacgcccgagggcaucauuccugcccuguucgaacccgagcgcgaaaaauccgcggccaucgauggggaguaucggcucagaggagaggcucgcaagaccuuuguggaacugaugagacggggcgaccugccugucuggcucagcuacaaaguggccuccgagggguuccaguauucugaucgcagauggugcuuugacggcgaacggaacaaucaaguccuugaggaaaacauggauguggagauuuggacaaaggagggagaacgcaaaaagcugagaccgcgguggcuggacgcuagaaccuacagcgacccccucgcccugcgcgaguucaaggaauuugcugccggccggagauccguuucuggggaucuuauccuggagaucggaaaacucccucagcaccugacacagcgcgcgcagaaugcccuggacaaccucgugaugcuucauaauagcgaacaaggcgggcgggcuuauagacacgccauggaggagcugcccgauaccauugaaacacugaugcuccuggcucuuaucgccgugcugaccggaggcgucacgcuguucuuucuguccggccgggggcugggaaagacaagcauuggccuccuuuguguuauggccucuuccgugcugcuguggauggcuagcguggagccucauuggaucgcggccucuauuauccucgaguucuuucugaugguccuucugauccccgagccggaccgccagagaaccccucaggauaaccagcucgcuuacgugguuauugggcugcuguucaugauccucaccguggccgccaaugagaugggacuucuggaaacaaccaaaaaggaccugggcauugggcacgucgcuguggagaaccaccaucacgccgcgaugcucgaugucgaccugcaucccgccuccgcuuggacacuuuacgccguggcuacgaccaucauuacaccuaugaugcggcacaccaucgaaaacacaaccgccaauauuagccugacggcgaucgccaaccaagcugccauccucaugggacuggauaaaggcuggcccauuucuaagauggacaucggcguuccucugcucgcucuugggugcuauagccaggugaauccccugacccugacagccgcuguccucaugcugguggcccauuacgcgauuaucggaccgggccuucaggccaaggcuacccgcgaggcccagaagagaacagcugccgggauuaugaagaacccuaccguugauggaaucguggccaucgaccuggaucccgucguguaugacgcgaaauuugaaaagcagcucggccagauuaugcugcugauccucuguacgucccagauucuucugaugcggacaaccugggcucugugcgagucuaucacacucgccaccgggccccugaccacacuuugggagggaagcccuggcaaauucuggaauacgaccauugcuguguccauggccaacaucuuccgcggcagcuaccuggccggggcuggacucgccuuuucccugaugaagucucugggcgggggaagacggggcacaggggcgcaaggagaaacccucggcgagaaguggaaacgccagcuuaaucagcugagcaaguccgaguucaacacauauaaaagaucuggcaucauggagguugaccggagcgaagccaaggaggggcugaaaagaggagagaccacgaagcacgcugucucccgcggcacagccaagcuccggugguuuguggaaagaaaucuggugaaaccggaggggaaggucauugaucuuggauguggccgcgggggauggucuuacuauugcgcuggccugaaaaagguuaccgaagugaaaggcuacaccaaagggggacccggccacgaggaaccuauccccauggccacauacggguggaaccucgugaaacugcauagcggaaaggacgucuucuuuauuccucccgagaagugugauacccugcucugcgacaucggcgaguccagcccuaauccgacaauugaagaggggcggacgcuuagagugcugaaaaugguugaacccuggcugcgcggaaaccaguucuguaucaagauucucaauccuuauaugcccucuguggucgagacccuggagcaaaugcagcggaaacacggcggcaugcuugugagaaacccucugucccgcaauagcacacaugaaauguacuggguuucuugcgggaccggaaacaucguguccgcggucaauaugacaagccggaugcuccugaacagauuuaccauggcccaccgcaagcccacguaugagcgggauguggaccugggcgcugggaccagacacguggccgucgaaccggagguugcuaaccucgauaucauuggacagcgcaucgaaaauauuaaacaugagcacaagucuacauggcauuacgacgaggauaacccuuauaagaccugggccuaccacggcuccuaugaagugaaacccagcggguccgcuagcucuauggugaauggagucgugaagcugcuuacaaaacccugggacguuaucccuauggugacccagauugccaugacagauaccacgcccuucggccaacagagagucuuuaaggagaaaguggacacacggaccccuaaggcgaagcgcggcaccgcccagaucauggaaguuacagcuaaauggcuguggggguuccucagcagaaacaagaaaccgcggaucuguacgagagaggaauuuacccggaaggugcgcuccaaugccgcuauuggagccgucuucguggacgagaaccaauggaacucugccaaagaggcgguugaagaugagagauuuugggaccuggugcaucgggaacgcgagcuucacaagcagggcaagugcgcuacaugcgucuacaacaugauggggaaaagagaaaagaaacugggagaguucggcaaggccaaagggagccgggccaucugguacauguggcucggcgcucgcuuccuggaguuugaagcccugggauucaugaaugaggaucacugguuuuccagagaaaacucucucagcggcguggagggggagggacugcauaaacuuggcuauauucugcgggacaucuccaaaauucccgggggaaauauguacgcugaugacaccgccggcugggauacacgcaucaccgaagacgaucuccagaacgaggcgaagaucacagacauuauggaaccugagcacgcccugcuugcuaagucuaucuucaaacugaccuaucagaauaaggucgugagaguucaacggcccgccaaaaacgggacggugauggaugucauuagccgcagagaccagcggggcuccggacaggugggcaccuacgggcucaauacauuuaccaacauggaagcucagcugauccgccaaauggagagcgagggaauuuucucuccuuccgaacuggagacacccaaccucgccagacgggugcuggauuggcuugaaaagcauggcguugagagacugaaacgcauggcgaucagcggggacgacuguguggucaagccgaucgaugaccgguuugccaccgcucucacggcccugaaugauaugggaaaggugagaaaagacauuccucagugggaacccucuaagggcuggaacgauuggcagcagguuccuuucugcucccaccacuuucaucaacuuaucaugaaagacgggcgcgagauugugguccccugucggaaucaggaugagcuggugggcagagcucgcgucagccagggagccggcuggucccuccgggaaacagcuugccuggggaagucuuaugcccagauguggcaacugauguacuuccacagacgcgaccuccggcuggcggccaacgcuaucuguagcgccgugccuguugauugggugcccaccuccagaacaaccuggagcauucaugcccaccaucaguggaugacgaccgaggacaugcuuucugucuggaaucgcguguggaucgaagagaacccguggauggaagauaaaacacacauuuccagcuggggagacguuccuuaucugggcaagcgggaggaccaguggugcgggucucucaucggacugaccgcuagagccacaugggcgaccaauauccaaguggcuauuaaccagguccggagacuuaucggcaaugagaacuaccuggauuacaugacaagcaugaagcgcuuuaaaaaugaauccgaccccgagggggcccucugguga

SEQ ID NO: 19034 - RNA, 9879 nt, Artificial Sequence
  derived and/or modified CDS sequence (opt5) from DENV-1__GQ199789__SS-prME
agcgugaccaugcugcugaugcugaugcccaccgcccuugcuuuccaccugacgaccagaggaggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagaagguugaaacaugggcucuccggcaccccggcuuuaccgugaucgcccuguuccuugcgcaugccauugggacaucuaucacccagaagggaaucauuuuuauccugcucaugcuggucaccccuagcauggcuaugcgcugcgugggcauuggguccagagauuucguugagggacuuagcggcgccacauggguggacgucgugcuggagcacgggucuugugugacgaccauggcuaaagauaagcccacacucgacaucgaacugcugaaaaccgaggucacaaacccugccguucuccggaagcugugcauugaagcgaaaaucuccaauaccacgacagauagccgcuguccgacccaaggagaggccacccuuguggaagaacaggacgcuaacuuugugugcagacggacauucgucgaucgcggcuggggcaauggguguggacuguuuggcaaggggucucucauuaccugcgccaaguucaaaugcgugacaaagcuggagggaaaaacgguucagcacgaaaaccuuaaguacuccgugaucgucaccgugcauacaggcgaccagcaccaaguugggaaugagagcaccgaacauggaacaaccgcuacgaucacaccccaggccccuucuacagagauucagcugaccgacuauggcgcccucacacuggauuguucccccagaaccggccuggacuuuaacgaaauggugcuccugacgaugaaagaaaagagcuggcuuguccacaaacagugguuccuggaucucccucugcccuggacauccggggcuucuaccagccaagagacauggaaucggaaggaccuucuggugaccuuuaagaccgcgcacgccaaaaagcaggaagucgugguucucggaucccaggagggcgcuaugcauacagcccugacgggggccaccgaaauccaaacaagcggaaccacaaccauuuucgcuggccaccugaaaugccgccucaagauggauaaacugacgcuuaaggggacaucuuacgugauguguaccggcuccuucaagcuggagaaagaagucgccgagacccagcauggaacagugcucguucagaucaaguaugagggcaccgacgcgccgugcaaaauuccuuuuagcacacaggaugaaaagggggugacgcaaaacggaagacugaucaccgcuaaucccaucgucacagacaaagagaagccugugaacauugaagccgagccgcccuucggcgagucuuacaucgugauuggggccggagaaaaggcucugaaacuuagcugguuuaagaaaggcuccucuaucgggaagauguucgaggccaccgcucggggcgccagacgcauggcgauucucggagauacagccugggacuuuggcagcaucgggggaguuuucaccuccgucggcaaacuggugcaccagaucuuugggacggcuuauggagugcuguucagcggcgucucuuggaccaugaagauugggaucggcgugcuccugacauggcuuggacucaauucccggagcaccucucucuccaugacauguauugccguuggccuggugacccuguaccuuggggucauggugcaggcugauagcggaugcguuaucaacuggaagggcagagaacucaaauguggguccggaauuuuugugacaaaugagguccauaccuggacggaacaguacaaguuccaagccgacucuccuaaacgccugagcgcggccaucggcaaggcuugggaggagggggugugcggcauucgguccgccacaagacuggaaaacaucauguggaaacagaucucuaacgagcucaaucacauucugcuugaaaacgacaugaaguuuaccguuguggucggagauguggcuggcauccuggcccaggggaaaaagaugauucgcccgcagcccauggaguauaaguacagcuggaaauccuggggaaaggccaaaaucauuggcgcugacgugcaaaauaccacauucaucaucgaugggccuaacacccccgaauguccugacgaucagcgggcguggaauauuugggaggucgaggacuauggauuuggcaucuucacgacaaacauuuggcucaagcugagagauagcuacacccagguuugcgaccaccgccugaugucugccgcuaucaaagauuccaaggccgugcaugccgacaugggcuauuggauugaaagcgagaagaaugaaacauggaaacuugcucgggccucuuucaucgaggugaagaccuguaucuggcccaaaucccacacacucuggagcaacgggguccuggaaucugagaugauuaucccgaagauuuacggaggcccuaccagccagcauaauuauagacccggguacuuuacgcaaaccgcgggaccuuggcaccugggcaaacucgagcuggauuucgaccuuugcgaagggacaaccgugguuguggaugagcacugcggaaaccgcggccccucccugcggacaaccacggucacaggcaagaucauucaugaaugguguugcagaagcuguacccucccuccccugcgguuuaagggggaggacggaugcugguacggcauggagauccgcccggugaaagaaaaggaggaaaaucugguuaaaucuaugguguccgcugggagcggagaggucgacuccuucucucuuggccuccuguguaucagcauuaugaucgaagaggugaugagaucccgguggucuagaaagaugcugaugacagggacccucgccgucuuuuuccugcuuauuaugggacagcugaccuggaacgaucucauccgccugugcauuauggugggcgccaaugcuagcgaccggaugggcauggggacaacguaucuggcccuuauggcgaccuuuaaaaugagaccuauguucgcugucggacugcucuuucgcagacugacaucccgggaggugcuccugcuuaccaucggccugucucucguggccagcgucgaacugcccaacucccuggaggaacuuggggauggacuggccaugggcauuaugauccucaagcugcucacagacuuccagagccaccaacugugggcuacccuucugucucucacguuuaucaagacaaccuucucccugcauuacgccuggaaaaccauggcuaugguucugagcauugugucucuuuuuccccugugucucuccacaaccagccagaagacaacguggcugccugugcuccuggggucucuuggaugcaaaccgcugaccauguuccugaucgccgagaauaagauuuggggccgcaaauccuggccccucaacgaaggcaucauggcggucgggauugugagcauccugcuuuccagccugcucaagaacgauguuccucuggccggaccccucaucgcuggcgggaugcugauugccuguuaugugaucucuggaagcuccgcugaccuuucucuggagaaagccgccgaggucagcugggaagaggaagcugagcacuccggcgcgucucauaauauucugguggaaguucaggaugacgggacaaugaagaucaaggaugaggagagagacgauacccucacaauucugcuuaaagccacccugcucgcugugagcggagucuacccucuguccauccccgccacgcuguucgugugguauuuuuggcagaagaaaaagcaacggucuggcguccugugggacaccccuagcccucccgaaguggagcgcgccguucuugaugacggcaucuacagaauuaugcagcgggggcugcugggacgcucccaggugggcgucgggguguuccaggaaaacguuuuucacacaauguggcacgugaccagaggagcuguccucauguaucaaggcaaacggcuggagcccagcugggccucugugaagaaggaccuuaucuccuacgggggaggcuggcgccugcagggcagcuggaauacaggggaggaagugcagguuauugcggucgagcccggcaaaaauccuaagaaugugcagaccgcucccggcacauucaaaacgucugaaggggaggugggagccaucgcccucgauuuuaagccgggcaccuccgggagcccuauugucaacagagaaggaaaaaucgugggccuguacggcaaugggguugugacaaccuccggaaccuaugucucugcuauugcccaagcgaaggcuagccaggagggcccccucccugagaucgaagacgagguguuccggaagagaaaccugacaaucauggaucuucaucccggguccggaaaaacgcgccgguaccugcccgccauuguuagagaagccaucaagcgcaaacugcggacccucauucuggcuccuacaagaguggucgccagcgagauggcugaagcccuuaagggcaugccgauccgcuaucagaccacagcggugaaaggggagcacaccggcaaggagauuguugaccugaugugccaugccacguuuacaaugcggcuccugucucccgugagagucccuaauuacaacaugaucaucauggaugaagcucacuucaccgaccccuccagcauugccgcucgcggauauaucucuacccgggugggcaugggggaggccgccgcuauuuuuaugacagcgaccccucccggaagcguggaagccuucccucaauccaaugcugucauccaggaugaggaaagagacauuccggagcggucuuggaacagcggcuacgaguggaucacagauuuucccgggaagaccguuugguucgugccuuccaucaaaucuggaaaugacauugccaacugucugcgcaagaauggcaaaagagugauccagcucagccggaagacguucgauacagaauaucagaaaaccaagaacaacgacugggacuacgucgugacaaccgauauuuccgagaugggggccaauuuucgcgcugacagaguuaucgauccccggagaugccuuaagccugugauucugaaagacggccccgaacgcgucauccuggccggaccgaugccugugacgguugcgagcgcugcccaacggagaggccgcauugggcggaaccauaauaaggagggagaucaguacaucuauaugggccagccccucaacaaugacgaggaucacgcccacuggaccgaagcuaaaaugcugcuugacaacaucaauacacccgaggggauuaucccugcccuguucgaacccgagagagaaaagucugcggccauugauggagaguaccgccuccggggcgaggcuagaaaaaccuuuguggaacugaugcgcagaggggaccugccugucuggcucuccuauaagguggccagcgagggcuuccaguacuccgaucggcgcuggugcuuugacggagaaagaaacaaucaaguccuugaggaaaacauggauguggagaucuggacaaaagagggcgaacggaagaagcugcgcccgagauggcuggacgcucggaccuauucugacccccucgcccugagagaguucaaagaauuugcugccgggcgccggagcguuuccggagaucuuauucuggagaucggcaagcucccucagcaucugacacagagagcgcagaaugcccuggacaaccucgugaugcuucacaauucugaacaagggggacgcgcuuaccggcaugccauggaggagcugcccgauaccaucgaaacgcugaugcuccuggcucuuauugccgugcugacaggcggcgucacccucuucuuucugagcgggagaggacugggcaaaaccuccaucgggcuccuuuguguuauggccagcucugcucugcuguggauggcguccguggagccucacuggauugccgcuagcaucauucucgaguucuuucugauggugcuucugauccccgagccggaccggcagcgcacaccucaggauaaccagcucgccuaugucgugaucggacugcuguucaugauucucaccguugccgcuaaugagaugggccuucuggaaacaacgaagaaagaccuggggaucggacacguggccgucgagaaccaucaccaugcggccaugcucgauguggaccugcaccccgcuucugccuggacccuuuacgcugucgccacaaccauuaucacaccuaugaugagacauaccauugaaaacacgaccgcgaauaucucccugacagccauugcuaaccaagccgcuauccucaugggccuggauaagggcuggcccaucagcaagauggacauuggggugccucugcucgcccuuggaugcuacucucagguuaauccccugacccugacagcugccgugcucaugcuggucgcgcacuaugccaucauuggcccggggcuucaggcuaaagccacccgggaggcucaaaagcgcacggccgccggaaucaugaaaaacccuacaguggauggcauuguugcgaucgaccuggaucccguggucuacgacgcuaaguuugaaaaacagcucgggcagaucaugcugcuggugcucuguaccagccagauucuucugaugagaacaaccugggcccugugcgaguccaucacccucgcuacaggaccccugacgacccuuugggagggcucuccuggcaaguucuggaauacaaccauugccgugagcauggccaacaucuuccggggguccuaucuggcuggagccggccucgcguuuagccugaugaagucccucgggggaggccgcagagggacaggagcccaaggcgaaacccucggcgagaaauggaagcggcagcuuaaucagcugucuaaaagcgaguucaacacguacaagcgcuccgggauuauggagguugacagaucugaagcuaaagagggacugaagcggggcgagacaaccaagcacgccgucagcagagggaccgcuaaacuccgcugguuuguggaacggaaucuggugaagccggagggaaaagucaucgaucuuggcugugggagaggaggcugguccuauuacugcgccggccugaagaaaguuacagaagugaagggguauaccaaaggaggccccgggcaugaggaaccuauccccauggcgacauacggauggaaccucgugaagcugcacucuggcaaggacgucuucuuuauuccucccgagaaaugugauacgcugcucugcgacaucggggagagcuccccuaauccgaccauugaagagggacgcacacuucgggugcugaagaugguugaacccuggcugagaggcaaccaguucuguaucaaaauucucaauccuuacaugcccagcguggucgagacccuggagcaaaugcagcgcaagcauggcgggaugcuugugcggaacccucugucuagaaauuccacacacgaaauguauuggguuagcugcggaaccggcaacaucgugucugccgucaauaugacgucccgcaugcuccugaaccgguuuaccauggcucacagaaaacccacauacgagcgcgauguggaccugggggccggaacccggcauguggcugucgaaccggagguugccaaccucgauauuaucggccagagaaucgaaaauauuaagcacgagcauaagagcacauggcacuaugacgaggauaacccuuacaaaaccugggcuuaucaugggucuuacgaagugaagcccuccggaagcgccuccagcauggugaauggcgucgugaaacugcuuacaaagcccugggacguuaucccuauggugacccagauugcgaugacggauacaacccccuucggccaacagcgcgucuuuaaagagaagguggacaccagaacaccuaaggccaaacgggggacggcucagaucauggaaguuaccgccaaguggcuguggggauuccucucucgcaacaaaaagccgagaauuuguacacgggaggaauuuaccagaaaagugcggagcaaugcugccaucggcgccgucuucguggacgagaaccaauggaacuccgcgaaggaggcuguugaagaugagcgcuuuugggaccuggugcacagagaacgggagcuucacaagcaggggaaaugcgccacaugcgucuauaacaugaugggaaagcgcgagaaaaagcugggcgaguucgggaaagccaagggcucuagagcuaucugguacauguggcucggagcccgguuccuggaguuugaagcucugggcuucaugaaugaggaucauugguuuagccgcgaaaacucccucucugggguggagggagagggccugcacaaacuuggguacauucugagagacaucagcaagauucccggaggcaauauguaugccgaugacaccgcggggugggauacacggaucaccgaagacgaucuccagaacgaggccaagauuacggacaucauggaaccugagcaugcucugcuugccaaauccaucuucaagcugaccuaccagaauaaagucgugcgcguucaaagacccgcuaagaacggcacagugauggaugucauuucucggcgcgaccagagaggaagcggccagguggggaccuauggacucaauacauuuaccaacaucgaagcccagcugauucggcaaauggaguccgaggaaaucuucagcccuucugagcuggaaacgcccaaccucgcgggccgcgugcuggauuggcuugagaaacacgggguugaaagacugaagcggauggccauuuccggagacgacuguguggucaagccgaucgaugacagauuugcuacagcccucaccgcucugaaugauaugggcaaagugcgcaaggacaucccucagugggagcccagcaaaggguggaacgauuggcagcagguuccuuucugcucucaccauuuucaccaacuuauuaugaaggacggccgggagaucgugguccccuguagaaaucaggaugaacuggugggacgcgcccgggucucccagggcgcuggguggagccucagagagacagccugccugggaaaauccuacgcgcagauguggcaacugauguauuuccaucgccgggaccucagacuggccgcuaacgccauuuguucugccgugccuguugauugggugcccaccagccgcacgaccugguccauccacgcucaucaccaguggaugacaaccgaagacaugcuuagcgucuggaaucggguguggauugaggaaaacccguggauggaggauaagacacacaucucuuccuggggcgacguuccuuaccuggggaagagagaggaccaguggugcggaagccucauuggccugaccgcccgcgcgacaugggcuaccaauauccaaguggccaucaaccagguccggagacuuauugggaaugaaaacuaucuggauuacaugacgucuaugaaacgguuuaagaaugagagcgaccccgaaggcgcccucugguga

SEQ ID NO: 19035 - RNA, 9879 nt, Artificial Sequence
  derived and/or modified CDS sequence (opt5) from DENV-1__GQ199790__SS-prME
agcgugaccaugcugcucaugcugaugcccaccgcccuugcuuuccaccugacgacccggggcggggaaccucauaugaucgucacaaagcaggaacggggaaaaucccuccuguuuaagaccucugccggcguuaacaugugcacccuuauugcgauggaccugggggaacucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccguugcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugucauugggaccuccaucacccagaagggaaucauuuucauccuccugaugcuugugacaccuucuauggccaugagaugcguuggcauugggagccgggauuuuguggagggacuguccggcgcuacgugggucgacguggugcucgagcacgggagcugugucaccacaauggccaaggauaaacccacccuggacaucgaacugcucaagacagagguuaccaacccugcugugcugcgcaaacuuugcauugaagccaagaucucuaauacgacaaccgauuccagauguccgacccaaggagaggcgacacugauggaagaacaagacgccaacuucgugugccggcgcaccuuugucgauagaggcuggggcaauggguguggacucuucggcaaagggagccugauuacaugcgcuaaguuuaagugcgugacgaaacuugagggaaagaucguucaguacgaaaaccugaaauauucugugaucgucaccgugcacacaggcgaccagcaucaaguugggaaugaguccaccgaacacggaacaaccgccacgauuacaccccaggcuccuacaagcgagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggccuccaccucucaagagacauggaaucgccaggaccugcucgugaccuucaaaaccgcucacgcgaagaagcaggaagucgugguucugggaagccaagagggcgccaugcacacagcucugacgggggccaccgaaauucagacauccggaaccacaaccaucuuugccggccaucucaaaugcagacugaagauggauaaacuuacgcugaaggggaugagcuaugugauguguacaggcucuuucaaacucgagaaggaagucgcugagacccagcacggaaccgugcugguucagauuaaguacgagggcacagacgccccgugcaaaaucccuuucuccacccaagaugaaaagggggugacacagaacggacggcugaucacggcgaaucccauugucaccgacaaagagaagccugugaacaucgaagcugagccgcccuuuggcgagagcuauauugugaucggggccggagaaaaagcccuuaagcucucuugguucaagaaaggcagcuccauugggaagauguuugaggcuacagccagaggcgcucgccggauggccauccugggagauaccgcgugggacuucggcucuaucgggggaguuuuuacaagcgucggcaaacuggugcaucagauuuucgggaccgccuacggagugcucuuuuccggcgucagcuggacgaugaagaucgggauuggcgugcugcuuaccuggcugggacucaauucuagauccacaagccugucuaugaccuguaucgcuguuggccuggugacacuuuaccucggggucauggugcaggccgauuccggaugcguuauuaacuggaaaggccgcgaacugaagugugggagcggaaucuucgugaccaaugagguccacacauggaccgaacaauauaaguuucaggcugacuccccuaaacggcugucugccgcgauuggcaaggccugggaggagggggugugcggcaucagaagcgcuacgcgccucgaaaacaucauguggaaacagauuuccaacgagcugaaucauauccuucuggaaaacgacaugaaguucacaguuguggucggagauguggugggcauucucgcccaggggaaaaagaugauccggccgcaacccauggagcacaaauacucuuggaaaagcuggggaaaggcuaagauuaucggcgccgacguccagaauaccaccuuuaucauugaugggccuaacacacccgaauguccugacgaucagagagccuggaauaucugggagguugaggacuauggauucggcauuuuuaccacgaacaucuggcugaagcugcgcgauucccacacacaggugugcgaccaucggcuuaugagcgcugcgauuaaagauucuaaggccgugcacgcugacaugggcuacuggaucgaauccgagaaaaaugaaaccuggaagcucgccagagccagcuucaucgaggucaagacauguauuuggcccaaaucucauacccugugguccaacggggugcuggaaagcgagaugaucauuccgaagaucuauggaggcccuauuucucaacacaauuaccgccccggguauuucacacagaccgcuggaccuuggcaccucggcaaacuggagcuugauuuugaccugugcgaagggacgaccguuguggucgaugagcauugcggaaaccggggccccagccucagaacaaccacagugaccggcaagaucauccacgaaugguguugccgguccuguacgcugccuccccugcgcuucaaaggggaggacggaugcugguacggcauggagauuagaccgguuaaggaaaaggaggaaaaucuugugaaaagcauggucucugccggguccggagagguggacagcuuuucccucggccugcuguguaucucuauuaugaucgaagagguuaugcggagcagauggucccgcaagaugcucaugacagggacccuggcgguguuccuucugcucauuaugggacagcugacauggaacgaucugauccggcuuugcauuauggucggcgcuaaugccucugacagaaugggcauggggaccaccuaccuggcccucauggcuacauuuaaaaugcgcccuauguucgccgugggacugcucuuuagacggcugacgagccgcgaggugcuucugcucaccaucggccugucccuggucgcgucuguugaacuucccaacagccuggaggaacucggggauggacuggcuaugggcaucaugauucucaagcugcuuacagacuuccaaucccaucagcugugggccacccuccugagccugacauuuaucaaaaccacgcuuucucugcacuaugccuggaagacaauggcuauggugcucuccauugugagccuguucccccucugucugucuaccaccucccagaagacaaccuggcuuccuguccugcuggggagccucggaugcaaaccgcuggccauguuucuuaucgcugagaauaagauuuggggcagaaaaucuuggccccugaacgaaggcaucauggccguggggguuguguccauccuccugagcucccuccugaagaacgaugucccucuugcgggaccccugauugccggcgggaugcugaucgcuuguuacgugauuagcggaucuagcgccgaccucucccuggagaaagcugccgagguuucuugggaagaggaagccgagcauagcggcgcuucccacaauauccuuguggaaguccaggaugacgggacaaugaagauuaaagaugaggagcgggacgauacgcugaccauccuccugaaggcgacacuccuggccgugucuggagucuauccucuuagcauccccgcuacccuguucgugugguacuuuuggcaaaagaaaaagcagcgcuccggcguucugugggacacaccuucucccccggaaguggagagagccguccucgaugacggcauuuaucggaucaugcagcgcgggcugcuuggaagaagccaggugggcguugggguguuccaagaaaacgucuuccacaccauguggcaugugacgcggggagccgugcugauguaccagggcaaacgccucgagccuuccugggcuagcguuaagaaagaccugauuucuuaugggggaggcuggagacuccagggcuccuggaauaccggggaggaaguccaggugaucgccguggagcccggaaagaacccuaagaauguccaaacagcgcccggcaccuuuaaaacaccggaaggggaggugggagcuauugcccuggauuucaagccuggcaccagcgggucucccaucguuaaccgggaaggaaaaauugugggccuuuacggcaauggggucgugacaacguccggaaccuacguuagcgccaucgcucaggccaaggcgucccaggagggcccucugcccgagaucgaagacgagguguuuagaaaacgcaaccugacaauuauggaucuccaccccgggucuggaaagacccggagauaucugccugcuaucguccgcgaagccauuaagcggaaacuuagaacccugauccucgccccgacacgcgugguugcuagcgagauggccgaagcucugaagggcaugcccauucgguaccaaacgaccgccgugaaauccgagcauacagggaaggagaucgucgaccugaugugccacgcgaccuucacaaugagacuccuuagcccugugcgcgugcccaauuauaacaugaucauuauggaugaagcccauuuuaccgacccuucuuccaucgcugcccggggcuacauuagcacgagagucggaaugggcgaggcugccgccaucuucaugacagcuacacccccugggucuguugaagcguuuccgcagagcaaugccgugauucaggaugaggaacgggacauccccgagcgcuccuggaacucuggauaugaguggaucaccgauuucccuggcaaaacagugugguuuguccccagcauuaaguccgggaaugacaucgcuaacugucugagaaagaauggaaaacgggugauucagcugucucgcaagaccuucgauacagaauaccagaagaccaagaacaacgacugggacuauguugugacgacagauaucagcgagaugggcgccaauuuuagagccgaccgggucauugauccuagacgcugccucaaacccgugauccugaaggacgggccggaacggguuauucuugcuggcccuaugcccgugaccgucgccuccgcggcucagagacgcggacggaucggcagaaaccacaauaaggagggggaucaguacaucuacaugggacagccccugaacaaugacgaggaucacgcccauuggacagaagccaaaaugcuccuggacaacauuaauaccccugagggcaucauucccgcucuguucgaaccugagcgcgaaaagagcgccgcgaucgauggggaguaucggcucagaggagaggcccgcaaaacguucguggaacuuaugagacggggcgaccugccggucuggcugucuuacaagguggcuuccgagggguuucaauauagcgaucgcagauggugcuucgacggcgaacggaacaaucagguucucgaggaaaacauggauguggagauuuggaccaaagagggagaacgcaagaaacugagaccccgguggcuugacgccagaacauacuccgacccucuggcucuccgcgaguuuaaggaguucgccgcuggccggagaucugugagcggggaucugauccuggagaucggaaagcucccccagcaccuuacccagcgcgcccaaaaugcgcuggacaaccuggucaugcuccauaauuccgaacagggcgggcgggccuauagacacgcuauggaggagcugccugauacaauugaaacccuuaugcugcucgcccugaucgcuguucugacaggaggcgugacccucuuuuuccuuucuggccgggggcugggaaaaacgagcauuggccugcucugugugauggccuccagcguccugcuuuggauggccucuguggagccccacuggaucgcugcguccauuauccuggaauuuuuccucaugguucugcugaucccggagccugaccgccagagaacaccccaggauaaccaacucgccuacguggucauugggcuucuguuuaugauccugaccguggcugccaaugagaugggacuccuggaaaccacaaagaaagaccuuggcauugggcaugucgccguggagaaccaccaucacgcuaccaugcuggauguugaccuccauccugccagcgcguggacacuguaugccguggcuacgaccaucauuacacccaugaugcggcacaccaucgaaaacacaaccgccaauauuucucugacggcuaucgccaaccaggcggccauccucaugggacuugauaagggcuggccuauuuccaaaauggacaucggcgucccccugcuggcucucgggugcuacagccaggugaauccgcugacccuuacagccgcuguucugaugcucguggcccacuacgcuauuaucggaccuggccugcaagccaaggcgacccgcgaggcccagaagagaacagcugccgggauuaugaaaaaccccaccgucgauggaaucguggcuaucgaccuggaucccgugguuuaugacgccaaguucgaaaaacagcucggccagauuaugcuucugauccuguguacgucucaaauucuccugaugcggacaaccugggcccuuugcgagagcaucacacuggcgaccgggccucucaccacacugugggagggauccccgggcaaguuuuggaauacgaccauugcugucucuauggccaacaucuuccgcggcagcuaccuggcuggggccggacucgccuuuucccuuaugaaaagccugggcgggggaagacggggcacaggggcucagggagaaacccugggcgagaaguggaagcgccagcucaaucagcuguccaaaucugaguucaacaucuauaagagaagcggcauuauggagguggaccgguccgaagccaaagaggggcuuaagagaggagagacaacccgccaugcggugucucggggcacggccaaacugagaugguucgucgaacgcaaucucguuaagcccgaggggaaggugaucgaucugggauguggcagagggggauggagcuacuauugcgcuggccugaaaaaggugacagaagucaaaggcuacaccaaagggggaccuggccacgaggaacccauuccuauggccaccuauggguggaaccucgugaaacuucauuccggaaaggacgucuuuuucacacccccugagaaaugugauacccugcugugcgacaucggcgagucuagcccgaaucccacaauugaagaggggagaacgcuccgcgugcugaagauggucgaaccuuggcuucggggaaaccaauuuuguaucaagauucugaaucccuacaugccuuccgugguugagacccucgagcagaugcagagaaaacacggcggcaugcuggugcgcaacccccugagcagaaauucuacacacgaaauguacugggucuccugcgggaccggaaacaucgugagcgcugugaauaugacaucuagaaugcuccugaaccgcuucaccauggcccaucggaagccgacguaugagagagaugucgaccuuggcgcggggacccgccacguugccguggaaccugagguggcuaaccuggauaucauuggacagagaaucgaaaauauuaaacaugagcacaaguccacauggcauuacgacgaggauaaccccuauaaaaccugggccuaccacggcagcuaugaagucaagcccucuggguccgcuagcuccauggugaauggaguugugaagcuccugacaaaaccuugggacgucauccccauggugacccaaauugccaugacagauaccacgccuuuuggccagcagcggguuuucaaggagaaaguggacacacgcaccccgaaggcuaaaagaggcaccgcccaaaucauggaagucacagcgcgguggcuuuggggguuucugagcagaaacaagaagccccggaucuguacgcgcgaggaguucaccagaaaagugcggucuaaugccgcuauuggagccguuuuuguggacgagaaccaguggaauagcgcuaaggaggccgucgaagaugagcgcuucugggaccucgugcagaaagaaagagagcugcacaagcagggcaaaugcgccacaugcgucuacaacaugauggggaagcgggaaaagaaacugggagaguuuggcaaggcgaaagggucccgcgcuaucugguauauguggcucggcgccagauuccuggaguuugaagcccuuggauucaugaaugaggaucauugguucucucgggaaaacagccuguccggcguggagggggagggacuccacaagcugggcuacauucuucgcgacaucucuaaaauuccugggggaaauauguacgcugaugacaccgccggcugggauacaagaaucaccgaagacgaucugcaaaacgaggcucggaucacagacauuauggaacccgagcaugcccuccuggcgaccagcaucuuuaagcugacguaucagaauaaaguugugcgcguccagagaccugccaagaacgggaccgugauggaugugauuucccggcgcgaccagagaggcucuggacaaguuggcacauacgggcucaauaccuucacaaacauggaagcucagcugauccggcagauggagagcgagggaauuuuucuucccuccgaacuggagacccagaaccucgccgaaagagugcuggauuggcuugagaaguauggcgucgaacgccugaaacggauggcuaucagcggggacgacugugugguuaagccgaucgaugacagauucgccacggcgcucacagcccugaaugauaugggaaaagugcgcaaggacauuccucaaugggagcccucuaaaggcuggaacgauuggcagcaggucccuuuuugcucccaccacuuccaucagcugaucaugaaggacgggcgggagauugugguccccuguagaaaucaagaugaacucgugggccgcgcucggguuagccagggagccggcuggucucugagagagaccgcuugccuugggaaguccuacgcccagauguggcaacugauguauuuucaccgccgggaccucagacuggcugccaacgcgaucuguagcgccgugccugucgauugggugcccacaucccgcaccacguggucuauucaugcucaccaucaguggaugaccacagaagacaugcuuagcguuuggaaucggguguggaucgaggaaaacccguggauggaggauaaaacccacgucuccagcuggggagacgugccuuaccugggcaagagagaggaccaguggugcgggucucucauuggacugacagcccgggccaccugggcuuccaauauccagguggccaucaaccaaguuagacgccugauuggcaaugaaaacuaucucgauuacaugacaagcaugaaacgguucaagaaugagggggaccccgaaggcgcgcugugguga

SEQ ID NO: 19036 - RNA, 9879 nt, Artificial Sequence
  derived and/or modified CDS sequence (opt5) from DENV-1__GQ199791__SS-prME
uccgugaccaugcugcucaugcugaugcccaccgcccuugcuuuccaccugacgaccagaggcggggaaccucauaugaucgucaccaagcaggaacggggaaagucccuucuguuuaagaccucugccggcguuaauaugugcacccuuauugccauggaccugggggaacucugugaagauaccaugacauacaagugcccgcgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaagcagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuuccugacccaagaugaaaaggggguuacacagaacggacggcuuaucacggcuaaucccauugugaccgacaaagagaagccugucaacaucgaagccgagccgcccuuuggcgaguccuauauugugaucggggccggagaaaaagcucucaagcugagcugguucaagaaaggcucuagcauugggaagauguuugaggccacagcuagaggcgcccgccggauggcgauccugggagauaccgccugggacuucggcuccaucgggggaguguuuacaucuguuggcaaacucguccaucagauuuucgggaccgcuuacggagugcuguuuagcggcguguccuggacgaugaagaucgggauuggcguccuucugaccuggcucggacugaauagcagaucuacaucccugagcaugaccuguaucgccgugggccuuguuacacucuaccugggggugaugguccaggcugauucuggaugcgugauuaacuggaaaggccgcgaacugaaguguggguccggaaucuucguuaccaaugaggugcacacauggaccgaacaauauaaguuucaggccgacagcccuaaacggcucuccgcggccauuggcaaggcuugggaggagggggucugcggcaucagaucugccacgcgccuggaaaacaucauguggaaacagauuagcaacgagcuuaaucauauccugcucgaaaacgacaugaaguucacagugguugugggagaugucgugggcauucuggcucaggggaaaaagaugauccggccgcaacccauggagcacaaauacuccuggaagucuuggggaaaggccaaaauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaaacuucgcgauagcuacacacagguuugcgaccaccggcucauguccgcggccauuaaagauagcaaggcugugcaugccgacaugggcuauuggaucgaaucugagaaaaaugaaaccuggaagcuggccagagcuuccuucaucgaggugaagacauguauuuggcccaaaagccacacccuguggucuaacgggguccucgaauccgagaugaucauuccgaagaucuacggaggcccuauuagccaacauaauuaucgccccggguacuucacacagaccgccggaccuuggcaccugggcaaacuugagcuggauuuugaccucugcgaagggacgaccgugguuguggaugagcacugcggaaaccggggccccucucugagaacaaccacagucaccggcaagaucauccaugaaugguguugccggagcuguacgcugccuccccuucgcuucaaaggggaggacggaugcugguacggcauggagauuagaccggugaaggaaaaggaggaaaaucucguuaaauccauggugagcgcggggucuggagaggucgacuccuuuagccugggccugcucuguaucuccauuaugaucgaagaggugaugcggucuagauggagccgcaagaugcugaugacagggacccuugcuguuuuccugcuccugauuaugggacagcugacauggaacgaucuuauccggcugugcauuauggugggcgccaaugccuccgacagaaugggcauggggaccaccuaucucgcucugauggccacauuuaaaaugcgcccuauguucgcggucggacuccuguuuagacggcuuacgucucgcgaggugcugcuccugaccaucggccugagccuuguggcuuccgucgaacugcccaacucucucgaggaacugggggauggacucgccaugggcaucaugauucugaaacuucugacagacuuccaaagccaccagcucugggccacccugcugucccuuacauuuaucaaaaccacgcugagccuccauuacgcuuggaagacaauggccaugguucugucuauugugucccucuucccccugugucuuagcaccaccucucagaagacaaccuggcugccugugcugcucgggucccugggaugcaaaccgcuuacaauguuucugaucgcugagaauaagauuuggggcagaaaaagcuggccccucaacgaaggcaucauggccgucggggugguuucuauccugcucuccagccugcuuaagaacgaugugccucuggcgggaccccugauugccggcgggaugcucaucgcuuguuaugucauuuccggaagcucugccgaccugagccuugagaaagcugccgagguguccugggaagaggaagccgagcacucuggcgcuagccauaauauccugguugaagugcaggaugacgggacgaugaagauuaaagaugaggagcgggacgauacccucacaauccugcucaaggcgacccugcuugccgucuccggaguguacccucugucuauccccgcuacacuguucgucugguauuuuuggcaaaagaaaaagcagcgcagcggcgugcucugggacaccccuagcccucccgaaguugagagagccgugcuggaugacggcauuuaccggaucaugcagcgcgggcuucugggaagaucucaggucggcguggggguuuuccaagaaaacguguuccacacgauguggcacgucacccggggagccgugcucauguaucagggcaaacgccuggagcccagcugggcuuccgugaagaaagaccucauuagcuacgggggaggcuggagacugcagggcucuuggaauacaggggaggaaguucaggucaucgccguggagcccggaaagaacccuaagaaugugcaaaccgcgcccggcacauuuaaaaccccggaaggggaggucggagcuauugcccuugauuucaagccuggcacauccgggagccccaucgugaaccgggaaggaaaaauuguuggccuguacggcaaugggguggucacgaccucuggaacauauguguccgccaucgcucaggccaaggcgagccaggagggcccucugcccgagaucgaagacgagguuuuuagaaaacgcaaccucaccauuauggaucugcaucccggguccggaaagacccggagauaccuuccugcuaucgugcgcgaagccauuaagcggaaacugagaacacucauccuggccccgacgcgcgucguggcuucugagauggccgaagcucugaagggcaugcccauucgguaucaaaccacagccguuaaaagcgagcacaccgggaaggagaucguggaccucaugugccaugcgacauucaccaugagacuucuguccccuguccgcgugcccaauuacaacaugaucauuauggaugaagcccacuuuacggacccuagcucuaucgcugcccggggcuauauuuccacaagagugggaaugggcgaggcugccgccaucuucaugaccgcuacacccccugggagcgucgaagcguuuccgcagucuaaugccguuauucaggaugaggaacgggacauccccgagcgcagcuggaacuccggauacgaguggaucacagauuucccuggcaaaaccgugugguuugugcccucuauuaagagcgggaaugacaucgcuaacugucugagaaagaauggaaaacgggucauucagcucucccgcaagacauucgauaccgaauaucagaagacgaagaacaacgacugggacuacgugguuacaaccgauaucucugagaugggcgccaauuuuagagccgaccgggugauugauccuagacgcugccugaaacccgucauccuuaaggacgggccggaacgggugauucuggcuggcccuaugcccguuacaguggccagcgcggcucagagacgcggacggaucggcagaaaccauaauaaggagggggaucaguacaucuauaugggacagccccucaacaaugacgaggaucacgcccacuggaccgaagccaaaaugcugcuggacaacauuaauacgccugagggcaucauucccgcucucuucgaaccugagcgcgaaaaguccgccgcgaucgauggggaguaccggcuuagaggagaggcccgcaaaaccuucgucgaacugaugagacggggcgaccugccgguguggcucagcuauaaggucgcuucugagggguuucaauacuccgaucgcagauggugcuucgacggcgaacggaacaaucaggugcuggaggaaaacauggauguugagauuuggacaaaagagggagaacgcaagaaacuuagaccccgguggcuggacgccagaaccuauagcgacccucucgcucugcgcgaguuuaaggaguucgccgcuggccggagauccgugucuggggaucugauccucgagaucggaaaacuuccccagcaucugacacagcgcgcccaaaaugcgcuggacaaccucgugaugcugcacaauagcgaacagggcgggcgggccuacagacaugcuauggaggagcuuccugauaccauugaaacacugaugcuccuggcccugaucgcuguccucaccggaggcguuacgcucuuuuuccuguccggccgggggcugggaaaaacaucuauuggcgugcucugugugauggccagcuccguccugcuuuggauggccagcguggagccccacuggaucgcugcgucuauuauccuggaauuuuuccucaugguucugcugaucccggagccugaccgccagagaacaccccaggauaaccaacucgccuauguggucauugggcuucuguuuaugauccugaccguggcugccaaugagaugggacuccuggaaacaaccaagaaagaccuuggcauugggcacgucgccguggagaaccaucaccaugcuacaaugcuggauguugaccuccacccugccuccgcguggacgcuguacgccguggcuaccacaaucauuacccccaugaugcggcauacaaucgaaaacaccacggccaauauuagccugaccgcuaucgccaaccaggcggccauccucaugggacuugauaagggcuggccuauuucuaaaauggacaucggcgucccccugcuggcucucgggugcuacucccaggugaauccgcugacacuuaccgccgcuguucugaugcucguggcccacuaugcuauuaucggaccuggccugcaagccaaggcgacacgcgaggcccagaagagaaccgcugccgggauuaugaaaaaccccacggucgauggaaucguggcuaucgaccuggaucccgugguuuacgacgccaaguucgaaaaacagcucggccagauuaugcuucugauccuguguacaagccaaauucuccugaugcggaccacaugggcccuuugcgagucuaucacccuggcgaccgggccucucacaacgcugugggagggaagcccgggcaaguuuuggaauaccacaauugcugucuccauggccaacaucuuccgcggcucuuaucuggcuggggccggacucgccuuuagccuuaugaaaucccugggcgggggaagacggggcaccggggcucagggagaaacacugggcgagaaguggaagcgccagcucaaucagcugagcaaauccgaguucaacaucuacaagagaucuggcauuauggagguggaccggagcgaagccaaagaggggcuuaagagaggagagaccacgcgccacgcggugucccggggcacagccaaacugagaugguucgucgaacgcaaucucguuaagcccgaggggaaggugaucgaucugggauguggcagagggggauggucuuauuacugcgcuggccugaaaaaggugaccgaagucaaaggcuauaccaaagggggaccuggccaugaggaacccauuccuauggccacauacggguggaaccucgugaaacuucacagcggaaaggacguguuuuucacacccccugagaaaugugauacccugcugugcgacaucggcgaguccucuccgaaucccacgauugaagaggggagaacccuccgcguucugaagauggucgaaccuuggcuucggggaaaccaauuuuguaucaagauucugaaucccuacaugccuagcgugguugagacacucgagcagaugcagagaaaacauggcggcaugcuggugcgcaacccccugucccggaauagcacccacgaaauguauugggucucuugcgggacaggaaacaucguguccgcugugaauaugaccagcagaaugcuccugaaccgcuucacgauggcccaccggaagccgaccuacgagagagaugucgaccuuggcgcggggacacgccauguugccguggaaccugagguggcuaaccuggauaucauuggacagagaaucgaaaauauuaaacacgagcauaagucuaccuggcacuaugacgaggauaaccccuacaaaacaugggccuaucauggcuccuacgaagucaagcccagcgggucugcuuccagcauggugaauggaguugugaagcuccugaccaaaccuugggacgucauccccauggugacacaaauugccaugaccgauacgacaccuuuuggccagcagcggguuuucaaggagaaaguggacacccgcaccccgaaggcuaaaagaggcacagcccaaaucauggaagucacggcgcgguggcuuuggggguuucuguccagaaacaagaagccccggaucuguacccgcgaggaguucacaagaaaagugcggagcaaugccgcuauuggagccguuuuuguggacgagaaccaguggaacucugcuaaggaggccgucgaagaugagcgcuucugggaccucgugcagaaagaaagagagcugcacaagcagggcaaaugcgcgaccugcgucuauaacaugauggggaagcgggaaaagaaacugggagaguuuggcaaggcgaaagggagccgcgcuaucugguacauguggcucggcgccagauuccuggaguuugaagcccuuggauucaugaaugaggaucacugguucucccgggaaaacucucugagcggcguggagggggagggacuccauaagcugggcuacauucuucgcgacaucuccaaaauuccugggggaaauauguaugcugaugacacagccggcugggauaccagaaucacagaagacgaucugcaaaacgaggcuaagaucaccgacauuauggaacccgagcacgcccuccuggcgacgucuaucuuuaaacugaccuaccagaauaagguugugcggguccagcgcccugccaagaacgggacagugauggaugugauuagcagacgggaccagcgcggcuccggacaaguuggcaccuaugggcucaauacauucaccaacauggaagcucagcugaucagacagauggagucugagggaauuuuucuucccagcgaacuggagacgccgaaccucgccgaacgggugcuggauuggcuugagaaauacggcgucgaaagacugaagcgcauggcuaucuccggggacgacugugugguuaaaccuaucgaugaccgguucgccacagcgcucaccgcccugaaugauaugggaaaggugagaaaagacauuccccagugggagccuagcaagggcuggaacgauuggcaacagguccccuuuugcucucaucacuuccaccagcugaucaugaaggacgggcgcgagauuguggucccuugucggaaucaggaugaacucgugggcagagcucgcguuucccaaggagccggcuggagccugcgggagacagcuugccuugggaaaucuuaugcccagauguggcagcugauguacuuucauagacgcgaccuccggcuggcugccaacgcgaucuguuccgccgugcccgucgauugggugccgaccagcagaacgaccugguccauucacgcucaucaccaauggaugacaaccgaagacaugcuuucuguuuggaaucgcguguggaucgaggaaaacccuuggauggaggauaagacacaugucagcuccuggggagacgugcccuaucugggcaaacgggaggaccaguggugcgggagccucauuggacugaccgccagagccacaugggcuucuaauauccagguggccaucaaccagguucggagacugauuggcaaugaaaacuaccucgauuacaugaccuccaugaagcgcuucaaaaaugagggggaccccgaaggcgcguuuugguga

SEQ ID NO: 19037 - RNA, 9879 nt, Artificial Sequence
  derived and/or modified CDS sequence (opt5) from DENV-1__GQ199792__SS-prME
agcgugaccaugcugcucaugcugaugcccacagcccuugcuuuccaccugacgaccagaggaggggaaccucauaugaucguguccaagcaggaacggggaaaaucucuccuguuuaagacaagcgccggcguuaacaugugcacccuuauugcgauggaccugggggaacucugugaagauacaaugaccuacaaaugcccccgcaucacagaagcugaacccgacgauguggacuguuggugcaaugccaccgaugccugggugacguauggaaccuguucccagacaggcgagcacagacgggacaagcgcucuguggcucuggccccucauguggggcugggacucgagaccagaacagaaaccuggaugagcuccgagggcgcuuggaaacagauucagcggguugaaacgugggcccugcgccaccccggcuucacagugaucgcgcuuuuucuggcccaugcuauugggaccucuaucacacagaagggaaucauuuucauccuccugaugcuugucaccccuagcauggccaugagaugcgugggcauugggucccgggauuuuguugagggacugagcggcgcuaccuggguggacgucgugcucgagcacgggucuugugugacaacgauggccaaggauaaacccacccuggacaucgaacugcucaagacagaggucaccaacccugcgguucugcgcaaacuuugcauugaagccaagaucuccaauacaaccacggauagcagauguccgacacaaggagaggcuacccugguggaagaacaggacgccaacuucgugugccggcgcaccuuugucgauagaggcuggggcaauggguguggacucuucggcaaagggucucugauuacaugcgcuaaguuuaagugcgugaccaaacuugagggaaagaucguucaguacgaaaaccugaaauauuccgugaucgucacagugcacacgggcgaccagcaucaaguugggaaugagagcaccgaacacggaacaaccgccacaauuacaccccaggccccuacgaccgagauccagcucacagacuacggcgcucugacccuggauuguucuccccggacaggccucgacuucaacgaaauggugcugcuuaccaugaaggagaaauccuggcugguccauaagcagugguuucucgaucugccucuucccuggacgagcggggcguccacaucucaagagaccuggaaucgccaggaccugcucgugacauucaaaaccgcccacgcuaagaagcaggaagucgugguucugggaagccaagagggcgccaugcacaccgcccugacaggggcuacggaaauucagaccuccggaacaaccacaaucuuugccggccaucucaaaugcagacugaagauggauaaacuuacccugaaggggaugagcuaugugauguguacgggcucuuucaaacucgagaaggaagucgcggagacacagcacggaaccgugcugguucagauuaaguacgagggcaccgacgcuccgugcaaaaucccuuucuccacacaagaugaaaagggggugacccagaacggacggcugaucacagccaaucccauugucacggacaaagagaagccugugaacaucgaagccgagccgcccuuuggcgagagcuauauugugaucggggcuggagaaaaagcccuuaagcucucuugguucaagaaaggcagcuccauugggaagauguuugaggcuaccgccagaggcgcgcgccggauggccauccugggagauacagcuugggacuucggcucuaucgggggaguuuuuaccagcgucggcaaacuggugcaucagauuuucgggacagccuacggagugcucuuuuccggcgucagcuggaccaugaagaucgggauuggcgugcugcuuacguggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacagaacaauauaaguuucaggcggacuccccuaaacggcugucugccgcuauuggcaaggccugggaggagggggugugcggcaucagaagcgcuacccgccucgaaaacaucauguggaaacagauuuccaacgagcugaaucauauccuucuggaaaacgacaugaagcucacgguuguggucggagauguggccggcauucuggggcagggcaagaagaugauccggccgcaacccauggaguacaaauauucuuggaaaagcuggggcaaggccaagauuaucggggcugacgcgcagaauacaaccuucaucauugauggaccuaacacccccgaauguccugacgaucagagagccuggaauaucugggagguggaggacuacggcuuuggcauuuucacaaccaacaucuggcugaaacuucgcgauuccuauacgcaggucugcgaccaccggcucaugagcgcugccauuaaagauucuaaggccguucacgcugacaugggguacuggaucgaauccgagaaaaaugaaacauggaagcuggccagagcgagcuuuaucgaggugaagaccuguauuuggcccaaaucucauacacugugguccaacggagugcucgaaagcgagaugaucauuccgaagaucuauggcgggccuauuucucaacacaauuaccgccccggauacuucacccagacagcuggcccuuggcaucuggggaaacuugagcuggauuucgaccucugcgaaggaaccacggucgugguugaugagcacugcggcaaccggggccccagccugagaaccacaaccgugacagggaagaucauccacgaaugguguugccgguccuguacccugccuccccuucgcuuuagaggagaggacggcugcugguaugggauggagauucggccggucaaagaaaaggaggaaaaucucgucaagagcaugguuucugccggauccggcgagguggacagcuucucccuggggcugcucuguaucucuauuaugaucgaagaggucaugagaagccgcuggucccggaaaaugcugaugacgggaacacuugccguguuuuuccugcucauuaugggccagcugaccuggaacgaucugaucagacuuugcauuaugguuggcgcuaaugccucugaccgcauggggaugggaacaaccuaccuggcgcucauggcuaccuuuaagaugagaccuauguucgccgugggccugcucuuucggcgccugacaagcagagagguccuucugcucacgaucgggcugucccugguggccucuguggaacuucccaacagccuggaggaacucggagauggccuggcuauggggaucaugauucucaaacugcuuaccgacuuccaaucccaucagcugugggccacacuccugagccugaccuuuaucaagacaaccuucucucuucacuaugcuuggaaaacgauggccaugguccuguccauuguuagccucuuuccccugugucucucuacaaccucccagaagaccacauggcugccugugcuucugggaagccugggcugcaagccgcucaccauguuccugaucgcggagaauaaaauuuggggccggaagucuuggccccuuaacgaagggaucauggccgugggaaucgucuccauucugcucagcucccugcucaaaaacgaugugccucuggcuggcccccuuaucgccgggggaaugcugauugcuuguuacguuaucagcggcucuagcgccgaccugucccucgagaaggccgcugaggugucuugggaagaggaagcggagcauagcggggccucccacaauauucuggucgaagugcaggaugacggaacaaugaaaaucaaggaugaggagcgcgacgauacgcuuaccauccugcucaaagcuacacugcucgccguuucuggcguguauccucugagcauucccgccacccuuuuugucugguacuucuggcaaaagaagaaacagagauccggcgugcugugggacacaccuucucccccggaagucgagcgggcugugcuggaugacgggaucuaucgcauuaugcagagaggacuccugggccggagccagguuggggugggagucuuccaagaaaacguguuucauaccauguggcacguuacgcgcggcgccgugcuuauguaccaggggaagagacuggagccuuccugggcgagcgucaaaaaggaccucaucucuuacggaggcggcuggcggcugagaggguccuggaauaugggagaggaaguccaggugauugcuguugagcccggcaaaaacccuaagaauguccagaccgcccccgggacauucaagaccccggaaggagaggugggcgccaucgcucucgauuuuaaaccugggacaagcggaucucccauugugaaccgcgaaggcaagaucgucggccuguaugggaauggagugguuaccacauccggcacguacgugagcgccaucgcgcaagcuaaagccucccaggaggggccucuucccgagauugaagacgaggucuuccggaagagaaaccugaccaucauggaucugcaccccggaucuggcaaaacacgccgguaucucccugccauugugagagaagcuaucaagcgcaagcugcggacccuuauucuggccccgaccagaguuguggcuagcgagauggccgaagcgcucaaagggaugcccauccgcuaccagacaacggccgucaaguccgagcauaccggcaaagagaucguggaccugaugugccacgcuacauuuaccaugcggcugcucagcccuguuagagugcccaauuauaacaugauuaucauggaugaagcccauuucacagacccuucuuccauugcugcccggggauacaucagcacccgcgucggcaugggggaggccgcugcgauuuuuaugacggccacacccccuggaucuguggaggcuuucccgcaaagcaaugccgugauccaggaugaggaaagagacauccccgagcgguccuggaacucuggcuaugaguggauuaccgauuuuccugggaagaccgucugguucguucccagcaucaaauccggaaaugacauugccaacugucuucgcaagaauggcaagagagugauccagcugucucggaaaacauuugauaccgaauaccagaagaccaagaacaacgacugggacuacguggucaccacggauauuagcgagaugggggcuaauuucagagccgaccgcgugaucgauccucggagaugccugaagcccguuauucucaaagacggcccggaacgcgugauccuggcgggaccuaugcccgucacaguggcuuccgccgcccaacggagaggccgcaucgggcggaaccacaauaaggagggagaucaguauauuuacaugggccagccccuuaacaaugacgaggaucaugcucacuggaccgaagccaagaugcugcucgacaacaucaauacaccugaggggauuauccccgcgcuguucgaaccugagagagagaaaagcgccgcuguugauggagaguaucgccugagaggcgaggcccggaagaccuuuguggaacucaugcgcagaggggaccuuccggucuggcugucuuacaaaguggcuuccgagggcuuccaguauagcgaucggcgcuggugcuuugacggagaaagaaacaaucaaguccuggaggaaaacauggauguggagauuuggacgaaggagggcgaacggaaaaagcucagaccccgcuggcuggacgcccggaccuacuccgacccucuugcucugagagaguucaaagaauuugccgcggggcgccggucuguuagcggagaucucauccuggagaucggcaagcugccccagcaccucacacagagagcccagaaugcucuugacaaccuggugaugcugcauaauuccgaacaagggggacgggccuaucgccacgcuauggaggagcucccugauaccauugaaacacugaugcuucuggcccucaucgccgugcugaccggcggcgucacacuguucuuucucucugggagaggacuuggcaagaccagcauugggcugcuguguguuauggcuuccagcgugcuccuguggauggcgucuguggagccccauuggaucgccgcuuccauuauccuugaguucuuucugaugguccuccugaucccggagccugaccggcagcgcacgccccaggauaaccagcuggccuacgugguuauuggacuccuuuucaugauccugacaguggccgcuaaugagaugggccugcucgaaaccaccaaaaaggaccuggggauuggacacgucgccguggagaaccaccaucacgcggccaugcuugaugucgaccugcauccugcuagcgccuggacacucuacgcuguggccaccacaaucauuacgcccaugaugagacacaccaucgaaaacacaaccgcgaauauuucucugacagccaucgcuaaccaagccgcuauccugaugggccucgauaaaggcuggccuauuuccaagauggacaucgggguuccccuucuggcccugggaugcuauagccaggugaauccgcucacccugacggcugccguccuuaugcugguggcgcauuacgccauuaucggcccugggcuccaggcuaaagccacccgggaggcucaaaagcgcacagccgccggaauuaugaagaaccccaccguugauggcaucguggcgaucgaccuggaucccgucguguaugacgcuaaauuugaaaagcagcuggggcagauuaugcuccuuauccuguguacaucucagauucugcucaugagaaccacgugggcccugugcgagagcaucacacuugcuaccggaccucugacaacccucugggagggcuccccgggcaaauucuggaauaccacaauugccgugucuauggccaacaucuuucgggggagcuaccuggcuggagccggccuggcguucucccucaugaaaagccuugggggaggccgcagagggacgggagcccaaggcgaaacccugggcgagaaauggaagcggcagcugaaucagcucuccaagucugaguucaacacauauaaaagaagcgggaucauggagguugaccgcuccgaagcuaaggagggacugaaacggggcgagaccacaaagcacgccgucucuagagggaccgcuaaacuucgcugguuuguggaacggaaucuggugaagcccgagggaaaggucauugaucucggcugugggagaggaggcuggagcuacuauugcgccggccugaaaaagguuacggaagugaaaggguacacaaagggaggcccugggcacgaggaacccaucccuauggcgaccuacggauggaaccuggugaaacuccauuccggcaaggacgucuucuuuauucccccugagaaaugugauacccuucugugcgacaucggggagucuagcccgaaucccacaauugaagagggacgcacccugcgggugcucaagaugguugaaccuuggcugagaggcaaccaguucuguaucaagauucuuaaucccuauaugccuuccguggucgagacacuggagcaaaugcagcgcaaacacggcgggaugcucgugcggaacccccugagcagaaauucuacgcaugaaauguacuggguuuccugcggaaccggcaacaucgugagcgccgucaauaugacaucucgcaugcugcucaaccgguuuaccauggcucacagaaagccgacauaugagcgcgauguggaccuggggaccggaacgagacacguggccgucgaaccugagguugcuaaccuugauaucauuggccagcggaucgaaaauauuaaacaugagcacaaguccaccuggcauuacgacgaggauaaccccuauaaaacaugggccuaccacgggagcuaugaagugaagcccucuggauccgcuagcuccauggugaauggcgucgugaagcugcucaccaaaccuugggacguuauccccauggugacacagauugccaugaccgauacaaccccuuucggccaacagcgcgucuuuaaggagaaaguggacacgagaacaccgaaggcgaaacgggggaccgcccagaucauggaaguuaccgcuagauggcuguggggauuccuuagccggaacaagaagccccgcaucuguacaagagaggaauuuacgcggaaagugcgcucuaaugccgcuauuggcgccgucuucguggacgagaaccaauggaauagcgccaaggaggcgguugaagaugagagauuuugggaccuggugcaucgggaacgcgagcuccacaaacaggggaagugcgcuaccugcgucuacaacaugaugggaaaaagagaaaagaagcugggcgaguucgggaaagccaagggcucccgggccaucugguacauguggcugggagcucgcuuucucgaguucgaagcccugggcuucaugaaugaggaucacugguuuucuagagaaaacagccuuuccgggguggagggagagggccugcauaaacucggguauauucugcgggacaucucuaagauuccuggaggcaauauguacgcugaugacacagccgggugggauacccgcaucacagaagacgaucuucagaacgaggcgaaaaucaccgacauuauggaacccgagcacgcccugcucgcuaaggccaucuucaaacugacauaucagaauaaggucgugagaguucaacggccugcuaagaacggcaccgugauggaugucauuagccgcagagaccagcggggauccggccagguggggacguacggacugaauaccuuuacaaacauggaagcccagcucaucagacaaauggagucugagggcauuuucagccccuccgaacuggagaccccgaaccuugcggaacgcgcccuggauuggcucgagaaauaugggguggaacggcugaagagaauggcuaucagcggagacgacuguguugugaaaccuaucgaugaccgcuuugccacagcucuuaccgcccugaaugauaugggcaagguccggaaagacauuccccagugggagccuucuaagggguggaacgauuggcaacaggugcccuucugcucccaucacuuucaccaacucaucaugaaggacggcagagagauuguugugccuugucgcaaucaggaugaacuggucggacgggcuagagugagccagggcgccggguggucucugcgcgagacggcgugccucggaaaauccuacgcccagauguggcaacugauguauuuccaucggagagaccuucgccuggcugccaacgccaucuguagcgcuguccccggcgauugggugccgacaucccggaccacauggucuauucacgcccaucaccaguggaugaccacggaagacaugcucagcguuuggaauagaguguggaucgaggaaaacccuuggauggaggauaagacccauauuuccagcugggaggacguccccuaccuggggaaacgggaagaccaguggugcggaucucuuaucggccugacagcgagagcuaccugggccacaaauauccaaguggccauuaaccagguucgccggcucaucgggaaugagaacuaccuggauuauaugaccuccaugaagagauuuaaaaaugaaagcgaccccgagggcgcucugugguga

SEQ ID NO: 19038 - RNA, 9879 nt, Artificial Sequence
  derived and/or modified CDS sequence (opt5) from DENV-1__GQ199793__SS-prME
uccgugaccaugcugcucaugcugaugcccaccgcccuugcuuuccaccugacgaccagaggcggggaaccucauaugaucgucacaaagcaggaacggggaaaaucccuccuguuuaagaccucugccggcguuaauaugugcacacuuauugcgauggaccugggggaacucugugaagauaccaugacauacaaaugcccgcgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuaccacaucccaagagaccuggaaucgccaggaccugcucgucaccuucaaaacagcgcacgccaagaagcaggaaguggucgugcugggaucucaagagggcgcuaugcacacggcccugaccggggccacagaaauucagaccagcggaacaaccacgaucuuugcuggccaucucaaaugcagacugaagauggauaaacuuacacugaaggggauguccuauguuauguguaccggcagcuucaaacucgagaaggaaguggccgagacccagcacggaacaguccuggugcagauuaaguacgagggcaccgacgcgccgugcaaaaucccuuucucuacacaagaugaaaaggggguuacgcagaacggacggcugaucaccgcuaaucccauugugacagacaaagagaagccugucaacaucgaagccgagccgcccuuuggcgaguccuauauugugaucggggccggagaaaaagcucuuaagcucagcugguucaagaaaggcucuagcauugggaagauguuugaggccaccgcuagaggcgcccgccggauggcgauccugggagauacagccugggacuucggcuccaucgggggaguguuuaccucuguuggcaaacugguccaucagauuuucgggacggcuuacggagugcucuuuagcggcguguccuggaccaugaagaucgggauuggcguccugcuuacauggcugggacucaauagcagaucuaccucccugagcaugacauguaucgccgugggccugguuacccuuuaccucggggugaugguccaggcugauucuggaugcgugauuaacuggaaaggccgcgaacugaaguguggguccggaaucuucguuacaaaugaggugcacaccuggacggaacaauauaaguuucaggccgacagcccuaaacggcuguccgcggccauuggcaaggcuugggaggagggggucugcggcaucagaucugccacacgccucgaaaacaucauguggaaacagauuagcaacgagcugaaucauauccuucuggaaaacgacaugaaguucaccgugguugugggagaugucgugggcauucucgcucaggggaaaaagaugauccggccgcaacccauggagcacaaauacuccuggaagucuuggggaaaggccaaaauuaucggcgccgacgugcagaauaccacauuuaucauugaugggccuaacacccccgaauguccugacgaucagagagcuuggaauaucugggaggucgaggacuauggauucggcauuuuuacgacaaacaucuggcugaagcugcgcgauagcuacacccagaugugcgaccaccggcuuauguccgcggccauuaaagauagcaaggcuguucaugccgacaugggcuauuggaucgaaucugagaaaaaugaaacauggaagcucgccagagcuuccuucaucgaggugaagaccuguauuuggcccaaaagccacacacuguggucuaacggggugcuggaauccgagaugaucauuccgaagaucuacggaggcccuauuagccaacauaauuaucgccccggguacuucacccagacggccggaccuuggcaccucggcaaacuggagcuugauuuugaccugugcgaagggaccacagucgugguugaugagcacugcggaaaccggggccccucucucagaaccacaaccgugacgggcaagaucauccaugaaugguguugccggagcuguacacugccuccccugcgcuucaaaggggaggacggaugcugguacggcauggagauuagaccggucaaggaaaaggaggaaaaucuugugaaauccaugguuagcgcggggucuggagagguggacuccuuuagccucggccugcuguguaucuccauuaugaucgaagaggucaugcggucuagauggagccgcaagaugcucaugaccgggacacuggcuguguuccuucugcucauuaugggacagcugaccuggaacgaucugauccggcuuugcauuaugguuggcgccaaugccuccgacagaaugggcauggggaccacauaucuggcucucauggccacguuuaaaaugcgcccuauguucgcggugggacugcucuuuagacggcugaccucucgcgagguccuucugcucacaaucggccugagccugguggcuuccguggaacuucccaacucucuggaggaacucggggauggacuggccaugggcaucaugauucucaagcugcuuaccgacuuccaaagccaccagcugugggccacacuccugucccugaccuuuaucaaaacgacacuuagccugcauuacgcuuggaagaccauggccaugguccucucuauuguuucccuguucccccucugucugagcaccacaucucagaagaccacauggcuuccugugcugcuggggucccucggaugcaaaccgcugacgauguuucuuaucaccgagaauaagauuuggggcagaaaaagcuggccccugaacgaaggcaucauggcugugggggucgugucuauccuccuguccagccuccugaagaacgauguuccucuugccggaccccugauugcgggcgggaugcugaucgccuguuaugugauuuccggaagcucugcugaccucagccuggagaaagccgcugaggucuccugggaagaggaagccgagcacucuggcgccagccauaauauccuuguggaaguucaggaugacgggacaaugaagauuaaagaugaggagcgggacgauacccugacaauccuccugaaggcuacccuccuggcgguguccggagucuacccucuuucuauccccgccacgcuguucgugugguauuuuuggcaaaagaaaaagcagcgcagcggcguccugugggacaccccuagcccucccgaaguggagagagcuguucucgaugacggcauuuaccggaucaugcagcgcgggcugcuuggaagaucucaggugggcgucgggguguuccaagaaaacguuuuccacacaauguggcacgugacccggggagccguccugauguaucagggcaaacgccucgagcccagcugggccuccgugaagaaagaccugauuagcuacgggggaggcuggagacuccagggcucuuggaaugcuggggaggaagugcagguuaucgccgucgagcccggaaagaacccuaagaaugugcaaacagcgcccggcaccuuuaaaacaccggaaggggaggugggagcuauugcccuggauuucaagccuggcacguccgggagccccaucgucaaccgggaaggaaaaauugugggccuuuacggcaaugggguugugaccacaucuggaaccuaugucuccgccaucgcucaggccaaggcgagccaggagggcccucugcccgagaucgaagacgagguguuuagaaaacgcaaccugaccauuauggaucuccaucccggguccggaaagacacggagauaccugccugcuaucguucgcgaagccauuaagcggaaacuuagaacgcugauccucgccccgacccgcguggucgcuucugagauggccgaagcucugaagggcaugcccauucgguaucaaacaaccgccgugaaaagcgagcacacagggaaggagaucguugaccugaugugccaugcgaccuucacgaugagacuccuuuccccugugcgcguccccaauuacaacaugaucauuauggaugaagcccacuuuacagacccuagcucuaucgcugcccggggcuauauuuccaccagagugggaaugggcgaggcugccgccaucuucaugaccgcuacacccccugggagcguggaagcguuuccgcagucuaaugccgucauucaggaugaggaacgggacauccccgagcgcagcuggaacuccggacaugaguggaucaccgauuucccuggcaaaacaguuugguuugugcccucuauuaagagcgggaaugacaucgcuaacugucugagaaagaauggaaaacgggugauucagcugucccgcaagaccuucgauacggaauaccagaagaccaagaacaacgacugggacuaugucgugaccacagauaucucugagaugggcgccaauuuuagagccgaccggguuauugauccuagacgcugccucaaacccgugauccugaaggacgggccggaacgggucauucuugcuggcccuaugcccgugaccguugccagcgcggcucagagacgcggacggaucggcagaaaccacaauaaggagggggaucaguacaucuacaugggacagccccugaacaaugacgaggaucacgcccauuggacggaagccaaaaugcuccuggacaacauuaauaccccugagggcaucauucccgcucuguucgaaccugagcgcgaaaaguccgccgcgaucgauggggaguaucggcucagaggagaggcccgcaaaacauucguggaacuuaugagacggggcgaccugccggucuggcugagcuacaagguggcuucugagggguuucaauauuccgaucgcagauggugcuucgacggcgaacggaacaaucagguccucgaggaaaacauggauguggagauuuggaccaaagagggagaacgcaagaaacugagaccccgguggcuugacgccagaacauacagcgacccucuggcucuccgcgaguuuaaggaguucgccgcuggccggagauccguuucuggggaucugauccuggagaucggaaagcucccccagcaccuuacccagcgcgcccaaaaugcgcuggacaaccuggugaugcuccauaauagcgaacagggcgggcgggccuauagacacgcuauggaggagcugccugauacaauugaaacccuuaugcugcucgcccugaucgcugugcugacgggaggcgucacacucuuuuuccuuuccggccgggggcugggaaaaaccucuauuggccugcucuguguuauggccagcuccgugcugcuuuggauggccagcguggagccccacuggaucgcugcgucuauuauccuggaauuuuuccucaugguccugcugaucccggagccugaccgccagagaacaccccaggauaaccaacucgccuacgugguuauugggcuucuguuuaugauccugacaguggcugccaaugagaugggacuccuggaaaccacaaagaaagaccuuggcauugggcaugucgccguggagaaccaccaucacgcuacgaugcuggaugucgaccuccauccugccuccgcguggacccuguaugccguggcuacaaccaucauuacacccaugaugcggcacaccaucgaaaacacgaccgccaauauuagccugacagcuaucgccaaccaggcggccauccucaugggacuugauaagggcuggccuauuucuaaaauggacaucggcguuccccugcuggcucucgggugcuacucccaggugaauccgcugacccuuacagccgcuguccugaugcucguggcccacuacgcuauuaucggaccuggccugcaagccaaggcgacccgcgaggcccagaagagaacggcugccgggauuaugaaaaaccccacaguugauggaaucguggcuaucgaccuggaucccgucguguaugacgccaaguucgaaaaacagcucggccagauuaugcuucugauccuguguaccagccaaauucuccugaugcggacaaccugggcccuuugcgagucuaucacccuggcgacagggccucucacgacccugugggagggaagcccgggcaaguuuuggaauacaaccauugcuguguccauggccaacaucuuccgcggcucuuaccuggcuggggccggacucgccuuuagccuuaugaaaucccugggcgggggaagacggggcacaggggcucagggagaaacccugggcgagaaguggaagcgccagcucaaucagcugagcaaauccgaguucaacaucuauaagagaucuggcauuauggagguugaccggagcgaagccaaagaggggcuuaagagaggagagacgacacgccaugcggucucccggggcaccgccaaacugagaugguucguggaacgcaaucucgugaagcccgaggggaaggucaucgaucugggauguggcagagggggauggucuuacuauugcgcuggccugaaaaagguuaccgaagugaaaggcuacacaaaagggggaccuggccacgaggaacccauuccuauggccaccuauggguggaaccucgugaaacuucauagcggaaaggacgucuuuuucacacccccugagaaaugugauacgcugcugugcgacaucggcgaguccucuccgaaucccaccauugaagaggggagaacacuccgcgugcugaagaugguugaaccuuggcuucggggaaaccaauuuuguaucaagauucugaaucccuacaugccuagcguggucgagacccucgagcagaugcagagaaaauacggcggcaugcuggugcgcaacccccugucccggaauagcacacacgaaauguauuggguuucuugcgggaccggaaacaucguguccgcugucaauaugacgagcagaaugcuccugaaccgcuucaccauggcccaccggaagccgacauacgagagagauguggaccuuggcgcggggacccgccauguggccgucgaaccugagguugcuaaccuggauaucauuggacagagaaucgaaaauauuaaacacgagcauaagucuacauggcacuaugacgaggauaaccccuacaaaaccugggccuaucauggcuccuacgaagugaagcccagcgggucugcuuccagcauggugaauggagucgugaagcuccugacaaaaccuugggacguuauccccauggugacccaaauugccaugacggauacaaccccuuuuggccagcagcgggucuucaaggagaaaguggacacccgcacaccgaaggcuaaaagaggcacggcccaaaucauggaaguuaccgcgcgguggcuuuggggguuucuguccagaaacaagaagccccggaucuguacacgcgaggaguucaccagaaaagugcggagcaaugccgcuauuggagccgucuuuguggacgagaaccaguggaacucugcuaaggaggccguugaagaugagcgcuucugggaccucgugcagaaagaaagagagcugcacaagcagggcaaaugcgccacaugcgucuauaacaugauggggaagcgggaaaagaaacugggagaguuuggcaaggcgaaagggagccgcgcuaucugguacauguggcucggcgccagauuccuggaguuugaagcccuuggauucaugaaugaggaucacugguucucccgggaaaacucucugagcggcguggagggggagggacuccauaagcugggcuacauucuucgcgacaucuccaaaauuccugggggaaauauguaugcugaugacaccgccggcugggauacaagaaucaccgaagacgaucugcaaaacgaggcuaagaucacggacauuauggaacccgagcacgcccuccuggcgaccucuaucuuuaaacugacauaccagaauaaggucgugcggguucagcgcccugccaagaacgggaccgugauggaugucauuagcagacgggaccagcgcggcuccggacaagugggcacauaugggcucaauaccuucacgaacauggaagcucagcugaucagacagauggagucugagggaauuuuucuucccagcgaacuggagacaccgaaccucgccgaacgggugcuggauuggcuugagaaauacggcguugaaagacugaagcgcauggcuaucuccggggacgacuguguggucaaaccuaucgaugaccgguucgccaccgcgcucacagcccugaaugauaugggaaaggugagaaaagacauuccccagugggagccuagcaagggcuggaacgauuggcaacagguucccuuuugcucucaucacuuccaccagcugaucaugaaggacgggcgcgagauuguggucccuugucggaaucaggaugaacucgugggcagagcucgcgucucccaaggagccggcuggagccugcgggagaccgcuugccuugggaaaucuuaugcccagauguggcagcugauguacuuucauagacgcgaccuccggcuggcugccaacgcgaucuguuccgccgugcccguugauugggugccgacgagcagaaccacaugguccauucacgcucaucaccaauggaugaccacagaagacaugcuuucugucuggaaucgcguguggaucgaggaaaacccuuggauggaggauaagacccauguuagcuccuggggagacgugcccuaucugggcaaacgggaggaccaguggugcgggagccucauuggacugacagccagagccaccugggcuucuaauauccaggucgccaucaaccaggugcggagacugauuggcaaugaaaacuaccucgauuacaugacguccaugaagcgcuucaaaaaugagggggaccccgaaggcgcgcugugguga

SEQ ID NO: 19039 - RNA, 9879 nt, Artificial Sequence
  derived and/or modified CDS sequence (opt5) from DENV-1__GQ199795__SS-prME
agcgugaccaugcugcucaugcugaugcccaccgcccuugcuuuccaccugacgaccagaggaggggagccucauaugaucgucuccaagcaggaacggggaaaaucucuccuguuuaagaccagcgccggcguuaacaugugcacccuuaucgcgauggaccugggggagcucugugaagauaccaugaccuacaaaugccccagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccaggccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucagaggggaggacggaugcugguauggcauggagauucggccggugaaagaaaaggaggaaaaucuuguuaagagcauggugucugcuggguccggagaggucgacagcuuuucccucggccugcuguguaucucuauuaugaucgaagaggugaugagaagccgcuggucccggagaaugcucaugacagggacccuggccguuuucuuucuucugauuaugggacagcucacauggaacgaucugauccgccugugcauuauggugggcgccaaugcuucugacagaaugggcauggggaccaccuaccuugcccugauggcgacauucaaaaugcggccuauguuugcugucggacuccuguuccgcagacucacgagccgggaggugcugcuucugaccaucggccucucccugguggccucugucgaacugcccaacagccuugaggaacugggggauggacucgccaugggcaucaugauucugaagcuccugacagacuuucaaucccaucagcuuugggcuacccugcucagccugacauucaucaaaaccacguuuucucugcacuaugccuggaagacaauggcuaugguucuuuccauugugagccuguucccccucugucugucuaccaccucccagaaaacaaccuggcucccugugcugcuugggagccugggaugcaagccgcugacaauguuucucaucgccgagaauaagauuuggggccgcagaucuuggccccugaacgaaggcaucauggcggucgggaucguguccauucuucugagcucccuccugaaaaacgauguuccucucgccggaccccugaucgcuggcgggaugcuuauugccuguuacgugaucagcggaucuagcgcugaccugucccuggagaaggccgccgaggucucuugggaagaggaagcugagcauagcggcgcgucccacaauauucucguggaaguucaggaugacgggacgaugaaaaucaaggaugaggagcgggacgauacccugacaauccuucugaaagccacccuccuggcugugucuggagucuauccucucagcauucccgccacacuguucgugugguacuucuggcaaaagaaaaagcagcgcuccggcguccuuugggacaccccuucucccccggaaguggagagagccguucuggaugacggcaucuaucggauuaugcagcgcgggcugcucggaagaagccaggugggcgucgggguguuucaagaaaacguuuuccauacgauguggcacgugacccggggagcuguccugauguaccagggcaagagacuugagccuuccugggccagcgugaaaaaggaccugaucucuuacgggggaggcuggcgccuccagggcuccuggaauacaggggaggaagugcagguuauugcggucgagcccggcaagaacccuaagaaugugcaaaccgcucccggcacauuuaaaaccccggaaggggaggugggagccaucgcccuggauuucaagccuggcacaagcgggucucccauugucaaccgggaaggaaagaucgugggccucuauggcaaugggguugugacgaccuccggaacauacgucagcgcuaucgcccaggcgaaggcuucccaggagggcccucugcccgagauugaagacgagguguuuagaaagcgcaaccuuaccaucauggaucugcaccccgggucuggaaaaacccggagauaucugccugccauuguucgcgaagccaucaagcggaaacucagaacacugauucuugcuccgacgcgcguggucgccagcgagauggcugaagcccugaagggcaugcccauccgguaccaaaccacagcggugaaguccgagcauaccgggaaagagaucguugaccucaugugccacgccacauucaccaugagacugcugagcccugugcggguccccaauuauaacaugauuaucauggaugaagcucauuuuacggacccuucuuccauugccgcucgcggcuacaucagcacaagagugggaaugggcgaggccgccgcuauuuucaugaccgcgacacccccugggucuguggaagccuuuccgcagagcaaugcugucauccaggaugaggaacgggacauccccgagcgcuccuggaacucuggauaugaguggauuacagauuucccuggcaagaccguuugguuugugcccagcaucaaauccgggaaugacauugccaacugucucagaaagaauggaaaacgggugauccagcuuucuagaaagacauucgauaccgaauaccaaaagacgaaaaacaacgacugggacuacgucgugacaaccgauauuagcgagaugggcgccaauuuccgcgcugaccggguuaucgauccuagacgcugccugaagcccgugauucugaaagacgggccggaacgggucauccucgccggcccuaugcccgugacaguugcguccgcugcccagagacgcggacggaucggcagaaaccacaauaaggagggggaucaguauauuuacaugggacagccccugaacaaugacgaggaucaugcccacuggaccgaagcuaaaaugcuucuggacaacaucaauacgccugagggcauuauccccgcccucuuugaaccugagcgcgaaaagagcgcggccauugauggggaguauagacugcggggagaggcucgcaagaccuucguggaacugaugagacggggcgaccucccggucuggcuuucuuacaaaguggccuccgagggguuucaauauagcgaucgcagauggugcuucgacggcgaacggaacaaucagguccuggaggaaaacauggauguggagaucuggacaaaggagggagaacgcaagaaacugcgcccccgguggcucgacgcuagaaccuacuccgacccucuggcccuucgcgaguuuaaagaguucgcugccggccggagaucuguuagcggggaucugauccucgagauuggaaagcugccccagcaccugacacagcgggcgcaaaaugcccucgacaaccuugugaugcugcauaauuccgaacagggcgggcgcgcuuauagacacgccauggaggagcugccugauaccaucgaaacacucaugcugcuugcucugauugccgugcucaccggaggcgucacgcuguuuuuccugucuggccgggggcucggaaaaacaagcaucggccuucuguguguuauggccuccagcgugcugcucuggauggcuucuguggagccccauuggauugcggccuccaucauccuggaauuuuuccuuaugguccugcucauuccggagccugaccgccagagaacaccccaggauaaccaacuggcuuacgugguuaucgggcugcucuuuaugauucuuaccguggccgccaaugagaugggacugcuggaaacaaccaagaaggaccucggcaucgggcacgucgcuguggagaaccaccaucacgccgcgaugcuggaugucgaccuucauccugccagcgcuuggacacuguacgccguggcuacgaccauuaucacacccaugaugcggcacaccauugaaaacacaaccgccaauaucucucucacggcgaucgccaaccaggcugccauucugaugggacuggauaaaggcuggccuaucuccaagauggacauuggcguuccccuccuugcucuggggugcuauagccaggugaauccgcugacccucacagccgcuguccugaugcuuguggcccauuacgcgaucauuggaccuggccugcaagccaaagcuacccgcgaggcccagaagagaacagcugccgggaucaugaaaaaccccaccguugauggaaucguggccauugaccucgaucccgucguguaugacgcgaaguucgaaaagcagcugggccagaucaugcugcucauucuuuguacgucucaaauccugcugaugcggacaaccugggcucucugcgagagcauuacacuggccaccgggccucuuaccacacugugggagggauccccgggcaaauuuuggaauacgaccaucgcugugucuauggccaacaucuuccgcggcagcuaccucgccggggcuggacuggccuucucccugaugaaaagccucggcgggggaagacggggcacaggggcgcagggagaaacccuuggcgagaaauggaagagacagcugaaucagcuguccaaaucugaauuuaacacauauaagcgcagcggcauuauggagguugaccgguccgaagccaaggaggggcucaaaagaggagagaccacgaagcacgcugucucucgcggcacagccaaacugcggugguucguggaaagaaaucuugugaagcccgaggggaaagucaucgaucugggauguggccgcgggggauggagcuacuauugcgcuggccucaagaagguuaccgaagugaaaggcuacaccaaaggcgggccugggcacgaggaccccauuccuauggccacauacggguggaaccuggugaaacugcauuccggaaaggaugucuuuuucauucccccugaaaaaugugacacccuccuuugcgauauuggcgagucuagcccgaaucccacaaucgaggaagggcggacgcugagagugcugaagaugguugagccuuggcuccgcggaaaccaauuuuguauuaaaauccugaaucccuauaugccuuccguggucgaaacccuugagcagaugcagcggaagcacggcggcaugcuggugagaaacccccucagccgcaauucuacacaugagauguacuggguuuccugcgggaccggaaacaucgugagcgcggucaauaugacaucucggaugcugcugaacagauucaccauggcccaccgcaagccgacguaugaaagagacguggaucucggcgcugggacccggcacguggccgucgagccugaaguugcuaaccuggacauuaucggacagcgcauugagaauaucaaacaugaacacaaguccacauggcauuacgaugaggacaaccccuauaaaaccugggccuaccacggcagcuaugaggugaagcccucuggguccgcuagcuccauggugaauggagucgugaaacuucugacaaagccuugggauguuauucccauggugacccaaaucgccaugacagacaccacgccuuuuggccagcagagagucuucaaggaaaaaguggacacacggaccccgaaggcgaaaagaggcaccgcccaaaucauggagguuacagcuaaguggcucuggggguuucugagccggaacaaaaagccccgcauuuguacgagagaagaguucacccggaaggugcgcucuaaugccgcuaucggagccgucuuuguggaugaaaaccaguggaauagcgccaaagaggcgguugaggacgaaagauucugggaucuugugcaucgggagcgcgaacugcacaagcagggcaaaugcgcuacaugcgucuacaacaugauggggaagagagagaaaaagcucggagaauuuggcaaggccaaagggucccgggccauuugguacauguggcugggcgcucgcuuccuggaguucgaggcccucggauuuaugaaugaagaccacugguucucuagagagaacagccuguccggcguggaaggggagggacuucauaagcugggcuauauccuccgggauauuucuaaaaucccugggggaaauauguacgcugacgauaccgccggcugggacacacgcaucaccgaggaugaccugcagaacgaagcgagaauuacagauaucauggagcccgaacacgcccuucuggcuaagagcauuuuuaaacucaccuaucaaaauaaggucgugcggguucagcgcccugccaaaaacgggacggugauggacgucaucuccagacgggaucagagaggcucuggacaggugggcaccuacgggcugaauacauucaccaacauggaggcucaacugauucgccagauggaaagcgagggaaucuuuucccccagcgagcucgaaacaccgaaccuggccgagcgggugcuugacuggcuggaaaaguauggcguugagagacucaagcgcauggcgaucucuggggacgauuguguggucaaaccuauugacgaucgguucgccaccgcucugacggcccuuaaugacaugggaaaggugagaaaagauaucccccagugggaaccuuccaagggcuggaacgacuggcagcaaguucccuuuugcagccaucacuuccaccagcugauuaugaaagaugggcgcgagaucguggucccuugucggaaucaggacgagcucgugggcagagcucgcgucucucagggagccggcuggucccugcgggaaacagcuugccugggaaagagcuacgcccaaauguggcagcucauguauuuucauagacgcgaucugcggcuugcggccaacgcuauuuguuccgccgugcccguugacuggaucccgaccucuagaacaaccuggagcauucacgcccaucaccaguggaugacgaccgaggauaugcuguccguguggaaucgggucuggaucgaagagaacccuuggauggaagacaagacacauaucagcucuuggggagacgugcccuaccucggcaaaagagaggaucaauggugcgggucccugauuggacuuaccgcucgcgccacaugggcgaccaauauccagguugcuauuaaccaggugcggagacugaucggcaaugagaacuaccucgacuauaugacaagcaugaagcgcuucaaaaaugaaucugaucccgagggggcccugugguga

SEQ ID NO: 19040 - RNA, 9873 nt, Artificial Sequence
  derived and/or modified CDS sequence (opt5) from DENV-1__FJ882547__SS-prME
agcgugaccaugcugcucaugcugaugcccaccgcccuugcuuuccaccugacgacccggggaggggaaccucauaugauuguguccaagcaggaacggggaaaaucucuccuguuuaagaccagcgccggcguuaauaugugcacccuuauugcgauggaccugggggaacucugugaagauacaaugaccuacaaaugcccccgcaucacagaagcugaacccgacgauguggacuguuggugcaaugccaccgauacgugggugaccuauggaacauguucccaaaccggcgagcacagacgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaagcucacaguuguggucggagauguggcuggcauucuggggcagggcaagaaaaugauccggccgcaacccauggaguacaaauauucuuggaaaagcuggggcaaggccaagauuaucggggccgacgcucagaauaccaccuucaucauugauggaccuaacacacccgaauguccugacgaucagagagcguggaauaucugggagguggaggacuacggcuuuggcauuuucaccacgaacaucuggcugaaacuucgcgauuccuauacacaggucugcgaccaccggcucaugagcgccgcuauuaaagauucuaaggccguucacgccgacaugggguacuggaucgaauccgagaaaaaugaaaccuggaagcuggcuagagccagcuuuaucgaggugaagacauguauuuggcccaaaucucauacccugugguccaacggagugcucgaaagcgagaugaucauuccgaagaucuauggcgggccuauuucucaacacaauuaccgccccggauacuucacacagaccgcgggcccuuggcaucuggggaaacuugagcuggauuucgaccucugcgaaggaacgaccgucgugguugaugagcacugcggcaaccggggccccagccugagaacaaccacagugaccgggaagaucauccacgaaugguguugccgguccuguacgcugccuccccuucgcuuuagaggagaggacggcugcugguaugggauggagauucggccggucaaagaaaaggaggaaaaucucgucaagagcaugguuucugcuggauccggcgagguggacagcuucucccuggggcugcucuguaucucuauuaugaucgaagaggucaugagaagccgcuggucccggaaaaugcugaugacaggaacccuugccguguuuuuccugcucauuaugggccagcugacauggaacgaucugaucagacuuugcauuaugguuggcgccaaugcuucugaccgcauggggaucggaaccaccuaccuggcccucauggcgacauuuaagaugagaccuauguucgcugugggccugcucuuucggcgccugacgagcagagagguccuucugcucaccaucgggcugucccugguggccucuguggaacuucccaacagccuggaggaacucggagauggccuggccauggggauuaugaugcucaaacugcuuacagacuuccaaucccaucagcugugggcuacccuccugagccugacauuuaucaagaccacguucucucuucacuaugccuggaaaacaauggcuaugguccuguccauuguuagccucuuuccccugugucucucuaccaccucccagaagacaaccuggcugccugugcuucugggaagccugggcugcaagccgcucacaauguuccugaucgccgagaauaaaauuuggggccggaagucuuggccccuuaacgaagggaucauggcggugggaaucgucuccauucugcucagcucccugcucaaaaacgaugugccucuggccggcccccuuaucgcugggggaaugcugauugccuguuacguuaucagcggcucuagcgcugaccugucccucgagaaggccgccgaggugucuugggaagaggaagcugagcauagcggggcgucccacaauauucuggucgaagugcaggaugacggaacgaugaaaaucaaggaugaggagcgcgacgauacccuuacaauccugcucaaagccacccugcucgcuguuucuggcguguauccucugagcauucccgccacacuuuuugucugguacuucuggcaaaagaagaaacagagauccggcgugcugugggacaccccuucucccccggaagucgagcgggccgugcuggaugacgggaucuaucgcauuaugcagagaggacuccugggccggagccagguuggggugggagucuuccaagaaaacguguuucauacgauguggcacguuacccgcggcgcugugcuuauguaccaggggaagagacuggagccuuccugggccagcgucaaaaaggaccucaucucuuacggaggcggcuggcggcugagaggguccuggaauacaggagaggaaguccaggugauugcgguugagcccggcaaaaacccuaagaauguccagaccgcucccgggacauucaagaccccggaaggagaggugggcgccaucgcccucgauuuuaaaccugggacaagcggaucucccauugugaaccgcgaaggcaagaucgucggccuguaugggaauggagugguuacgaccuccggcacauacgugagcgcuaucgcccaagcgaaggcuucccaggaggggccucuucccgagauugaagacgaggucuuccggaagagaaaccugaccaucauggaucugcaccccggaucuggcaaaacccgccgguaucucccugccauugugagagaagccaucaagcgcaagcugcggacacuuauucuggcuccgacgagaguuguggccagcgagauggcugaagcccucaaagggaugcccauccgcuaccagaccacagcggucaaguccgagcauaccggcaaagagaucguggaccugaugugccacgccacauuuaccaugcggcugcucagcccuguuagagugcccaauuauaacaugauuaucauggaugaagcucauuucacggacccuucuuccauugccgcucggggauacaucagcacacgcgucggcaugggggaggccgccgcuauuuuuaugaccgcgacacccccuggaucuguggaagccuucccgcaaagcaaugcugugauccaggaugaggaaagagacauccccgagcgguccuggaacucuggcuaugaguggauuacagauuuuccugggaagaccgucugguucguucccagcaucaaauccggaaaugacauugccaacugucuucgcaagaauggcaagagagugauccagcugucucggaaaacauuugauaccgaauaccagaagacgaaaaacaacgacugggacuacguggucacaaccgauauuagcgagaugggggccaauuucagagcugaccgcgugaucgauccucggagaugccugaagcccguuauucucaaagacggcccggaacgcgugauccuggccggaccuaugcccgucacaguggcguccgcugcccaacggagaggccgcaucgggcggaaccacaauaaggagggagaucaguauauuuacaugggccagccccuuaacaaugacgaggaucaugcccacuggaccgaagcuaagaugcugcucgacaacaucaauacgccugaggggauuauccccgcccuguucgaaccugagagagaaaagagcgcggccguugauggagaguaucgccugagaggcgaggcucggaagaccuuuguggagcucaugcgcagaggggaccuuccggucuggcugucuuacaaaguggccuccgagggcuuccaguauagcgaucggcgcuggugcuuugacggagaaagaaacaaucaaguccuggaggaaaacauggauguggagauuuggacaaaggagggcgaagggaaaaagcuccggcccagauggcuggacgcucgcaccuacuccgacccucuugcccugcgggaguucaaagaauuugcugccggaagacgcucuguuagcggcgaucucauccuggagaucgggaagcugccccagcaccucacacagcgggcgcagaaugcccuugacaaccuggugaugcugcauaauuccgaacaaggaggcagagcuuaucggcacgccauggaggagcucccugauaccauugaaacacugaugcuucuggcucucaucgccgugcugaccggcggggucacgcuguucuuucucucuggacgcggccuugggaagacaagcauuggacugcuguguguuauggccuccagcgugcuccuguggauggcuucuguggagccccauuggaucgcggccuccauuauccuugaguucuuucugaugguccuccugaucccggagccugacagacagcggacaccccaggauaaccagcuggcuuacgugguuauuggccuccuuuucaugauccugaccguggccgccaaugagauggggcugcucgaaacaaccaaaaaggaccugggaauuggccacgucgcuguggagaaccaccaucacgccgcgaugcuugaugucgaccugcauccugccagcgcuuggacacucuacgccguggcuacgaccaucauuacacccaugaugcgccacaccaucgaaaacacaaccgccaauauuucucugacggcgaucgccaaccaagcugccauccugaugggccucgauaaaggguggccuauuuccaagauggacaucggaguuccccuucuggcucugggcugcuauagccaggugaauccgcucacccugacagccgcuguccuuaugcugguggcccauuacgcgauuaucgggccuggacuccaggccaaagcuaccagagaggcccaaaagcggacagcugccggcauuaugaagaaccccaccguugaugggaucguggccaucgaccuggaucccgucguguaugacgcgaaauuugaaaagcagcugggacagauuaugcuccuuauccuguguacgucucagauucugcucaugcgcacaaccugggcucugugcgagagcaucacacuugccaccggcccucugaccacacucugggagggcuccccggggaaauucuggaauacgaccauugcugugucuauggccaacaucuuuagaggaagcuaccuggccggcgcugggcuggccuucucccucaugaaaagccuuggaggcgggcggcgcggaacaggcgcgcaaggcgaaacccugggggagaaauggaagagacagcugaaucagcucuccaagucugaguucaacacauauaaacggagcggaaucauggagguugacagauccgaagccaaggagggccugaaacgcggggagaccacgaagcacgcugucucucggggaacagccaaacuuagaugguuuguggaacgcaaucuggugaagcccgagggcaaggucauugaucucggguguggacggggcggcuggagcuacuauugcgcugggcugaaaaagguuaccgaagugaaaggauacaccaagggcgggccuggacacgaggaacccaucccuauggccacauacggcuggaaccuggugaaacuccauuccgggaaggacgucuucuuuauucccccugagaaaugugauacccuucugugcgacaucggagagucuagcccgaaucccacaauugaagagggcagaacgcugcgcgugcucaagaugguugaaccuuggcugcggggcaaccaguucuguaucaagauucuuaaucccuauaugccuuccguggucgagacccuggagcaaaugcagagaaaacacgggggaaugcucgugcgcaacccccugagcagaaauucuacacaugaaauguacuggguuuccugcggcaccgggaacaucgugagcgcggucaauaugacaucuagaaugcugcucaaccgcuuuaccauggcccaccggaagccgacguaugagagagauguggaccugggaaccggcacacgccacguggcugucgaaccugagguugccaaccuugauaucauugggcagagaaucgaaaauauuaaacaugagcacaaguccaccuggcauuacgacgaggauaaccccuauaaaacaugggcuuaccacggaagcuaugaagugaagcccucuggcuccgccagcuccauggugaauggcgucgugaagcugcucaccaaaccuugggacguuauccccaugagcccuauugcuaugacagauaccacgccgcuggcccagcggguguucaaggagaaagucgacacacgcacccccaaggcgaaaagagggaccgcccaaaucauggaagugacagcucgguggcuuuggggauuucugucuagaaacaagaagccucggaucuguacgcgcgaggaguucaccagaaaaguucggagcaaugccgcuauuggcgccguguuugucgacgagaaccaguggaacuccgccaaggaggcgguggaagaugagcgcuucugggaccucguucauagagaacgggagcugcacaaacaggggaagugcgcuacaugcguguacaacaugaugggaaaacgcgaaaagaagcugggcgaguuugggaaagccaagggcucuagagccaucugguacauguggcucggagcucgguuccuggaguuugaagcccuuggcuucaugaaugaggaucacugguucagccgcgaaaacucccugucuggggucgagggagagggccuccauaaacugggguauauucuuagagacaucagcaagauucccggaggcaauauguacgcugaugacaccgccgggugggauacacggaucaccgaagacgaucugcaaaacgaggcgaaaaucacagacauuauggaaccugagcacgcccuccuggcuaaggccaucuuuaaacugaccuaucagaauaaggugguccgcgugcagagacccgcuaagaacggcacgguuauggaugugauuucccggcgcgaccagagaggaucuggccaagucgggaccuacggacucaauacauucaccaacauggaagcccagcugauccggcagauggagagcgaggaaaucuuuuccccgagcgagcuugaaacaccuaaccuggcggagagagcccucgauuggcuggaaaaauauggcguggagcgccuuaagcggauggcuaucucuggggacgacugugugguuaaacccaucgaugacagauucgccaccgcucugacggcccucaaugauaugggaaaggugcgcaaagacauuccucagugggagcccuccaagggcuggaacgauuggcaacaggucccuuuuugcagccaucacuuccaccagcugaucaugaaggacgggcgggaaauugugguucccuguagaaaucaggaugagcuggugggccgcgcucgggucucucaaggagccggcuggucccucagagaaacagcgugccuggggaaaagcuacgcccagauguggcagcuuauguauuuucaucgccgggaccugagacucgcugccaacgccaucuguuccgcugugccggucgauugggugccuaccucucgcacaaccuggagcauucacgcccaucaccaguggaugacgaccgaggacaugcuguccguuuggaaucggguguggaucgaagagaaccccuggauggaggauaagacacauauuagcucuugggaagacguccccuaccuuggaaaaagagaggaccaauggugcggcucccugaucgggcucaccgcgcgggcuacaugggccaccaauauccagguggccauuaaccagguuagacgccugaucggaaaugaaaacuaccuggauuauaugacaagcaugaagcgguucaaaaaugagucugacccugagggcgcucucugguga

SEQ ID NO: 19041 - RNA, 9879 nt, Artificial Sequence
  derived and/or modified CDS sequence (opt5) from DENV-1__GQ199797__SS-prME
agcgugaccaugcugcugaugcugaugcccaccgcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucucucacauuuauuaagaccacguucucccugcacuaugccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuacgugauuucuggaagcuccgcugaccuuucucuggagaaggccgccgaggucagcugggaagaggaagcugagcauuccggcgcgucucacaauauccugguggaaguucaggaugacgggacgaugaaaauuaaggaugaggagcgggacgauacccucacaauccugcuuaaggccacccugcucgcugugagcggagucuauccucuguccauccccgccacacucuucgugugguacuuuuggcagaaaaagaaacaacgcucuggcguccugugggacaccccuuccccucccgaaguggagagagccguucuugaugacggcauuuaucggaucaugcagcgcgggcugcugggaagaucccaggugggcgucgggguguuccaggaaaacguuuuucauacgauguggcacgugacccggggagcuguccucauguaccaaggcaagcgccuggagcccagcugggccucugugaaaaaggaccuuauuuccuacgggggaggcuggagacugcagggcagcuggaauacaggggaggaagugcagguuaucgcggucgagcccggaaagaacccuaaaaaugugcagaccgcucccggcacauucaagaccucugaaggggaggugggagccauugcccucgauuuuaaaccgggcacauccgggagcccuaucgucaaccgggaaggaaagauugugggccuguauggcaaugggguugugacgaccuccggaacauacgucucugcuaucgcccaagcgaaagcuagccaggagggcccccucccugagaucgaagacgagguguucagaaagcgcaaccugaccauuauggaucuucaccccggguccggaaagacccggagauaucugcccgccaucguucgcgaagccauuaaacggaagcugagaacacucauccuggcuccuacgcgcguggucgccagcgagauggcugaagcccuuaaaggcaugccgauucgguaccagaccacagcggugaagucugagcauaccgggaaagagaucguugaccugaugugccacgccacauuuaccaugagacuccugucccccgugcgcgucccuaauuauaacaugaucauuauggaugaagcucauuucacggaccccagcucuaucgccgcucggggcuacauuagcacaagagugggaaugggcgaggccgccgcuaucuuuaugaccgcgaccccucccggguccguggaagccuucccucaaucuaaugcugucauucaggaugaggaacgggacaucccggagcgcagcuggaacuccggauaugaguggaucacagauuuucccggcaagaccguuugguucgugccuucuauuaagagcgggaaugacaucgccaacugucugcgcaagaauggaaagcgggugauucagcucucccgcaaaacauucgauaccgaauaccagaagacgaaaaacaacgacugggacuacgucgugacaaccgauaucagcgagaugggcgccaauuuuagagcugaccggguuauugaucccagacgcugccuuaagccugugauccugaaggacgggcccgaacgggucauucuggccggcccgaugccugugacaguugcgucugcugcccaaagacgcggacggaucggcagaaaccacaauaaagagggggaucaguauaucuacaugggacagccccucaacaaugacgaggaucaugcccacuggaccgaagcuaagaugcugcuugacaacauuaauacgcccgagggcaucauuccugcccuguucgaacccgagcgcgaaaaauccgcggccaucgauggggaguaucggcucagaggagaggcucgcaagaccuuuguggaacugaugagacggggcgaccugccugucuggcucagcuacaaaguggccuccgagggguuccaguauucugaucgcagauggugcuuugacggcgaacggaacaaucaaguccuugaggaaaacauggauguggagauuuggacaaaggagggagaacgcaaaaagcugagaccgcgguggcuggacgcuagaaccuacagcgacccccucgcccugcgcgaguucaaggaauuugcugccggccggagauccguuucuggggaucuuauccuggagaucggaaaacucccucagcaccugacacagcgcgcgcagaaugcccuggacaaccucgugaugcuucauaauagcgaacaaggcgggcgggcuuauagacacgccauggaggagcugcccgauaccauugaaacaaugaugcugcucgcucugaucgccgugcuuaccggaggcgucacgcuguucuuucucuccggccgggggcugggaaagacaagcauuggccugcucuguguuauggccucuuccgugcuucuguggauggcuagcguggagccucauuggaucgcggccucuauuauccuggaguucuuucucaugguccugcuuauccccgagccggaccgccagagaaccccucaggauaaccagcuggcuuacgugguuauugggcuccuguucaugauccugaccguggccgccaaugagaugggacuccuugaaacaaccaaaaaggaccugggcauugggcacgucgcuguggagaaccaccaucacgccgcgaugcuggaugucgaccuccaucccgccuccgcuuggacacuguacgccguggcuacgaccaucauuacaccuaugaugcggcacaccaucgaaaacacaaccgccaauauuagccuuacggcgaucgccaaccaagcugccauccugaugggacucgauaaaggcuggcccauuucuaagauggacaucggcguuccucugcuggcucucgggugcuauagccaggugaauccccuuacccugacagccgcuguccugaugcucguggcccauuacgcgauuaucggaccgggccugcaggccaaggcuacccgcgaggcccagaagagaacagcugccgggauuaugaagaacccuaccguugauggaaucguggccaucgaccuugaucccgucguguaugacgcgaaauuugaaaagcagcugggccagauuaugcuccugauccuguguacgucccagauucuccuuaugcggacaaccugggcucugugcgagucuaucacacuggccaccgggccccucaccacacugugggagggaagcccuggcaaauucuggaauacgaccauugcuguguccauggccaacaucuuccgcggcagcuaccuugccggggcuggacuggccuuuucccucaugaagucucugggcgggggaagacggggcacaggggcgcaaggagaaacccugggcgagaaguggaaacgccagcucaaucagcuuagcaaguccgaguucaacacauauaaaagaucuggcaucauggagguugaccggagcgaagccaaggaggggcugaaaagaggagagaccacgaagcacgcugucucccgcggcacagccaagcugcggugguuuguggaaagaaaucucgugaaaccggaggggaaggucauugaucugggauguggccgcgggggauggucuuacuauugcgcuggccuuaaaaagguuaccgaagugaaaggcuacaccaaagggggacccggccacgaggaaccuauccccauggccacauacggguggaaccuggugaaacuccauagcggaaaggacgucuucuuuauuccucccgagaagugugauacccugcugugcgacaucggcgaguccagcccuaauccgacaauugaagaggggcggacgcucagagugcuuaaaaugguugaacccuggcugcgcggaaaccaguucuguaucaagauucugaauccuuauaugcccucuguggucgagacccucgagcaaaugcagcggaaacacggcggcaugcuggugagaaacccucuuucccgcaauagcacacaugaaauguacuggguuucuugcgggaccggaaacaucguguccgcggucaauaugacaagccggaugcugcucaacagauuuaccauggcccaccgcaagcccacguaugagcgggauguggaccugggcgcugggaccagacacguggccgucgaaccggagguugcuaaccuggauaucauuggacagcgcaucgaaaauauuaaacaugagcacaagucuacauggcauuacgacgaggauaacccuuauaagaccugggccuaccacggcuccuaugaagugaaacccagcggguccgcuagcucuauggugaauggagucgugaagcuccugacaaaacccugggacguuaucccuauggugacccagauugccaugacagauaccacgcccuucggccaacagagagucuuuaaggagaaaguggacacacggaccccuaaggcgaagcgcggcaccgcccagaucauggaaguuacagcuaaauggcuuuggggguuccugagcagaaacaagaaaccgcggaucuguacgagagaggaauuuacccggaaggugcgcuccaaugccgcuauuggagccgucuucguggacgagaaccaauggaacucugccaaagaggcgguugaagaugagagauuuugggaccucgugcaucgggaacgcgagcugcacaagcagggcaagugcgcuacaugcgucuacaacaugauggggaaaagagaaaagaaacuuggagaguucggcaaggccaaagggagccgggccaucugguacauguggcugggcgcucgcuuccucgaguuugaagcccugggauucaugaaugaggaucacugguuuuccagagaaaacucucugagcggcguggagggggagggacuccauaagcugggcuauauucuucgggacaucuccaaaauucccgggggaaauauguacgcugaugacaccgccggcugggauacacgcaucaccgaagacgaucugcagaacgaggcgaagaucacagacauuauggaaccugagcacgcccuccuggcuaagucuaucuucaaacuuaccuaucagaauaaggucgugagaguucaacggcccgccaaaaacgggacggugauggaugucauuagccgcagagaccagcggggcuccggacaggugggcaccuacgggcugaauacauuuaccaacauggaagcucagcucauccgccaaauggagagcgagggaauuuucucuccuuccgaacuggagacacccaaccuggccagacgggugcucgauuggcuggaaaagcauggcguugagagacuuaaacgcauggcgaucagcggggacgacuguguggucaagccgaucgaugaccgguuugccaccgcucugacggcccucaaugauaugggaaaggugagaaaagacauuccucagugggaacccucuaagggcuggaacgauuggcagcagguuccuuucugcucccaccacuuucaucaacugaucaugaaagacgggcgcgagauugugguccccugucggaaucaggaugagcuugugggcagagcucgcgucagccagggagccggcuggucccugcgggaaacagcuugccucgggaagucuuaugcccagauguggcaacugauguacuuccacagacgcgaccugcggcucgcggccaacgcuaucuguagcgccgugccuguugauugggugcccaccuccagaacaaccuggagcauucaugcccaccaucaguggaugacgaccgaggacaugcugucugucuggaaucgcguguggaucgaagagaacccguggauggaagauaaaacacacauuuccagcuggggagacguuccuuaucuuggcaagcgggaggaccaguggugcgggucucugaucggacucaccgcuagagccacaugggcgaccaauauccaaguggcuauuaaccagguccggagacugaucggcaaugagaacuaccuugauuacaugacaagcaugaagcgcuuuaaaaaugaauccgaccccgagggggcccugugguga

SEQ ID NO: 19042 - RNA, 9879 nt, Artificial Sequence
  derived and/or modified CDS sequence (opt5) from DENV-1__GQ199799__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagagcaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguuccccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccccccuucggcgagucuuauauugugaucggggccggagaaaaagcucugaagcuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacugaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaagcugacgguuguggucggagauguggcuggcauucucgcccaggggaaaaagaugauccggccgcaacccauggaguacaaauauagcuggaaguccuggggaaaggccaaaauuaucggcgcugacgugcagaauacaaccuuuaucauugaugggccuaacacccccgaauguccugacgaucagagagcguggaauaucugggaggucgaggacuacggauucggcauuuuuacaaccaacaucuggcugaagcugcgcgauagcuauacgcagguuugcgaccaccggcuuaugucugccgcuauuaaagauuccaaggccgugcacgccgacaugggcuacuggaucgaaagcgagaaaaaugaaacauggaagcucgcuagagccucuuucaucgaggugaagaccuguauuuggcccaaaucccauacacuguggagcaacgggguccuggaaucugagaugaucauuccgaagaucuauggaggcccuauuagccaacacaauuaccgccccggguacuucacccagacagcgggaccuuggcaucucggcaaacuggagcuugauuuugaccugugcgaagggaccacggugguuguggaugagcacugcggaaaccggggccccucccucagaaccacaaccgucacaggcaagaucauccacgaaugguguugccggagcuguacccugccuccccugcgcuucaaaggggaggacggaugcugguauggcauggagauuagaccggugaaggaaaaggaggaaaaucuuguuaaaucuaugguguccgcugggagcggagaggucgacuccuuuucucucggccugcuguguaucagcauuaugaucgaagaggugaugcgguccagauggucucgcaagaugcucaugacggggacacuggccguuuucuuucuucugauuaugggacagcucaccuggaacgaucugauccggcugugcauuauggugggcgccaaugcuagcgacagaaugggcauggggacaaccuaccuugcccugauggcgaccuucaaaaugcgcccuauguuugcugucggacuccuguucagacggcucacaucccgcgaggugcugcuucugacgaucggccucucucugguggccagcgucgaacugcccaacucccuugaggaacugggggauggacucgccaugggcaucaugauucugaagcuccugaccgacuuucaaccccaucagcuuugggcuacacugcucagccugaccuucaucagaacaaccuuuucucugcacuaugccuggaaaacgauggcuaugguucuuuccauugugagccuguucccucucugucugucuacaaccucccagaagaccacauggcucccggugcugcuugggagccugggaugcaagccccugaccauguuucucaucgccgagaauaaaauuuggggccggaagucuuggccucugaacgaaggcaucauggcggucgggaucguguccauucuucugagcucccuccugaaaaacgauguuccccucgccggaccucugaucgcuggcgggaugcuuauugccuguuacgugaucagcggaucuagcgcugaccugucccuggagaaggccgccgaggucucuugggaagaggaagcugagcauagcggcgcgucccacaauauucucguggaaguucaggaugacgggacaaugaaaaucaaggaugaggagcgcgacgauacgcugaccauccuucugaaagccacacuccuggcugugucuggagucuauccccucagcauuccugccacccuguucgugugguacuucuggcaaaagaagaaacagagauccggcguccuuugggacacacccucuccgccugaaguggagcgggccguucuggaugacggcaucuaucgcauuaugcagagagggcugcucggacggagccaggugggcgucgggguguuucaagaaaacguuuuccauaccauguggcacgugacgcgcggagcuguccugauguaccagggcaagagacuugagcccuccugggccagcgugaaaaaggaccugaucucuuacgggggaggcuggcggcuccagggcuccuggaauaccggggaggaagugcagguuauugcggucgagccuggaaaaaaccccaagaaugugcaaacagcuccgggcaccuuuaagacaagcgaaggggaggugggagccaucgcccuggauuucaaaccuggcaccucugggucccccauugucaacagagaaggaaagaucgugggccucuauggcaaugggguugugacaacgagcggaaccuacgucuccgcuaucgcccaggcgaaagcuucucaggagggcccucugcccgagauugaagacgagguguuucgcaagcggaaccuuacaaucauggaucugcaccccgggagcggaaaaaccagacgcuaucugccugccauuguucgggaagccaucaagagacgccuccggacccugauucuugcuccgacaagaguggucgccuccgagauggcugaagcccugaagggcaugcccauccgcuaccaaacgaccgcggugaaaagcgagcauacagggaaggagaucguugaccucaugugccacgccaccuucacaaugcggcugcugucuccugugagaguccccaauuauaacaugauuaucauggaugaagcucauuuuaccgacccuuccagcauugccgcucggggcuacaucucuacgcgcgugggaaugggcgaggccgccgcuauuuucaugacagcgacccccccugggagcguggaagccuuuccgcaguccaaugcugucauccaggaugaggaaagagacauccccgagcggucuuggaacagcggauaugaguggauuaccgauuucccuggcaaaacaguuugguuugugcccuccaucaagucugggaaugacauugccaacugucuccgcaaaaauggaaagagagugauccagcuuagccggaagaccuucgauacagaauaccaaaaaaccaagaacaacgacugggacuacgucgugacgacagauauuuccgagaugggcgccaauuucagagcugaccgcguuaucgauccucggagaugccugaaacccgugauucugaaggacgggccggaacgcgucauccucgccggcccuaugcccgugaccguugcgagcgcugcccagcggagaggacgcaucggccggaaccacaauaaagagggggaucaguauauuuacaugggacagccccugaacaaugacgaggaucaugcccacuggacagaagcuaagaugcuucuggacaacaucaauaccccugagggcauuauccccgcccucuuugaaccugagagagaaaagucugcggccauugauggggaguaucgccugagaggagaggcucggaaaacguucguggaacugaugcgcagaggcgaccucccggucuggcuuuccuacaagguggccagcgagggguuucaauauuccgaucggcgcuggugcuucgacggcgaaagaaacaaucagguccuggaggaaaacauggauguggagaucuggaccaaagagggagaacggaagaaacugagaccccgcuggcucgacgcucggacauacucugacccucuggcccuuagagaguuuaaggaauucgcugccggccgccggagcguuuccggggaucugauccucgagauuggaaaacugccccagcaccugacccagagagcgcaaaaugcccucgacaaccuugugaugcugcauaauucugaacagggcgggcgggcuuaucgccacgccauggaggagcugccugauacaaucgaaacccucaugcugcuugcucugauugccgugcucacaggaggcgucacccuguuuuuccugagcggcagagggcucggaaagacguccaucggccuucuguguguuauggccagcucugugcugcucuggauggcuuccguggagccccauuggauugcggccagcaucauccuggaauuuuuccuuaugguccugcucauuccggagccugaccggcagcgcacaccccaggauaaccaacuggcuuacgugguuaucgggcugcucuuuaugauucuuaccguggccgccaaugagaugggacugcuggaaaccacaaagaaagaccucggcaucgggcacgucgcuguggagaaccaccaucacgccgcgaugcuggaugucgaccuucauccugccucugcuuggacccuguacgccguggcuacaacgauuaucacccccaugaugagacacacaauugaaaacaccacagccaauaucucccucaccgcgaucgccaaccaggcugccauucugaugggacuggauaagggcuggccuaucagcaaaauggacauuggcguuccccuccuugcucuggggugcuauucucaggugaauccgcugacgcucaccgccgcuguccugaugcuuguggcccauuacgcgaucauuggaccuggccugcaagccaaggcuacacgggaggcccagaaacgcaccgcugccgggaucaugaagaaccccacaguugauggaaucguggccauugaccucgaucccgucguguaugacgcgaaguucgaaaaacagcugggccagaucaugcugcucauucuuuguaccagccaaauccugcugaugagaacgacaugggcucucugcgaguccauuacccuggccacagggccucuuaccacccugugggagggaucuccgggcaaguuuuggaauacaacgaucgcugugagcauggccaacaucuuccggggcuccuaccucgccggggcuggacuggccuucagccugaugaaaucccucggcgggggacgcagaggcaccggggcgcagggagaaacacuuggcgagaaguggaaacggcagcugaaucagcugucuaagagcgaauuuaacaccuauaagagauccggcauuauggagguugaccgcucugaagccaaagaggggcucaagcggggagagacaaccaaacacgcugucagcagaggcacggccaagcugcgcugguucguggaacggaaucuugugaaacccgaggggaaggucaucgaucugggauguggcagagggggaugguccuacuauugcgcuggccucaagaaaguuacagaagugaagggcuacaccaaagggggaccuggccacgaggaacccauuccuauggccaccuacggguggaaccuggugaagcugcauucuggaaaagacgucuuuuucauccccccugagaagugugauacacuccuuugcgacauuggcgagagcuccccgaaucccaccaucgaagaggggcgcacacugcgggugcugaaaaugguugaaccuuggcucagaggaaaccaauuuuguauuaagauccugaaucccuauaugccuagcguggucgagacgcuugagcagaugcagcgcaagcacggcggcaugcuggugcggaacccccucucuagaaauuccacccaugaaauguacuggguuagcugcgggacaggaaacaucgugucugcggucaauaugaccucccgcaugcugcugaaccgguucacaauggcccacagaaaaccgaccuaugagcgcgauguggaccucggcgcugggacgagacacguggccgucgaaccugagguugcuaaccuggauauuaucggacagcggauugaaaauaucaagcaugagcacaaaagcaccuggcauuacgacgaggauaaccccuauaagacaugggccuaccacggcucuuaugaagugaaacccuccgggagcgcuuccagcauggugaauggagucgugaagcuucugaccaagccuugggacguuauucccauggugacacaaaucgccaugaccgauacaaccccuuuuggccagcagcgcgucuucaaagagaagguggacacgagaacaccgaaagcgaagcggggcaccgcccaaaucauggaaguuaccgcuaaauggcucuggggguuucugucuagaaacaagaagccccggauuuguacacgcgaggaauucacgagaaaagugcggagcaaugccgcuaucggagccgucuuuguggacgagaaccaguggaauuccgccaaggaggcgguugaagaugagcgcuucugggaccuugugcauagagaacgggagcugcacaaacagggcaagugcgcuaccugcgucuacaacaugauggggaaacgcgaaaagaagcucggagaguuuggcaaagccaaggggucuagagccauuugguacauguggcugggcgcucgguuccuggaguucgaagcccucggauuuaugaaugaggaucacugguucagccgcgaaaacucccugucuggcguggagggggagggacuucauaaacugggcuauauccucagagacauuagcaagaucccugggggaaauauguacgcugaugacacagccggcugggauacccggaucacagaagacgaucugcagaacgaggcgaaaauuaccgacaucauggaacccgagcacgcccuucuggcuaaguccauuuuuaaacucacauaucaaaauaaggucgugcgcguucagagaccugccaagaacgggaccgugauggaugucaucucucggcgcgaccagagaggcagcggacaggugggcacguacgggcugaauaccuucacaaacauggaagcucaacugauucggcagauggaguccgagggaaucuuuagccccucugaacucgagaccccgaaccuggccggcagagugcuugauuggcuggaaaaacaugggguugagcgccucaagcggauggcgaucuccggagacgacuguguggucaaaccuauugaugacagauucgccacagcucugaccgcccuuaaugauaugggcaaggugcgcaaagacaucccccagugggaaccuagcaagggguggaacgauuggcagcaaguucccuuuugcucucaccacuuccaucagcugauuaugaaggacggccgggagaucguggucccuuguagaaaucaggaugagcucgugggacgcgcucgggucucccagggcgccggguggagccugagagaaacggcuugccugggaaaauccuaugcccaaauguggcagcucauguacuuucaccgccgggaccugagacuugcggccaacgcuauuuguucugccgugcccguugauugggugccgacaagccgcaccacaugguccauccaugcccaccaucaguggaugaccacggaggacaugcugagcgucuggaaucggguguggauugaagagaacccuuggauggaagauaagacccacguuucuuccuggggcgacgugcccuaucucgggaaaagagaggaccaauggugcggaagccugaucggccuuacagcucgggccaccugggcgacaaauauccaggucgcuauuaaccaggugagacgccugcucgggaaugagaacuaccuggauuacaugaccucuaugaagcgguucaaaaaugaaagcgaccccgagggcgcccugugguga

SEQ ID NO: 19043 - RNA, 9879 nt, Artificial Sequence
  derived and/or modified CDS sequence (opt5) from DENV-1__GQ199800__SS-prME
uccgugaccaugcugcucaugcugaugcccacagcccuugcuuuccaccugacgaccagaggcggggaaccucauaugaucguguccaagcaggaacggggaaaaucucuccuguuuaagacaagcgccggcguuaauaugugcacccuuauugcgauggaccugggggaguucugugaagauacaaugaccuacaaaugcccccgcaucacagaagcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuucugacacaagaugaaaagggggugacccagaacggacggcugaucacagcuaaucccauugucacggacaaagagaagccugugaacaucgaagccgagccgcccuucggcgagagcuauauugugaucggggccggagaaaaagcucuuaagcucucuugguuuaagaaaggcagcuccauugggaagauguucgaggccaccgcuagaggcgcccgccggauggcgauccugggagauacagccugggacuuuggcucuaucgggggaguuuucaccagcgucggcaaacuggugcaucagauuuuugggacagcuuacggaguccuguucuccggcgucagcuggaccaugaagaucgggauuggcgugcugcuuacguggcugggacucaauucuagauccaccagccugucuaugacauguaucgccguuggccuggugacccuuuaccucggggucauggugcaggcugauuccggaugcguuauuaacuggaaaggccgcgaacugaagugugggagcggaaucuuugugacaaaugagguccacaccuggacagaacaauauaaguuccaggccgacuccccuaaacggcugucugcggccauuggcaaggcuugggaggagggggugugcggcaucagaagcgccacccgccucgaaaacaucauguggaaacagauuuccaacgagcugaaucauauccuucuggaaaacgacaugaaguuuacgguuguggucggagauguggcuggcauucucgcccaggggaaaaagaugauccggccgcaacccauggaguacaaauauucuuggaaaagcuggggaaaggccaagauuaucggcgcugacgugcagaauacaaccuucaucauugaugggccuaacacccccgaauguccugacgaucagagagcguggaauaucugggaggucgaggacuacggauuuggcauuuucacaaccaacaucuggcugaagcugcgcgauuccuauacgcagguuugcgaccaccggcuuaugagcgccgcuauuaaagauucuaaggccgugcacgccgacaugggcuacuggaucgaauccgagaaaaaugaaacauggaagcucgcuagagccagcuucaucgaggugaagaccuguauuuggcccaaaucucauacacugugguccaacgggguccuggaaagcgagaugaucauuccgaagaucuauggaggcccuauuucucaacacaauuaccgccccggguacuuuacccagacagcgggaccuuggcaucucggcaaacuggagcuugauuucgaccugugcgaagggaccacggugguuguggaugagcacugcggaaaccggggccccagccucagaaccacaaccgucacaggcaagaucauccacgaaugguguugccgguccuguacccugccuccccugcgcuuuaaaggggaggacggaugcugguauggcauggagauuagaccggugaaggaaaaggaggaaaaucuuguuaaaagcauggugucugcuggguccggagaggucgacagcuucucccucggccugcuguguaucucuauuaugaucgaagaggugaugcggagcagauggucccgcaagaugcucaugacggggacacuggccgucuuuuuccuucugauuaugggacagcucaccuggaacgaucugauccggcugugcauuauggugggcgccaaugcuucugacagaaugggcauggggacaaccuaccuugcccugauggcgaccuuuaaaaugcgcccuauguucgcugucggacuccuguuuagacggcucacaagccgcgaggugcugcuucugacgaucggccucucccugguggccucugucgaacugcccaacagccuugaggaacugggggauggacucgccaugggcaucaugauucugaagcuccugaccgacuuccaaucccaucagcuuugggcuacacugcucagccugaccuuuaucaaaacaaccuucucucugcacuaugccuggaagacgauggcuaugguucuuuccauugugagccuguuuccccucugucugucuacaaccucccagaagaccacauggcucccugugcugcuugggagccugggaugcaaaccgcugaccauguuccucaucgccgagaauaagauuuggggcagaaaaucuuggccccugaacgaaggcaucauggcggucgggaucguguccauucuucugagcucccuccugaagaacgauguuccucucgccggaccccugaucgcuggcgggaugcuuauugccuguuacgugaucagcggaucuagcgcugaccugucccuggagaaagccgccgaggucucuugggaagaggaagcugagcauagcggcgcgucccacaauauucucguggaaguucaggaugacgggacaaugaagaucaaagaugaggagcgggacgauacgcugaccauccuucugaaggccacacuccuggcugugucuggagucuauccucucagcauucccgccacccuguucgugugguacuuuuggcaaaagaaaaagcagcgcuccggcguccuuugggacacaccuucucccccggaaguggagagagccguucuggaugacggcaucuaucggauuaugcagcgcgggcugcucggaagaagccaggugggcgucgggguguuccaagaaaacguuuuucauaccauguggcacgugacgcggggagcuguccugauguaccagggcaaacgccuugagccuuccugggccagcgugaagaaagaccugaucucuuacgggggaggcuggagacuccagggcuccuggaauaccggggaggaagugcagguuauugcggucgagcccggaaagaacccuaagaaugugcaaacagcucccggcaccuucaaaacaagcgaaggggaggugggagccaucgcccuggauuuuaagccgggcaccucuggguccccuauugucaaccgggaaggaaaaaucgugggccucuauggcaaugggguugugacaacgagcggaaccuacgucuccgcuaucgcccaggcgaaggcuucucaggagggcccccugccugagauugaagacgagguguucagaaaacgcaaccuuacaaucauggaucugcaccccgggagcggaaagacccggagauaucugcccgccauuguucgcgaagccaucaagcggaaacucagaacccugauucuugcuccuacacgcguggucgccuccgagauggcugaagcccugaagggcaugccgauccgguaccaaacgaccgcggugaaaagcgagcauacagggaaggagaucguugaccucaugugccacgccaccuuuacaaugagacugcugucucccgugcgcgucccuaauuauaacaugauuaucauggaugaagcucauuucaccgaccccuccagcauugccgcucggggcuacaucucuacgagagugggaaugggcgaggccgccgcuauuuuuaugacagcgaccccucccgggagcguggaagccuucccucaguccaaugcugucauccaggaugaggaacgggacaucccggagcgcucuuggaacagcggauaugaguggauuaccgauuuucccggcaaaacaguuugguucgugccuuccaucaagucugggaaugacauugccaacugucucagaaagaauggaaaacgggugauccagcuuagccgcaagaccuucgauacagaauaccagaaaaccaagaacaacgacugggacuacgucgugacgacagauauuuccgagaugggcgccaauuuuagagcugaccggguuaucgaucccagacgcugccugaaaccugugauucugaaggacgggcccgaacgggucauccucgccggcccgaugccugugaccguugcgagcgcugcccagagacgcggacggaucggcagaaaccacaauaaggagggggaucaguauauuuacaugggacagccccugaacaaugacgaggaucaugcccacuggacagaagcuaaaaugcuucuggacaacaucaauacccccgagggcauuaucccugcccucuucgaacccgagcgcgaaaagucugcggccauugauggggaguaucggcugagaggagaggcucgcaaaacguuuguggaacugaugagacggggcgaccucccugucuggcuuuccuacaagguggccagcgagggguuccaauauuccgaucgcagauggugcuuugacggcgaacggaacaaucagguccuggaggaaaacauggauguggagaucuggaccaaagagggagaacgcaagaaacugagaccgcgguggcucgacgcuagaacauacucugacccccuggcccuucgcgaguucaaggaauuugcugccggccggagaagcguuuccggggaucugauccucgagauuggaaagcugccucagcaccugacccagcgcgcgcaaaaugcccucgacaaccuugugaugcugcauaauucugaacagggcgggcgggcuuauagacacgccauggaggagcugcccgauacaaucgaaacccucaugcugcuugcucugauugccgugcucacaggaggcgucacccuguucuuucugagcggccgggggcucggaaaaacguccaucggccuucuguguguuauggccagcucugugcugcucuggauggcuuccguggagccucauuggauugcggccagcaucauccuggaguucuuucuuaugguccugcucauucccgagccggaccgccagagaacaccucaggauaaccaacuggcuuacgugguuaucgggcuccucuucaugauucuuaccguggccgccaaugagaugggacugcuggaaaccacaaagaaagaccucggcaucgggcacgucgcuguggagaaccaccaucacgccgcgaugcuggaugucgaccuucaucccgccucugcuuggacccuguacgccguggcuacaacgauuaucaccccuaugaugcggcacacaauugaaaacaccacagccaauaucucccucaccgcgaucgccaaccaggcugccauucugaugggacuggauaagggcuggcccaucagcaaaauggacauuggcguuccucuccuugcucuggggugcuauucucaggugaauccccugacgcucaccgccgcuguccugaugcuuguggcccauuacgcgaucauuggaccgggccugcaagccaaggcuacacgcgaggcccagaagagaaccgcugccgggaucaugaaaaacccuacaguugauggaaucguggccauugaccucgaucccgucguguaugacgcgaaguuugaaaaacagcugggccagaucaugcugcucauucuuuguaccagccaaauccugcugaugcggacgacaugggcucucugcgaguccauuacccuggccacagggccccuuaccacccugugggagggaucuccuggcaaguucuggaauacaacgaucgcugugagcauggccaacaucuuccgcggcuccuaccucgccggggcuggacuggccuuuagccugaugaaaucccucggcgggggaagacggggcaccggggcgcagggagaaacacuuggcgagaaguggaagcgccagcugaaucagcugucuaaaagcgaguucaacaccuauaagagauccggcauuauggagguugaccggucugaagccaaagaggggcucaagagaggagagacaaccaaacacgcugucagccgcggcacggccaagcugcggugguuuguggaaagaaaucuugugaagccggaggggaaagucaucgaucugggauguggccgcgggggaugguccuacuauugcgcuggccucaagaaaguuacagaagugaagggcuacaccaaagggggacccggccacgaggaaccuauucccauggccaccuacggguggaaccuggugaagcugcauucuggaaaagacgucuucuuuaucccucccgagaagugugauacacuccuuugcgacauuggcgagagcuccccuaauccgaccaucgaagaggggcggacacugagagugcugaagaugguugaacccuggcuccgcggaaaccaauucuguauuaaaauccugaauccuuauaugcccagcguggucgagacgcuugagcagaugcagcggaagcacggcggcaugcuggugagaaacccucucucucgcaauuccacccaugaaauguacuggguuagcugcgggacaggaaacaucgugucugcggucaauaugaccucccggaugcugcugaacagauuuacaauggcccaccgcaaacccaccuaugagcgggauguggaccucggcgcugggacgagacacguggccgucgaaccggagguugcuaaccuggauauuaucggacagcgcauugaaaauaucaagcaugagcacaaaagcaccuggcauuacgacgaggauaacccuuauaagacaugggccuaccacggcucuuaugaagugaagcccuccgggagcgcuuccagcauggugaauggagucgugaaacuucugaccaagcccugggacguuauuccuauggugacacaaaucgccaugaccgauacaacccccuucggccagcagagagucuuuaaagagaagguggacacgcggacaccuaaagcgaagcgcggcaccgcccaaaucauggaaguuaccgcuaaguggcucuggggguuccugucuagaaacaaaaagccgcggauuuguacaagagaggaauuuacgcggaaagugcgcagcaaugccgcuaucggagccgucuucguggacgagaaccaguggaacuccgccaaggaggcgguugaagaugagagauuuugggaccuugugcaucgggaacgcgagcugcacaaacagggcaagugcgcuaccugcgucuacaacaugauggggaagagagagaaaaagcucggagaguucggcaaagccaaggggucucgggccauuugguacauguggcugggcgcucgcuuccuggaguuugaagcccucggauucaugaaugaggaucacugguuuagcagagaaaacucccugucuggcguggagggggagggacuucauaaacugggcuauauccuccgggacauuagcaagauccccgggggaaauauguacgcugaugacacagccggcugggauacccgcaucacagaagacgaucugcagaacgaggcgaaaauuaccgacaucauggaaccugagcacgcccuucuggcuaaguccauuuucaagcucacauaucaaaauaaagucgugagaguucagcggcccgccaagaacgggaccgugauggaugucaucucucgcagagaccagcggggcagcggacaggugggcacguacgggcugaauaccuuuacaaacauggaagcucaacugauucgccagauggaguccgagggaaucuucagcccuucugaacucgagacccccaaccuggccggcagagugcuugauuggcuggaaaaacaugggguugagcggcucaagagaauggcgaucuccggagacgacuguguggucaaaccgauugaugaccgcuuugccacagcucugaccgcccuuaaugauaugggcaaggugcggaaggacaucccucagugggaacccagcaaaggguggaacgauuggcagcaaguuccuuucugcucucaccacuuucaucagcugauuaugaaggacggcagagagaucgugguccccugucgcaaucaggaugagcucgugggacgggcuagagucucccagggcgccggguggagccugcgcgaaacggcuugccugggaaaauccuaugcccaaauguggcagcucauguacuuccaccggagagaccugcgccuugcggccaacgcuauuuguucugccgugccuguugauugggugcccacaagccggaccacaugguccauccaugcccaccaucaguggaugaccacggaggacaugcugagcgucuggaauagaguguggauugaagagaacccguggauggaagauaagacccacaucucuuccuggggcgacguuccuuaucucgggaaacgcgaggaccaauggugcggaagccugaucggccuuacagcucgggccaccugggcgacaaauauucagguggcuaucaaccaggucagacggcugauugggaaugagaacuaccucgauuacaugaccucuaugaagagauuuaagaaugaaagcgaccccgagggcgcccugugguga

SEQ ID NO: 19044 - RNA, 9879 nt, Artificial Sequence
  derived and/or modified CDS sequence (opt5) from DENV-1__FJ882548__SS-prME
agcgugaccaugcugcucaugcugaugcccaccgcccuugcuuuccaccugacgaccagaggaggggaaccucauaugaucguguccaagcaggaacggggaaagucucuccuguuuaagaccagcgccggcguuaauaugugcacccuuauugcgauggaccugggggagcucugugaagauacgaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacugauucaucagaucuucgggaccgcuuacggagugcucuuuuccggcgugagcuggacgaugaagauugggaucggcguccugcuuaccuggcugggacucaauucuagauccacaagccugucuaugaccuguauugccgugggccugguuacacuuuaccucggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcugucugcggccaucggcaaggcuugggaggagggggucugcggcaucagaagcgccacgcgccucgaaaacauuauguggaaacagaucuccaacgagcugaaucauauucuucuggaaaacgacaugaagcucacagugguugugggagaugucgcuggcauccuggggcagggcaagaagaugauucggccgcaacccauggaguacaaauauucuuggaaaagcuggggcaaggccaagaucaucggggccgacgcucagaauaccaccuucauuaucgauggaccuaacacacccgaauguccugacgaucagagagcguggaauauuugggagguggaggacuacggcuuuggcaucuucaccacgaacauuuggcugaaacuucgcgauuccuauacacaggugugcgaccaccggcucaugagcgccgcuaucaaagauucuaaggccguccacgccgacaugggguacuggaucgaauccgagaaaaaugaaaccuggaagcuggcuagagccagcuuuauugagguuaagacauguaucuggcccaaaucucauacccugugguccaacggagugcucgaaagcgagaugauuaucccgaagauuuauggcgggccuaucucucaacacaauuaccgccccggauacuucacacagaccgcgggcccuuggcaucuggggaaacuugagcuggauuucgaccucugcgaaggaacgaccguggucguggaugagcacugcggcaaccggggccccagccugagaacaaccacaguuaccgggaagaucauucacgaaugguguugccgguccuguacgcugccuccccuucgcuuuagaggagaggacggcugcugguaugggauggagauccggccggugaaagaaaaggaggaaaaucucgucaagagcauggugucugcuggauccggcgagguugacagcuucucccuggggcugcucuguauuucuaucaugauugaagaggugaugagaagccgcuggucccggaaaaugcugaugacaggaacccuugccgucuuuuuccugcucaucaugggccagcugacauggaacgaucugauuagacuuugcaucauggugggcgccaaugcuuuugaccgcauggggaugggaaccaccuaccuggcccucauggcgacauucaagaugagaccuauguuugcuguuggccugcuguuccggcgccugacgucuagagaggugcuucugcucaccaucgggcugagccuggucgccuccguggaacuucccaacucucuggaggaacucggagauggccuggccauggggauuaugauccucaaacugcuuacagacuuucaaagccaucagcugugggcuacccuccugucccugacauucauuaagaccacguuuagccuucacuaugccuggaaaacaauggcuauggugcugucuaucgucucccuccugccccucugucugagcaccaccucucagaagacaaccuggcuuccuguucugcugggaucccucggcugcaagccgcugacaauguuccuuauugccgagaauaaaaucuggggccggaaguccuggccccugaacgaagggaucauggcggugggaauugugucuauccuccuguccagccuccugaaaaacgaugucccucuugccggcccccugauugcugggggaaugcugaucgccuguuacgugauuuccggcagcucugcugaccucagccuggagaaggccgccgagguuuccugggaagaggaagcugagcauucuggggcgagccacaauauccuuguggaaguccaggaugacggaacgaugaaaaucaaggaugaggagcgcgacgauacccugacaauucuccugaaagccacccuccuggcuguguccggcguuuauccucuuucuauccccgccacacuguuugugugguacuucuggcaaaagaagaaacagagaagcggcguccugugggacaccccuagcccucccgaaguggagcgggccguccucgaugacgggauuuaucgcaucaugcagagaggacugcuuggccggucucagguggggguuggaguguuccaagaaaacgucuuucauacgauguggcacgugacccgcggcgcuguucugauguaccaggggaagagacucgagcccagcugggccuccgugaaaaaggaccugauuagcuacggaggcggcuggcggcucagagggucuuggaauacaggagaggaaguccaggugaucgcgguggagcccggcaaaaacccuaagaauguucagaccgcucccgggacauucaagaccccggaaggagaggucggcgccauugcccuggauuuuaaaccugggacauccggaagccccaucgugaaccgcgaaggcaagaucgugggccuuuaugggaauggagucgugacgaccucuggcacauacguuuccgcuauugcccaagcgaaagcuagccaggaggggccucugcccgagaucgaagacgagguguuccggaagagaaaccugaccauuauggaucuccaccccggauccggcaaaacccgccgguaucugccugccaucgucagagaagccauuaagcgcaaacuucggacacugauccucgcuccgacgagagugguugccucugagauggcugaagcccugaaagggaugcccauccgcuaccagaccacagcggucaagagcgagcauaccggcaaagagauugucgaccugaugugccacgccacauuuaccaugcggcuccuuuccccugugagaguucccaauuauaacaugaucauuauggaugaagcucauuucacggacccuagcucuaucgccgcucggggauacauuuccacacgcgugggcaugggggaggccgccgcuaucuuuaugaccgcgacacccccuggaagcgucgaagccuucccgcaaucuaaugcugugauccaggaugaggaaagagacauucccgagcggagcuggaacuccggccacgaguggaucacagauuuuccugggaagaccgugugguucguccccucuauuaaaagcggaaaugacaucgccaacugucugcgcaagaauggcaagagaguuauucagcugucccggaaaacauuugauaccgaauaucagaagacgaaaaacaacgacugggacuacguggugacaaccgauaucucugagaugggggccaauuucagagcugaccgcgucauugauccucggagaugccucaagcccgugauccugaaagacggcccggaacgcguuauccuugccggaccuaugcccgugacagucgcgagcgcugcccaacggagaggccgcauugggcggaaccauaauaaggagggagaucaguacaucuauaugggccagccccugaacaaugacgaggaucacgcccacuggaccgaagcuaagaugcuccuggacaacauuaauacgccugaggggaucauucccgcccuguucgaaccugagagagaaaaauccgcggccguggauggagaguaccgccucagaggcgaggcucggaagaccuuuguugaacuuaugcgcagaggggaccugccgguguggcugagcuauaaagucgccucugagggcuuccaguacuccgaucggcgcuggugcuuugacggagaaagaaacaaucaagugcucgaggaaaacauggaugucgagaucuggacaaaggagggcgaacggaaaaagcugagaccccgcuggcuugacgcucggaccuauagcgacccucuggcccucagagaguucaaagaauuugcugccgggcgccgguccgugucuggagaucugauccuggagauuggcaagcucccccagcaucuuacacagagagcgcagaaugcccuggacaaccugguuaugcuccacaauagcgaacaagggggacgggcuuaccgccaugccauggaggagcugccugauaccaucgaaacacuuaugcugcucgcucugauugccgugcugaccggcggcgugacacucuucuuucuuuccgggagaggacugggcaagacaucuaucgggcugcucugugucauggccagcuccguucugcuuuggauggcuagcguggagccccacuggauugcggccucuaucauccuggaguucuuucucauggugcugcugauuccggagccugaccggcagcgcacaccccaggauaaccagcucgcuuaugucgugaucggacuucuguucaugauucugaccguugccgccaaugagaugggccuccuggaaacaaccaaaaaggaccuugggaucggacacguggcugucgagaaccaucaccaugccgcgaugcuggauguggaccuccacccugccuccgcuuggacacuguacgccgucgcuacgaccauuaucacacccaugaugagacauaccauugaaaacacaaccgccaauaucagccugacggcgaucgccaaccaagcugccauucucaugggccuugauaaaggcuggccuaucucuaagauggacauuggggugccccugcuggcucucggaugcuacucccagguuaauccgcugacccuuacagccgcugugcugaugcucgucgcccacuaugcgaucauuggcccugggcugcaggccaaagcuacccgggaggcccaaaagcgcacagcugccggaaucaugaagaaccccaccguggauggcaucguugccauugaccuggaucccguggucuacgacgcgaaauuugaaaagcagcucgggcagaucaugcuucugauucuguguacgagccagauccuccugaugagaacaaccugggcucuuugcgagucuauuacacuggccaccggaccucucaccacacugugggagggcagcccgggcaaauucuggaauacgaccaucgcuguguccauggccaacaucuuucgggggucuuaucuggccggagcuggccucgccuucagccuuaugaagucccucgggggaggccgcagagggacaggagcgcaaggcgaaacccugggcgagaaauggaagcggcagcucaaucagcugagcaaguccgaguucaacacauacaaaagaucugggauuauggagguggaccgcagcgaagccaaggagggacuuaaacggggcgagaccacgaagcacgcuguuuccagagggacagccaaacugcgcugguuugucgaacggaaucucgugaagcccgagggaaaggugaucgaucugggcugugggagaggaggcuggucuuauuacugcgcuggccugaaaaaggucaccgaaguuaaaggguauaccaagggaggcccugggcaugaggaacccauuccuauggccacauacggauggaaccucgugaaacuucacagcggcaaggacguguucuuuauucccccugagaaaugugauacccugcugugcgacaucggggaguccucuccgaaucccacaaucgaagagggacgcacgcuccggguccugaagaugguggaaccuuggcuuagaggcaaccaguucuguauuaagauccugaaucccuacaugccuagcguuguggagacccucgagcaaaugcagcgcaaacauggcgggaugcugguccggaacccccuguccagaaauagcacacacgaaauguauugggugucuugcggaaccggcaacaucguuuccgcggugaauaugacaagccgcaugcuccugaaccgguuuaccauggcccacagaaagccgacguacgagcgcgaugucgaccuugggaccggaacaagacauguggcuguggaaccugaggucgccaaccuggauauuaucggccagcggauugaaaauaucaaacacgagcauaagucuaccuggcacuaugacgaggauaaccccuacaaaacaugggcuuaucauggguccuacgaaguuaagcccagcggaucugccuccagcauggugaauggcguggucaagcuccugaccaaaccuugggacgugauucccaugguuacacagaucgcuaugaccgauacgacaccuuucggccaacagcgcguguuuaaggagaaagucgacaccagaaccccgaaggccaaacgggggacagcgcagaucauggaagugacggccagauggcuuuggggauuccugucccggaacaagaagccccgcauuuguaccagagaggaauuuacacggaaaguucgcagcaaugcugccaucggcgcuguguucgucgacgagaaccaauggaacucugccaaggaggccguggaagaugagagauuuugggaccucguucaccgggaacgcgagcugcacaaacaggggaagugcgcgaccugcguguauaacaugaugggaaaaagagaaaagaagcugggcgaguucgggaaagcuaagggcagccgggccauuugguacauguggcucggagcccgcuuucuggaguucgaagcucuuggcuucaugaaugaggaucauugguuuuccagagaaaacucucugagcggggucgagggagagggccuccacaaacugggguacauccuucgggacauuuccaagaucccuggaggcaauauguaugccgaugacacagcugggugggauacccgcaucacagaagacgaucugcagaacgaggccaaaauuaccgacaucauggaacccgagcaugcgcuccuggccaaggcuauuuucaaacugacguaccagaauaagguggucagagugcaacggccugccaagaacggcaccguuauggaugugaucucucgcagagaccagcggggaagcggccaggucgggacauauggacucaauaccuuuacaaacauggaagcucagcugauuagacaaauggaguccgagggcaucuucucucccagcgaacuugagaccccgaaccuggccgaacgcgcgcucgauuggcuggagaaauacgggguggaacggcuuaagagaauggccaucuccggagacgacugugugguuaaaccuauugaugaccgcuuugcuacggcccugacagcucucaaugauaugggcaaggugcggaaagacaucccccagugggagccuagcaagggguggaacgauuggcagcagguccccuucugcucucaccacuuucaucaacugauuaugaaggacggcagagagaucgugguuccuugucgcaaucaggaugaacuggugggacgggccagagucucccagggcgcuggguggagccuccgcgagaccgccugccugggaaaaucuuaugcgcagauguggcaacuuauguacuuccaccggagagaccugcgccucgccgcuaacgccauuuguuccgccgugcccgucgauugggugccgacaagccggaccacgugguccauccaugcucaccaucaguggaugaccacagaagacaugcugucuguuuggaauagaguguggauugaggaaaacccuuggauggaggauaagacccacaucagcuccugggaggacguccccuaucuuggcaaacgggaagaccaguggugcgggagccugaucggacucacagccagagcgaccugggcuacaaauauucaaguggccaucaaccagguucgccggcugauuggcaaugagaacuaccuggauuacaugaccucuaugaagagauuuaaaaaugaauccgaccccgagggggcccucugguga

SEQ ID NO: 19045 - RNA, 9879 nt, Artificial Sequence
  derived and/or modified CDS sequence (opt5) from DENV-1__GQ199801__SS-prME
agcgugaccaugcugcucaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaacucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacacggcuugagggaaaaaucguucaguacgaaaaccugaaguauuccgugaucgucacggugcacaccggcgaccagcaucaaguugggaaugagagcacagaacacggaaccacagcuaccauuacgccccaggccccuucuaccgagauccagcucacagacuacggcgcccugacccuggauuguagcccccgcacaggccucgacuucaacgaaauggugcugcuuaccaugaaagaaaaguccuggcugguccauaaacagugguuucucgaucugccucuucccuggacguccggggcuucuacaagccaagagaccuggaauagacaggaccugcucgugacauucaagaccgcgcacgccaaaaagcaggaagucgugguucugggaucccaagagggcgcuaugcacaccgcccugacaggggccacggaaauucagaccagcggaacaaccacaaucuuugcuggccaucucaagugccggcugaaaauggauaaacuuacccugaaagggaugucuuaugugauguguacgggcuccuucaagcucgagaaagaagucgccgagacacagcacggaaccgugcugguucagauuaaguacgagggcaccgacgcgccgugcaagaucccuuucagcacacaagaugaaaaaggggugacccagaacggaagacugaucacagcuaaucccauugucacggacaaggagaaaccugugaacaucgaagccgagccgcccuuuggcgagucuuauauugugaucggggccggagaaaaggcucuuaaacucagcugguucaagaagggcuccucuauugggaaaauguuugaggccaccgcucgcggcgcccggagaauggcgauccugggagauacagccugggacuucggcagcaucgggggaguuuuuaccuccgucggcaagcuggugcaucagauuuucgggacagcuuacggagugcucuuuagcggcgucucuuggaccaugaaaaucgggauuggcgugcugcuuacguggcugggacucaauucccgcagcaccucucuguccaugacauguaucgccguuggccuggugacccuuuaccucggggucauggugcaggcugauagcggaugcguuauuaacuggaagggccgggaacugaaauguggguccggaaucuucgugacaaaugagguccacaccuggacagaacaauauaaguuucaggccgacucuccuaagagacugagcgcggccauuggcaaggcuugggaggagggggugugcggcauccgcuccgccacccggcucgaaaacaucauguggaagcagauuucuaacgagcugaaucauauccuucuggaaaacgacaugaaauucacgguuguggucggagauguggcuggcauucucgcccaggggaagaaaaugaucagaccgcaacccauggaguacaaguauagcuggaaauccuggggaaaggccaagauuaucggcgcugacgugcagaauacaaccuuuaucauugaugggccuaacacccccgaauguccugacgaucagcgcgcguggaauaucugggaggucgaggacuacggauucggcauuuuuacaaccaacaucuggcugaaacugcgggauagcuauacgcagguuugcgaccacagacuuaugucugccgcuauuaaggauuccaaagccgugcacgccgacaugggcuacuggaucgaaagcgagaagaaugaaacauggaaacucgcucgcgccucuuucaucgaggugaagaccuguauuuggcccaagucccauacacuguggagcaacgggguccuggaaucugagaugaucauuccgaaaaucuauggaggcccuauuagccaacacaauuaccggcccggguacuucacccagacagcgggaccuuggcaucucggcaagcuggagcuugauuuuaaccugugcgaagggaccacggugguuguggacgagcacugcggaaauagaggccccucccuccggaccacaaccgucacaggcaaaaucauccacgaaugguguugccgcagcuguacccugccuccccugagauucaagggggaggauggaugcugguauggcauggagauucggccggugaaagaaaaggaggaaaaccuuguuaagucuaugguguccgcugggagcggagaggucgacuccuuuucucucggccugcuguguaucagcauuaugaucgaagaggugaugagaucccgcuggucuaaaaagaugcucaugacggggacacuggccguuuucuuucuucugauuaugggacagcucaccuggaaugaccugauccggcugugcauuauggugggcgccaacgcuagcgauagaaugggcauggggacaaccuaccuugcccugauggcgaccuucaaaaugcgcccuaugcucgcugucggacugcucuuuagacggcugacaucccgcgaggugcuucugcucacgaucggccugucucugguggccagcgucgaacuucccaauucccuggaggaacucggggacggacuggccaugggcaucaugauucucaagcugcuuaccgauuuccaaagccaucagcugugggcuacacuccugucucugaccuuuaucaaaacaaccuauucccuucacuacgccuggaagacgauggcuaugguucugagcauugugucucucuucccccugugucucuccacaaccagccagaagaccacauggcugccugugcuucuggggucucugggaugcaaaccgcucaccauguuucugaucgccgagaacaagauuuggggcagaaaauccuggccccuuaacgaaggcaucauggcggucgggaucgugagcauucugcucuccagccugcucaagaaugacguuccucuggccggaccccuuaucgcuggcgggaugcugauugccuguuaugugaucucuggaagcuccgcugaucugucucucgagaaagccgccgaggucagcugggaagaggaagcugagcauuccggcgcgucucacaacauucugguggaaguucaggacgaugggacaaugaagaucaaagacgaggagcgggaugacacgcuuaccauccugcucaaggccacacugcucgcugugagcggagucuacccucuguccauucccgccacccuuuucgugugguauuuuuggcaaaagaaaaagcagcgcucuggcguccugugggauacaccuagcccucccgaaguggagagagccguucuggacgauggcaucuaccggauuaugcagcgcgggcuccugggaagaucccaggugggcgucgggguguuccaagaaaauguuuuccauaccauguggcacgugacgcggggagcuguccuuauguaccagggcaaacgccuggagcccagcugggccucugugaagaaagaccucaucuccuaugggggaggcuggagacugcagggcagcuggaacaccggggaggaagugcagguuauugcggucgagcccggaaagaauccuaagaacgugcaaacagcucccggcaccuuuaaaacaucugaaggggaggugggagccaucgcccucgacuucaagccgggcaccuccgggagcccuauugucaaucgggaaggaaaaaucgugggccuguacggcaacgggguugugacaacguccggaaccuaugucucugcuaucgcccaggcgaaggcuagccaggagggcccccuuccugagauugaaaaugagguguuuagaaaacgcaaccugacaaucauggaucugcaccccggguccggaaagacccggagauaccuccccgccauuguucgcgaagccaucaagcggaaacugagaacccuuauucuggcuccuacacgcguggucgccagcgagauggcugaagcccucaagggcaucccgauccgguaucaaacgaccgcggugaaaucugagcauacagggaaggagauuguugaccugaugugccacgccaccuucacaaugagacugcucucccccgugcgcgucccuaauuacaacaugaucauuauggaugaagcucauuuuaccgaccccagcucuaucgccgcucggggcuauauuagcacgagagugggaaugggcgaggccgccgcuaucuucaugacagcgaccccucccggguccguggaagccuuuccucagucuaaugcugucauccaggaugaggaacgggacauuccggagcgcagcuggaacuccggauacgaguggaucaccgauuuccccggcaaaacaguuugguuugugccuucuauuaagagcgggaaugacaucgccaacugucuuagaaagaacggaaaacgggugauucagcugucccgcaagaccuucgauacagaauaccagaagaccaagaauaacgacugggauuaugucgugacgacagacaucagcgagaugggcgccaauuuuagagcugaccggguuauugaucccagacgcugccugaaaccugugauccucaaggacgggcccgaacgggucauccuggccggcccgaugccugugaccguugcgucugcugcccagagacgcggacggauuggcagaaaccacaauaaggagggggaucaguacaucuauaugggacagccccuuaacaaugacgaggaucaugcccacuggacagaagcuaaaaugcugcucgacaacauuaauacccccgagggcaucauuccugcccuguucgaacccgagcgcgaaaaguccgcggccaucgauggggaguaccggcugagaggagaggcucgcaaaacguucguggaacucaugagacggggcgaccuuccugucuggcugagcuauaagguggccuccgagggguuucaauacucugaucgcagauggugcuucgacggcgaacggaacaaucagguccuggaggaaaacauggauguggagaucuggaccaaagagggagaacgcaagaaacucagaccgcgguggcuggacgcuagaacauauagcgauccccuugcccugcgcgaguuuaaggaguucgcugccggccggagauccguuucuggggaccucauucuggagaucggaaagcugccucagcaccucacccagcgcgcgcaaaaugcccuugacaaccuggugaugcugcauaauagcgaacagggcgggcgggcuuacagacacgccauggaggagcuccccgauacaauugaaacccugaugcuucuggcucucaucgccgugcugacaggaggcgucacccuguuuuuccucuccggccgggggcuuggaaaaacgagcauuggccugcuguguguuauggccucuuccgugcuccuguggauggcuagcguggagccucauuggaucgcggccucuaucauucuugaauuuuuccugaugguccuccugauccccgagccggaccgccagagaacaccucaggauaaccaacuggcuuacgugguuauugggcuccuuuuuaugauccugaccguggccgccaacgagaugggacugcucgaaaccacaaagaaagaccugggcauugggcacgucgcuguggagaaucaccaucacgccgcgaugcuugaugucgaccugcaucccgccuccgcuuggacccucuaugccguggcuacaacgaucauuaccccuaugaugcggcacacaaucgaaaacaccacagccaauaucagccugaccgcgauugccaaccaggcugccauccugaugggacucgauaagggcuggcccauuucuaaaauggacaucggcguuccucuucuggcucuggggugcuacagccaggugaauccccucacgcugaccgccgcuguccuuaugcugguggcccauuaugcgauuaucggaccgggccuccaagccaaggcuacacgcgaggcccagaagagaaccgcugccgggaucaugaaaaacccuacaguugauggaauuguggccaucgaccuggaucccgucguguacgacgcgaaguucgaaaaacagcugggccagauuaugcuccuuauccuguguaccucccaaauucugcucaugcggacgacaugggcucugugcgagucuaucacccuugccacagggccccugaccacccucugggagggaagcccuggcaaguuuuggaauacaacgaucgcuguguccauggccaacauuuuccgcggcagcuaucuggccggggcuggacuggccuuuucccucaugaaaucucuuggcgggggaagacggggcaccggggcgcagggagaaacacugggcgagaaguggaagcgccagcugaaucagcucagcaaauccgaguucaacaccuacaagagaucuggcaucauggagguugaucggagcgaagccaaagaggggcugaagagaggagagacaaccaaacacgcugucucccgcggcacggccaaacuucggugguucguggaaagaaaucuggugaagccggaggggaaagucauugaccucggauguggccgcgggggauggucuuauuacugcgcuggccugaagaaaguuacagaagugaagggcuacaccaaagggggacccggccacgaggaaccuauccccauggccaccuauggguggaaccuggugaagcuccauagcggaaaagacgucuuuuucauuccucccgagaagugugauacacuucugugcgacaucggcgaguccagcccuaauccgaccauugaagaggggcggacacugagagugcucaagaugguugaacccuggcugcgcggaaaccaauuuuguaucaaaauccuuaauccuuacaugcccucuguggucgagacgcuggagcagaugcagcggaagcacggcggcaugcucgugagaaacccucugucccgcaauagcacccaugaaauguauuggguuucuugcgggacaggaaacauuguguccgcggucaacaugaccagccggaugcugcucaauagauucacaauggcccaccgcaaacccaccuacgagcgggauguggaccugggcgcugggacgagacacguggccgucgaaccggagguugcuaaccuugauaucauuggacagcgcaucgaaaauauuaagcaugagcacaaaucuaccuggcauuaugacgaggauaacccuuacaagacaugggccuaucacggcuccuacgaagugaagcccagcggguccgcuagcucuauggugaauggagucgugaaacugcucaccaagcccugggacguuaucccuauggugacacaaaucgccaugaccgauacaacccccuuuggccagcagagagucuucaaagagaagguggacacgcggacaccuaaagcgaagcgcggcaccgcccaaauuauggaaguuaccgcuaaguggcuguggggguuucuuagcagaaacaaaaagccgcggaucuguacaagagaggaguucacgcggaaagugcgcuccaaugccgcuauuggagccgucuuuguggaugagaaccaguggaacucugccaaggaggcgguugaagacgagagauucugggaccuggugcaucgggaacgcgagcuccacaaacagggcaagugcgcuaccugcgucuacaacaugauggggaagagagagaaaaagcugggagaguuuggcaaagccaaggggagccgggccaucugguauauguggcugggcgcucgcuuccucgaguuugaagcccugggauucaugaaugaggaucacugguucuccagagaaaacucucuuagcggcguggagggggagggacugcauaaacucggcuacauucugcgggacaucuccaagauccccgggggaaauauguaugcugaugacacagccggcugggauacccgcauuacagaagacgaucuucagaacgaggcgaaaaucaccgacauuauggaaccugagcacgcccugcucgcuaagucuaucuuuaagcugacauaccaaaauaaagucgugagaguucagcggcccgccaagaacgggaccgugauggaugucauuagccgcagagaccagcggggcuccggacaggugggcacguaugggcugaacaccuucacaaauauggaagcucaacucauccgccagauggagagcgagggaaucuuuucuccuuccgaacuggagacccccaaccuugccggcagagugcuggauuggcucgaaaaacaugggguugagcggcugaagagaauggcgauuagcggagacgauuguguggucaaaccgaucgacgaccgcuucgccacagcucuuaccgcccugaaugauaugggcaaggugcggaaggacauuccucagugggaacccucuaaaggguggaacgauuggcagcaaguuccuuuuugcucccaccacuuccaucagcucaucaugaaggacggcagagagauugugguccccugucgcaaucaggaugagcuggugggacgggcuagagucagccagggcgccggguggucccugcgcgaaacggcuugccucggaaaaucuuacgcccaaauguggcagcugauguauuuucaccggagagaccuucgccuggcggccaacgcuaucuguagcgccgugccuguugauugggugcccacaucccggaccacauggagcauucaugcccaccaucaguggaugaccacggaggacaugcucucugucuggaauagaguguggaucgaagagaacccguggauggaagauaagacccacaucuccagcuggggcgacguuccuuaccuggggaaacgcgaggaucaauggugcggaucucuuauuggccugacagcucgggccaccugggcgacaaauauccagguggcuauuaaccaggucagacggcucaucgggaaugagaacuaccuggacuauaugaccagcaugaagagauucaagaaugaauccgaccccgagggcgcccugugguga

SEQ ID NO: 19046 - RNA, 9879 nt, Artificial Sequence
  derived and/or modified CDS sequence (opt5) from DENV-1__GQ199802__SS-prME
agcgugaccaugcugcucaugcugaugcccaccgcccuugcuuuccaccugacgaccagaggcggggaaccucauaugaucgucuccaagcaggaacgggggaaaucucuccuguuuaagaccagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccaggccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucaaaggggaggacggaugcugguauggcauggagauuagaccggugaaggaaaaggaggaaaaucuuguuaaaagcauggugucugcuggguccggagaggucgacagcuuuucccucggccugcuguguaucucuauuaugaucgaagaggugaugcggagcagauggucccgccggaugcucaugacagggacccuggccguuuucuuucuucugauuaugggacagcucacauggaacgaucugaucagacugugcauuauggugggcgccaaugcuucugaccgcaugggcauggggaccaccuaccuugcccugauggcgacauucaagaugagaccuauguuugcugucggacuccuguuccggcgccucacgagcagagaggugcugcuucugaccaucggccucucccugguggccucugucgaacugcccaacagccuugaggaacugggggauggacucgccaugggcaucaugauucugaaacuccugacagacuuucaaucccaucagcuuugggcuacccugcucagccugacauucaucaagaccacguuuucucugcacuaugccuggaaaacaauggcuaugguucuuuccauugugagccuguucccccucugucugucuaccaccucccagaagacaaccuggcucccugugcugcuugggagccugggaugcaagccgcugacaauguuucucaucgccgagaauaaaauuuggggccggcgcucuuggccccugaacgaaggcaucauggcggucgggaucguguccauucuucugagcucccuccugaagaacgauguuccucucgccggaccccugaucgcuggcgggaugcuuauugccuguuacgugaucagcggaucuagcgcugaccugucccuggagaaagccgccgaggucucuugggaagaggaagcugagcauagcggcgcgucccacaauauucucguggaaguucaggaugacgggacgaugaagaucaaagaugaggagagagacgauacccugacaauccuucugaaggccacccuccuggcugugucuggagucuauccucucagcauucccgccacacuguucgugugguacuucuggcagaagaagaagcagcgguccggcguccuuugggacaccccuucucccccggaaguggagcgcgccguucuggaugacggcaucuauagaauuaugcagcgggggcugcucggacgcagccaggugggcgucgggguguuucaagaaaacguuuuccauacgauguggcacgugaccagaggagcuguccugauguaccagggcaaacggcuugagccuuccugggccagcgugaagaaagaccugaucucuuacgggggaggcuggagacuccagggcuccuggaauacaggggaggaagugcagguuauugcggucgagcccggaaagaacccuaaaaaugugcaaaccgcucccggcacauuuaagaccccggaaggggaggugggagccaucgcccuggauuucaagccuggcacaagcgggucucccauugucaaccgcgaaggaaaaaucgugggccucuauggcaaugggguugugacgaccuccggaacauacgucagcgcuaucgcccaggcgaaggcuucccaggagggcccucugcccgagauugaagacgagguguuucggaaaagaaaccuuaccaucauggaucugcaccccgggucuggaaagacccgccgguaucugccugccauuguuagagaagccaucaaacgcaagcuccggacacugauucuugcuccgacgagaguggucgccagcgagauggcugaagcccugaagggcaugcccauccgcuaccaaaccacagcggugaaauccgagcauaccgggaaggagaucguugaccucaugugccacgccacauucaccaugcggcugcugagcccugugagaguccccaauuauaacaugauuaucauggaugaagcucauuuuacggacccuucuuccauugccgcucggggcuacaucagcacacgcgugggaaugggcgaggccgccgcuauuuucaugaccgcgacacccccugggucuguggaagccuuuccgcagagcaaugcugucauccaggaugaggaaagagacauccccgagcgguccuggaacucuggauaugaguggauuacagauuucccuggcaaaaccguuugguuugugcccagcaucaaguccgggaaugacauugccaacugucuccgcaaaaauggaaagagagugauccagcuuucucggaagacauucgauaccgaauaccagaaaacgaagaacaacgacugggacuacgucgugacaaccgauauuagcgagaugggcgccaauuucagagcugaccgcguuaucgauccucggagaugccugaaacccgugauucugaaggacgggccggaacgcgucauccucgccggcccuaugcccgugacaguugcguccgcugcccagcggagaggacgcaucggccggaaccacaauaaagagggggaucaguauauuuacaugggacagccccugaacaaugacgaggaucaugcccacuggaccgaagcuaagaugcuucuggacaacaucaauacgccugagggcauuauccccgcccucuuugaaccugagagagaaaagagcgcggccauugauggggaguaucgccugagaggagaggcucggaaaaccuucguggaacugaugcgcagaggcgaccucccggucuggcuuucuuacaagguggccuccgagggguuucaauauagcgaucggcgcuggugcuucgacggcgaaagaaacaaucagguccuggaggaaaacauggauguggagaucuggacaaaagagggagaacggaagaaacugagaccccgcuggcucgacgcucggaccuacuccgacccucuggcccuuagagaguuuaaggaguucgcugccggccgccggucuguuagcggggaucugauccucgagauuggaaaacugccccagcaccugacacagagagcgcaaaaugcccucgacaaccuugugaugcugcauaauuccgaacagggcgggcgggcuuaucgccacgccauggaggagcugccugauaccaucgaaacacucaugcugcuugcucugauugccgugcucaccggaggcgucacgcuguuuuuccugucuggcagagggcucggaaagacaagcaucggccuucuguguguuauggccuccagcgugcugcucuggauggcuucuguggagccccauuggauugcggccuccaucauccuggaauuuuuccuuaugguccugcucauuccggagccugaccggcagcgcacaccccaggauaaccaacuggcuuacgugguuaucgggcugcucuuuaugauucuuaccguggccgccaaugagaugggacugcuggaaacaaccaagaaagaccucggcaucgggcacgucgcuguggagaaccaccaucacgccgcgaugcuggaugucgaccuucauccugccagcgcuuggacacuguacgccguggcuacgaccauuaucacacccaugaugagacacaccauugaaaacacaaccgccaauaucucucucacggcgaucgccaaccaggcugccauucugaugggacuggauaagggcuggccuaucuccaaaauggacauuggcguuccccuccuugcucuggggugcuauagccaggugaauccgcugacccucacagccgcuguccugaugcuuguggcccauuacgcgaucauuggaccuggccugcaagccaaggcuacccgggaggcccagaaacgcacagcugccgggaucaugaagaaccccaccguugauggaaucguggccauugaccucgaucccgucguguaugacgcgaaguucgaaaaacagcugggccagaucaugcugcucauucuuuguacgucucaaauccugcugaugagaacaaccugggcucucugcgagagcauuacacuggccaccgggccucuuaccacacugugggagggauccccgggcaaguuuuggaauacgaccaucgcugugucuauggccaacaucuuccggggcagcuaccucgccggggcuggacuggccuucucccugaugaaaagccucggcgggggacgcagaggcacaggggcgcagggagaaacccuuggcgagaaguggaaacggcagcugaaucagcuguccaagucugaauuuaacacauauaagagaagcggcauuauggagguugaccgcuccgaagccaaagaggggcucaagcggggagagaccacgaaacacgcugucucuagaggcacagccaagcugcgcugguucguggaacggaaucuugugaaacccgaggggaaggucaucgaucugggauguggcagagggggauggagcuacuauugcgcuggccucaagaaaguuaccgaagugaagggcuacaccaaagggggaccuggccacgaggaacccauuccuauggccacauacggguggaaccuggugaagcugcauuccggaaaagacgucuuuuucauucccccugagaagugugauacccuccuuugcgacauuggcgagucuagcccgaaucccacaaucgaagaggggcgcacgcugcgggugcugaaaaugguugaaccuuggcucagaggaaaccaauuuuguauuaagauccugaaucccuauaugccuuccguggucgagacccuugagcagaugcagcgcaagcacggcggcaugcuggugcggaacccccucagcagaaauucuacacaugaaauguacuggguuuccugcgggaccggaaacaucgugagcgcggucaauaugacaucucgcaugcugcugaaccgguucaccauggcccacagaaaaccgacguaugagcgcgauguggaccucggcgcugggaccagacacguggccgucgaaccugagguugcuaaccuggauauuaucggacagcggauugaaaauaucaagcaugagcacaaauccacauggcauuacgacgaggauaaccccuauaagaccugggccuaccacggcagcuaugaagugaaacccucuggguccgcuagcuccauggugaauggagucgugaaacuucugacaaagccuugggacguuauucccauggugacccaaaucgccaugacagauaccacgccuuuuggccagcagcgcgucuucaaagagaagguggacacaagaaccccgaaagcgaagcggggcaccgcccaaaucauggaaguuacagcuaaauggcucuggguguuucugagcagaaacaagaagccccggauuuguacgcgcgaggaguucaccagaaaaguccggucuaaugccgcuaucggggccguguuuguugacgagaaccaguggaauagcgccaaggaggcgguggaagaugagcgcuucugggaccuuguccauagagaacgggagcugcacaaacagggaaagugcgcuacaugcguguacaacaugaugggcaaacgcgaaaagaagcucggggaguuuggaaaagccaagggcuccagagccauuugguacauguggcugggggcucgguuccuggaguucgaagcccucggcuuuaugaaugaggaucacugguucucucgcgaaaacagccuguccggagucgagggcgaggggcuucauaaacugggauauauccucagagacauuucuaagaucccuggcgggaauauguacgcugaugacaccgccggaugggauacacggaucaccgaagacgaucugcagaacgaggcgcgcauuacagacaucauggaacccgagcacgcccuucuggcuaaaagcauuuuuaagcucaccuaucaaaauaaagugguuagagugcagcggccugccaagaacggcacggucauggaugugaucucccgcagagaccagcgggggucuggccaggugggaaccuacggccugaauacauucaccaacauggaagcucaacugauuagacagauggagagcgaggggaucuuuucccccagcgaacucgagacaccgaaccuggccgaacgcguucuugauuggcuggagaaguauggaguggaacggcucaaaagaauggcgaucucuggcgacgacugugucgugaagccuauugaugaccgcuucgccaccgcucugacggcccuuaaugauauggggaaaguucggaaggacaucccccagugggagccuuccaaaggauggaacgauuggcagcaagugcccuuuugcagccaucacuuccaccagcugauuaugaaggacggcagagagaucgucgugccuugucgcaaucaggaugaacucgucgggcgggcuagagugucucagggcgccggauggucccugcgcgagacagcuugccugggcaagagcuacgcccaaauguggcagcucauguauuuucaucggagagaccugcgccuugcggccaacgcuauuuguuccgccguucccguggauuggaucccgaccucucggacaaccuggagcauucacgcccaucaccaguggaugacgaccgaagacaugcuguccgucuggaauagaguguggaucgaggaaaacccuuggauggaggauaaaacacauaucagcucuuggggagacguucccuaccucggaaagcgggaggaccaauggugcggcucccugauugggcuuaccgcuagagccacaugggcgaccaauauccagguggcuauuaaccagguccgccggcugaucggaaaugaaaacuaccucgauuauaugacaagcaugaaaagauucaagaaugagucugaccccgaaggcgcccugugguga

SEQ ID NO: 19047 - RNA, 9879 nt, Artificial Sequence
  derived and/or modified CDS sequence (opt5) from DENV-1__JF937597__SS-prME
agcgugaccaugcugcucaugcugaugcccaccgcccuugcuuuccaccugacgaccagaggaggggaaccucauaugaucgucuccaagcaggaacggggaaaaucucuccuguuuaagaccagcgccggcguuaacaugugcacccuuauugcgauggaccugggggaacucugugaagauacaaugaccuacaaaugcccccgcaucacagaagcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggcuaugguccaggccgauuccggaugcgugauuaacuggaaaggccgcgaacugaagugugggagcggaaucuucguuaccaaugaggugcacacauggaccgaacaauauaaguuucaggcggacuccccuaaacggcugucugccgcuauuggcaaggccugggaggagggggucugcggcaucagaagcgcuacgcgccucgaaaacaucauguggaaacagauuuccaacgagcugaaucauauccuucuggaaaacgacaugaagcucacagugguugugggagaugucgccggcauucuggggcagggcaagaagaugauccggccgcaacccauggaguacaaauauucuuggaaaagcuggggcaaggccaagauuaucggggcugacgcgcagaauaccaccuucaucauugauggaccuaacacacccgaauguccugacgaucagagagccuggaauaucugggagguggaggacuacggcuuuggcauuuucaccacgaacaucuggcugaaacuucgcgauuccuauacacaggugugcgaccaccggcucaugagcgcugccauuaaagauucuaaggccguccacgcugacaugggguacuggaucgaauccgagaaaaaugaaaccuggaagcuggccagagcgagcuuuaucgagguuaagacauguauuuggcccaaaucucauacccugugguccaacggagugcucgaaagcgagaugaucauuccgaagaucuauggcgggccuauuucucaacacaauuaccgccccggauacuucacacagaccgcuggcccuuggcaucuggggaaacuugagcuggauuucgaccucugcgaaggaacgaccguggucguggaugagcacugcggcaaccggggccccagccugagaacaaccacaguuaccgggaagaucauccacgaaugguguugccgguccuguacgcugccuccccuucgcuuuagaggagaggacggcugcugguaugggauggagauucggccggugaaagaaaaggaggaaaaucucgucaagagcauggugucugccggauccggcgagguugacagcuucucccuggggcugcucuguaucucuauuaugaucgaagaggugaugagaagccgcuggucccggaaaaugcugaugacaggaacccuugccgucuuuuuccugcucauuaugggccagcugacauggaacgaucugaucagacuuugcauuauggugggcgcuaaugccucugaccgcauggggaugggaaccaccuaccuggcgcucauggcuacauuuaagaugagaccuauguucgccguuggccugcucuuucggcgccugacgagcagagaggugcuucugcucaccaucgggcugucccuggucgccucuguggaacuucccaacagccuggaggaacucggagauggccuggcuauggggaucaugauucucaaacugcuuacagacuuccaaucccaucagcugugggccacccuccugagccugacauuuaucaagaccacguucucucuucacuaugcuuggaaaacaauggccauggugcuguccauugucagccucuuuccccugugucucucuaccaccucccagaagacaaccuggcugccuguucuucugggaagccugggcugcaagccgcucacaauguuccugaucgcggagaauaaaauuuggggccggaagucuuggccccuuaacgaagggaucauggccgugggaaucguguccauucugcucagcucccugcucaaaaacgaugucccucuggcuggcccccuuaucgccgggggaaugcugauugcuuguuacgugaucagcggcucuagcgccgaccugucccucgagaaggccgcugagguuucuugggaagaggaagcggagcauagcggggccucccacaauauucugguggaaguccaggaugacggaacgaugaaaaucaaggaugaggagcgcgacgauacccuuacaauccugcucaaagcuacccugcucgccgugucuggcguuuauccucugagcauucccgccacacuuuuugugugguacuucuggcaaaagaagaaacagagauccggcguccugugggacaccccuucucccccggaaguggagcgggcuguccuggaugacgggaucuaucgcauuaugcagagaggacuccugggccggagccagguggggguuggaguguuccaagaaaacgucuuucauacgauguggcacgugacccgcggcgccguucuuauguaccaggggaagagacuggagccuuccugggcgagcgugaaaaaggaccucaucucuuacggaggcggcuggcggcugagaggguccuggaauacaggagaggaaguccaggugauugcuguggagcccggcaaaaacccuaagaauguucagaccgcccccgggacauucaagaccccggaaggagaggucggcgccaucgcucucgauuuuaaaccugggacaagcggaucucccauugugaaccgcgaaggcaagaucgugggccuguaugggaauggagucgugacgaccuccggcacauacguuagcgccaucgcgcaagcuaaagccucccaggaggggccucuucccgagauugaagacgagguguuccggaagagaaaccugaccaucauggaucugcaccccggaucuggcaaaacccgccgguaucucccugccauugucagagaagcuaucaagcgcaagcugcggacacuuauucuggccccgacgagagugguugcuagcgagauggccgaagcgcucaaagggaugcccauccgcuaccagaccacagccgugaaguccgagcauaccggcaaagagaucgucgaccugaugugccacgcuacauuuaccaugcggcugcucagcccugugagaguucccaauuauaacaugauuaucauggaugaagcccauuucacggacccuucuuccauugcugcccggggauacaucagcacacgcgugggcaugggggaggccgcugcgauuuuuaugaccgccacacccccuggaucugucgaggcuuucccgcaaagcaaugccgugauccaggaugaggaaagagacauccccgagcgguccuggaacucuggcuaugaguggauuacagauuuuccugggaagaccgugugguucguccccagcaucaaauccggaaaugacauugccaacugucuucgcaagaauggcaagagaguuauccagcugucucggaaaacauuugauaccgaauaccagaagacgaaaaacaacgacugggacuacguggugacaaccgauauuagcgagaugggggcuaauuucagagccgaccgcgucaucgauccucggagaugccugaagcccgugauucucaaagacggcccggaacgcguuauccuggcgggaccuaugcccgugacagucgcuuccgccgcccaacggagaggccgcaucgggcggaaccacaauaaggagggagaucaguauauuuacaugggccagccccuuaacaaugacgaggaucaugcucacuggaccgaagccaagaugcugcucgacaacaucaauacgccugaggggauuauccccgcgcuguucgaaccugagagagaaaagagcgccgcuguggauggagaguaucgccugagaggcgaggcccggaagaccuuuguugagcucaugcgcagaggggaccuuccgguguggcugucuuacaaagucgcuuccgagggcuuccaguauagcgaucggcgcuggugcuuugacggagaaagaaacaaucaagugcuggaggaaaacauggaugucgagauuuggacaaaggagggcgaacggaaaaagcucagaccccgcuggcuggacgcccggaccuacuccgacccucuugcucugagagaguucaaagaauuugccgcggggcgccggucugugagcggagaucucauccuggagaucggcaagcugccccagcaccucacacagagagcccagaaugcucuugacaaccugguuaugcugcauaauuccgaacaagggggacgggccuaucgccacgcuauggaggagcucccugauaccauugaaacacugaugcuucuggcccucaucgccgugcugaccggcggcgugacgcuguucuuucucucugggagaggacuuggcaagacaagcauugggcugcugugugucauggcuuccagcguucuccuguggauggcgucuguggagccccauuggaucgccgcuuccauuauccuugaguucuuucugauggugcuccugaucccggagccugaccggcagcgcacaccccaggauaaccagcuggccuacgucgugauuggacuccuuuucaugauccugaccguugccgcuaaugagaugggccugcucgaaacaaccaaaaaggaccuggggauuggacacguggccgucgagaaccaccaucacgcggccaugcuugauguggaccugcauccugcuagcgccuggacacucuacgcugucgccacgaccaucauuacacccaugaugagacacaccaucgaaaacacaaccgcgaauauuucucugacggccaucgcuaaccaagccgcuauccugaugggccucgauaaaggcuggccuauuuccaagauggacaucggggugccccuucuggcccugggaugcuauagccagguuaauccgcucacccugacagcugccgugcuuaugcuggucgcgcauuacgccauuaucggcccugggcuccaggcuaaagccacccgggaggcucaaaagcgcacagccgccggaauuaugaagaaccccaccguggauggcaucguugcgaucgaccuggaucccguggucuaugacgcuaaauuugaaaagcagcuggggcagauuaugcuccuuauccuguguacgucucagauucugcucaugagaacaaccugggcccugugcgagagcaucacacuugcuaccggaccucugaccacacucugggagggcuccccgggcaaauucuggaauacgaccauugccgugucuauggccaacaucuuucgggggagcuaccuggcuggagccggccuggcguucucccucaugaaaagccuugggggaggccgcagagggacaggagcccaaggcgaaacccugggcgagaaauggaagcggcagcugaaucagcucuccaagucugaguucaacacauauaaaagaagcgggaucauggagguggaccgcuccgaagcuaaggagggacugaaacggggcgagaccacgaagcacgccguuucuagagggacagcuaaacuucgcugguuugucgaacggaaucuggugaagcccgagggaaaggugauugaucucggcugugggagaggaggcuggagcuacuauugcgccggccugaaaaaggucaccgaaguuaaaggguacaccaagggaggcccugggcacgaggaacccaucccuauggcgacauacggauggaaccuggugaaacuccauuccggcaaggacguguucuuuauucccccugagaaaugugauacccuucugugcgacaucggggagucuagcccgaaucccacaauugaagagggacgcacgcugcggguccucaagaugguggaaccuuggcugagaggcaaccaguucuguaucaagauucuuaaucccuauaugccuuccguuguggagacccuggagcaaaugcagcgcaaacacggcgggaugcucguccggaacccccugagcagaaauucuacacaugaaauguacuggguguccugcggaaccggcaacaucguuagcgccgugaauaugacaucucgcaugcugcucaaccgguuuaccauggcucacagaaagccgacguaugagcgcgaugucgaccuggggaccggaacaagacacguggccguggaaccugaggucgcuaaccuugauaucauuggccagcggaucgaaaauauuaaacaugagcacaaguccaccuggcauuacgacgaggauaaccccuauaaaacaugggccuaccacgggagcuaugaaguuaagcccucuggauccgcuagcuccauggugaauggcguggucaagcugcucaccaaaccuugggacgugauccccaugguuacacagauugccaugaccgauacgacaccuuucggccaacagcgcguguuuaaggagaaagucgacaccagaaccccgaaggcgaaacgggggacagcccagaucauggaagugacggcuagauggcuguggggauuccuuagccggaacaagaagccccgcaucuguaccagagaggaauuuacacggaaaguucgcucuaaugccgcuauuggcgccguguucgucgacgagaaccaauggaauagcgccaaggaggcgguggaagaugagagauuuugggaccugguucaucgggaacgcgagcuccacaaacaggggaagugcgcuaccugcguguacaacaugaugggaaaaagagaaaagaagcugggcgaguucgggaaagccaagggcucccgggccaucugguacauguggcugggagcucgcuuucucgaguucgaagcccugggcuucaugaaugaggaucacugguuuucuagagaaaacagccuuuccggggucgagggagagggccugcauaaacucggguauauucugcgggacaucucuaagauuccuggaggcaauauguacgcugaugacacagccgggugggauacccgcaucacagaagacgaucuucagaacgaggcgaaaaucaccgacauuauggaacccgagcacgcccugcucgcuaaggccaucuucaaacugacguaucagaauaagguggucagagugcaacggccugcuaagaacggcaccguuauggaugugauuagccgcagagaccagcggggauccggccaggucgggacauacggacugaauaccuuuacaaacauggaagcccagcucaucagacaaauggagucugagggcauuuucagccccuccgaacuggagaccccgaaccuugcggaacgcgcccugaauuggcucgagaaauaugggguggaacggcugaagagaauggcuaucagcggagaugacugugugguuaaaccuaucgacgaucgcuuugccacggcucuuacagcccugaacgacaugggcaaggugcggaaagauauuccccagugggagccuucuaagggguggaaugacuggcagcagguccccuucugcucccaucacuuucaccaacucaucaugaaggauggcagagagauugugguuccuugucgcaaccaggacgaacuggugggacgggcuagagucagccagggcgccggguggucucugcgcgagaccgcgugccucggaaaauccuacgcccagauguggcaacugauguauuuccaucggagagaucuucgccuggcugccaaugccaucuguagcgcugugcccgucgacugggugccgacaucccggaccacguggucuauucacgcccaucaccaguggaugaccacagaagauaugcucagcguuuggaacagaguguggaucgaggaaaauccuuggauggaggacaagacccauauuuccagcugggaggauguccccuaccugggcaaacgggaagaccaguggugcgggucucuuaucggacugacagcgagagcuaccugggccacaaacauccaaguggccauuaaucagguucgccggcucaucggcaacgagaauuaccuggacuauaugaccuccaugaagagauuuaaaaacgaaagcgaucccgagggggcucugugguga

SEQ ID NO: 19048 - RNA, 9879 nt, Artificial Sequence
  derived and/or modified CDS sequence (opt5) from DENV-1__GQ868609__SS-prME
agcgugaccaugcugcucaugcugaugcccacagcccuugcuuuccaccugacgaccagaggaggggaaccucauaugaucgugacaaagcaggaacggggaaaaucccuccuguuuaagaccucugccggcguuaacaugugcacacuuauugcgauggaccugggggaacucugugaagauaccaugacauacaaaugccccagaaucaccgaagcugaacccgacgauguggacuguuggugcaaugccacggauaccugggugacauauggaaccuguagccaaacaggcgaacacagacgggacaagcgcuccguggcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuuguuacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaggacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacguccagaauaccaccuuuaucaucgaugggccuaacacacccgaauguccugacgaucagagagcuuggaauauuugggagguugaggacuauggauucggcaucuuuaccacgaacauuuggcugcgccugcgggauuccuacacacaggugugcgaccacagacuuaugagcgcggccaucaaggauucuaaagcugugcaugccgacaugggcuauuggauugaauccgagaagaaugaaaccuggaaacucgcccgcgcuagcuucaucgaggucaagacauguaucuggcccaagucucacacccugugguccaacggggugcuggaaagcgagaugauuaucccgaaaauuuacggaggcccuaucucucaacauaauuaucggcccggguacuucacacagaccgccggaccuuggcaccucggcaagcuggagcuugauuuugaccugugcgaagggacgaccguuguggucgaugagcacugcggaaacagaggccccagccuccggacaaccacagugaccggcaaaauuauccaugaaugguguugccgcuccuguacgcugccuccccugagauucaagggggaggacggaugcugguacggcauggagauccggccgguuaaagaaaaggaggaaaaucuugucaagagcauggucucugcgggguccggagagguggacagcuuuucccucggccugcuguguauuucuaucaugauugaagagguuaugagaagccgcuggucccggaaaaugcucaugacagggacccuggcuguguuccuucugcucaucaugggacagcugacauggaacgaucugauuagacuuugcaucauggucggcgccaaugccucugaccgcaugggcauggggaccaccuaucuggcucucauggccacauuuaagaugagaccuauguucgcggugggacugcucuuucggcgccugacgagcagagaggugcuucugcucaccauuggccugucccuggucgcuucuguugaacuucccaacagccuggaggaacucggggauggacuggccaugggcaucaugauccucaaacugcuuacagacuuccaaucccaccagcugugggccacccuccugagccugacauuuauuaagaccacgcuuucucugcauuacgcuuggaaaacaauggccauggugcucuccaucgugagccuguucccccucugucugucuaccaccucccagaagacaaccuggcuuccuguccugcuggggagccucggaugcaagccgcugacaauguuucuuauuacggagaauaaaaucuggggccggaagucuuggccccugaacgaaggcauuauggcuguggggguuguguccauccuccugagcucccuccugaaaaacgaugucccucuugccggaccccugaucgcgggcgggaugcugauugccuguuaugugaucagcggaucuagcgcugaccucucccuggagaaggccgcugagguuucuugggaagaggaagccgagcacagcggcgccucccauaauauucuuguggaaguccaggaugacgggaccaugaaaaucaaggaugaggagcgcgacgauacacugaccauucuccugaaagcuacacuccuggcggugucuggagucuacccucuuagcauccccgccacccuguucgugugguauuuuuggcaaaagaagaaacagagauccggcguucugugggacacgccuucucccccggaaguggagcgggcuguccucgaugacggcaucuaccgcauuaugcagagagggcugcuuggacggagccaggugggcguugggguguuccaagaaaacgucuuccacaccauguggcacgugacacgcggagccgugcugauguaucagggcaagagacucgagccuuccugggccagcguuaaaaaggaccugaucucuuacgggggaggcuggcggcuccagggcuccuggaauaccggggaggaaguccaggugauugcuguggagcccggcaagaacccuaagaauguccaaacagcccccggcaccuuuaagacaccggaaggggaggugggagcgaucgcucuggauuucaaaccuggcacgagcgggucucccauuguuaacagagaaggaaagaucgugggccuuuacggcaauggggucgugaccacauccggaaccuauguuagcgccauugcccaggcuaaagccucccaggagggcccucugcccgagaucgaagacgagguguuucgcaagcggaaccugaccaucauggaucuccaucccgggucuggaaaaacaagacgcuaccugccugcgauuguccgggaagcuaucaagagaaaacuucgcacgcugauucucgccccgacccgggugguugccagcgagauggcugaagcccugaaaggcaugcccaucagauaucaaacaaccgcugugaaguccgagcacacagggaaagagauugucgaccugaugugccaugccaccuucacgaugcgccuccuuagcccugugcgggugcccaauuacaacaugaucaucauggaugaagcgcacuuuacagacccuucuuccauugccgcuagaggcuauaucagcacccgggucggaaugggcgaggccgcugccauuuucaugaccgccacacccccugggucuguugaggcuuuuccgcagagcaaugcggugauccaggaugaggaacgcgacauucccgagagauccuggaacucuggauacgaguggaucaccgauuucccuggcaagacagugugguuuguccccagcaucaaauccgggaaugacauugccaacugucugcggaagaauggaaagcgcgugauccagcugucuagaaaaaccuucgauacggaauaucaaaagaccaagaacaacgacugggacuacguugugaccacagauauuagcgagaugggcgcuaauuuucgggccgacagagucaucgauccucgccggugccucaagcccgugauucugaaagacgggccggaaagaguuauccuugccggcccuaugcccgugaccgucgcuuccgccgcgcagcgccggggaagaauuggccgcaaccauaauaaggagggggaucaguacaucuauaugggacagccccugaacaaugacgaggaucacgcucacuggacggaagccaagaugcuccuggacaacaucaauaccccugagggcauuauccccgcccuguucgaaccugagcgggaaaagagcgcugccauugauggggaguacagacuccgcggagaggcgagaaagacauucguggagcuuaugcggcgcggcgaccugccggucuggcugucuuauaaaguggccuccgagggguuucaauacagcgauagacgguggugcuucgacggcgaacgcaacaaucagguucucgaggaaaacauggauguggagaucuggaccaaggagggagaacgcaaaaagcugcggcccagauggcuugacgcucgcacauauuccgacccucuggcccuccgggaguuuaaagaguucgcugccggcagacgcucugugagcggggaucugauucuggagaucggaaagcucccccagcaucuuacccagcgggcucaaaaugcccuggacaaccuggucaugcuccacaauuccgaacagggcgggagagcguaccggcaugccauggaggagcugccugauacaaucgaaacccuuaugcugcucgcucugauugccguucugacgggaggcgugacacucuuuuuccuuucuggccgcgggcugggaaagaccagcaucggccugcucugugugauggcuuccagcguccugcuuuggauggccucuguggagccccacuggauugccgcuuccaucauucuggaauuuuuccucaugguucugcugaucccggagccugacagacagcggacaccccaggauaaccaacucgcguauguggucaucgggcuucuguuuaugauucugacaguggccgcuaaugagaugggacuccuggaaaccaccaaaaaggaccuuggcaucgggcacgucgccguggagaaccaucaccaugccacgaugcuggauguugaccuccacccugcuagcgccuggacccuguacgcgguggccacaaccauuaucacacccaugaugcgccauaccauugaaaacacgaccgcuaauaucucucugacagccauugcuaaccaggccgcgauccucaugggacuugauaaaggcuggccuaucuccaagauggacauuggcgucccccugcuggcccucgggugcuacagccaggugaauccgcugacccuuacagcugccguucugaugcucguggcucacuaugccaucauuggaccuggccugcaagcuaaagccaccagagaggcgcagaagcggacggccgcugggaucaugaagaaccccacagucgauggaauuguggccaucgaccuggaucccgugguuuacgacgcuaaauucgaaaagcagcucggccagaucaugcuucugauucuguguaccucucaaauccuccugaugcgcacaaccugggcccuuugcgagagcauuacccuggccacagggccucucacgacccugugggagggauccccgggcaaauuuuggaauacaaccaucgcggucucuauggcuaacauuuucagaggcagcuaucuggccggggcuggacucgccuuuucccuuaugaaaagccugggcgggggacggcgcggcacaggggcccagggagaaacccugggcgagaaauggaagagacagcucaaucagcuguccaagucugaguucaacaucuacaaacggagcggcaucauggagguggacagauccgaagcuaaggaggggcuuaaacgcggagagacgacacggcacgccgugucuagaggcaccgcgaagcugcgcugguucgucgaacggaaucucguuaaacccgaggggaaggugauugaucugggauguggcagagggggauggagcuauuacugcgccggccugaagaaagugaccgaagucaagggcuauacaaaagggggaccuggccaugaggaacccaucccuauggcuaccuacggguggaaccucgugaaacuucacuccggaaaagacgucuuuuucacacccccugagaagugugauacgcugcugugcgacauuggcgagucuagcccgaaucccaccaucgaagaggggcgcacacuccgggugcugaaaauggucgaaccuuggcuuagaggaaaccaauuuuguauuaagauccugaaucccuacaugccuuccgugguugagacccucgagcagaugcagcgcaagcauggcggcaugcuggugcggaacccccugagcagaaauucuacacacgaaauguauugggucuccugcgggaccggaaacauugugagcgccgugaauaugacgucucgcaugcuccugaaccgguucaccauggcucacagaaaaccgacauacgagaaggaugucgaccuuggcgccgggacccgccauguugcgguggaaccugagguggccaaccuggauaucaucggacagagaauugaaaauaucaaacacgagcauaaguccacauggcacuaugacgaggauaaccccuacaaaaccugggcuuaucauggcagcuacgaagucaagcccucuggguccgccagcuccauggugaauggaguugugaagcuccugacaaaaccuugggacgucauucccauggugacccaaaucgcuaugacggauacaaccccuuuuggccagcagcggguuuucaaggagaaaguggacacccgcacaccgaaggccaaaagaggcacggcucaaauuauggaagucaccgcccgguggcuuuggggguuucugagcagaaacaagaagccccggaucuguacacgcgaggaguucaccagaaaagugcggucuaaugcggccaucggagcuguuuuuguggacgagaaccaguggaauagcgccaaggaggcugucgaagaugagcgcuucugggaccucgugcagaaagaaagagagcugcacaagcagggcaaaugcgccacaugcgucuauaacaugauggggaagcgggaaaagaaacugggagaguuuggcaaggccaaagggucccgcgcgauuugguacauguggcucggcgcuagauuccuggaguuugaagcccuuggauucaugaaugaggaucacugguucucucgggaaaacagccuguccggcguggagggggagggacuccauaagcugggcuacauccuucgcgacauuucuaaaaucccugggggaaauauguaugccgaugacaccgcuggcugggauacaagaauuaccgaagacgaucugcaaaacgaggccaagaucacggacaucauggaacccgagcacgcucuccuggccaccagcauuuuuaaacugacauaccagaauaagguugugcggguccagcgcccugcgaagaacgggaccgugauggaugugaucuccagacgggaccagcgcggcucuggacaaguuggcacauaugggcucaauaccuucacgaacauggaagcccagcugauuagacagauggagagcgagggaaucuuucuucccuccgaacuggagacaccgaaccucgcugaacgggugcuggauuggcuugagaaauacggcgucgaaagacugaagcgcauggccauuagcggggacgacugugugguuaaaccuaucgaugaccgguucgcuaccgcccucacagcgcugaaugauaugggaaaggugagaaaagacaucccccagugggagccuucuaagggcuggaacgauuggcaacagguccccuuuugcucccaucacuuccaccagcugauuaugaaggacgggcgcgagaucguggucccuugucggaaucaggaugaacucgugggcagagcccgcguuagccaaggagcuggcuggucucugcgggagaccgccugccuugggaaauccuaugcucagauguggcagcugauguacuuucauagacgcgaccuccggcuggccgcuaacgccauuuguagcgcggugcccgucgauugggugccgacguccagaaccacauggucuauccacgcccaucaccaauggaugaccacagaagacaugcuuagcguuuggaaucgcguguggauugaggaaaacccuuggauggaggauaagacccaugucuccagcuggggagacgugcccuaucugggcaaacgggaggaccaguggugcgggucucucaucggacugacagcuagagccaccugggccuccaauauucagguggcuaucaaccagguucggagacugaucggcaaugaaaacuaccucgauuacaugacgagcaugaagcgcuucaaaaaugagggggaccccgaaggcgcccugugguga

SEQ ID NO: 19049 - RNA, 9879 nt, Artificial Sequence
  derived and/or modified CDS sequence (opt5) from DENV-1__GQ199803__SS-prME
agcgugaccaugcugcucaugcugaugcccacagcccuugcuuuccaccugacgaucagaggaggggagccucauaugauuguguccaagcaggaacggggaaaaucucuccuguuuaagaccagcgccggcguuaacaugugcacacuuaucgcgauggaccugggggagcucugugaagauaccaugacauacaaaugcccgcgcauuaccgaggcugaacccgacgauguggacuguuggugcaaugccacagauaccugggugacguauggaaccuguucccagacaggcgagcacagacgggacaagcgcucuguggcccuggcuccucauguggggcugggacucgagaccagaacagaaaccuggaugagcuccgagggcgccuggaaacagauccagcggguugaaacgugggcucugcgccaccccggcuucacagugauugcccuuuuucuggcgcaugccaucgggaccucuaucacacagaagggaauuaucuucauucuccugaugcuugucaccccuagcauggcuaugagaugcgugggcaucgggucccgggauuuuguugagggacugagcggcgccaccuggguggacgucgugcucgagcacgggucuugugugacaacgauggcuaaggauaaacccacccuggacauugaacugcucaagacagaggucaccaacccugccguucugcgcaaacuuugcaucgaagcgaagauuuccaauacaaccacggauagcagauguccgacacaaggagaggccacccugguggaggaacaggacgcuaacuucgugugccggcgcaccuuugucgauagaggcuggggcaauggguguggacucuucggcaaagggucucugaucacaugcgccaaguuuaagugcgugaccaaacuugagggaaagaucguucaguacgaaaaccugaaauauuccgugauugucacagugcacacgggcgaccagcaucaaguugggaaugagagcaccgaacacggaacaaccgcuacaaucacaccccaggccccuacgaccgagauucagcucacagacuacggcgcccugacccuggauuguucuccccggacaggccucgacuucaacgaaauggugcugcuuaccaugaaggagaaauccuggcugguccauaagcagugguuucucgaucugccucuucccuggacgagcggggcuuccacaucucaagagaccuggaaucgccaggaccugcucgugacauucaaaaccgcgcacgccaagaagcaggaagucgugguucugggaagccaagagggcgcuaugcacaccgcccugacaggggccacggaaauccagaccuccggaacaaccacaauuuuugcuggccaucucaaaugcagacugaagauggauaaacuuacccugaaggggaugagcuaugugauguguacgggcucuuucaaacucgagaaggaagucgccgagacacagcacggaaccgugcugguucagaucaaguacgagggcaccgacgcgccgugcaaaaucccuuucuccacacaagaugaaaagggggugacccagaacggacggcugauuacagcuaaucccaucgucacggacaaagagaagccugugaacauugaagccgagccgcccuuuggcgagagcuauaucgugauuggggccggagaaaaagcucuuaagcucucuugguucaagaaaggcagcuccaucgggaagauguuugaggccaccgcuagaggcgcccgccggauggcgauccugggagauacagccugggacuucggcucuauugggggaguuuuuaccagcgucggcaaacuggugcaucagaucuucgggacagcuuacggagugcucuuuuccggcgucagcuggaccaugaagauugggaucggcgugcugcuuacguggcugggacucaauucuagauccaccagccugucuaugacauguauugccguuggccuggugacccuuuaccucggggucauggugcaggcugauuccggaugcguuaucaacuggaaaggccgcgaacugaagugugggagcggaauuuucgugacaaaugagguccacaccuggacagaacaauauaaguuucaggccgacuccccuaaacggcugucugcggccaucggcaaggcuugggaggagggggugugcggcaucagaagcgccacccgccucgaaaacauuauguggaaacagaucuccaacgagcugaaucauauucuucuggaaaacgacaugaagcucacgguuguggucggagauguggcuggcauccuggggcagggcaagaagaugauucggccgcaacccauggaguacaaauauucuuggaaaagcuggggcaaggccaagaucaucggggccgacgcucagaauacaaccuucauuaucgauggaccuaacacccccgaauguccugacgaucagagagcguggaauauuugggagguggaggacuacggcuuuggcaucuucacaaccaacauuuggcugaaacuucgcgauuccuauacgcaggucugcgaccaccggcucaugagcgccgcuaucaaagauucuaaggccguucacgccgacaugggguacuggaucgaauccgagaaaaaugaaacauggaagcuggcuagagccagcuuuauugaggugaagaccuguaucuggcccaaaucucauacacugugguccaacggagugcucgaaagcgagaugauuaucccgaagauuuauggcgggccuaucucucaacacaauuaccgccccggauacuucacccagacagcgggcccuuggcaucuggggaaacuugagcuggauuucgaccucugcgaaggaaccacggucgugguugaugagcacugcggcaaccggggccccagccugagaaccacaaccgugacagggaagaucauucacgaaugguguugccgguccuguacccugccuccccuucgcuuuagaggagaggacggcugcugguaugggauggagauccggccggucaaagaaaaggaggaaaaucucgucaagagcaugguuucugcuggauccggcgagguggacagcuucucccuggggcugcucuguauuucuaucaugauugaagaggucaugagaagccgcuggucccggaaaaugcugaugacgggaacacuugccguguuuuuccugcucaucaugggccagcugaccuggaacgaucugauuagacuuugcaucaugguuggcgccaaugcuucugaccgcauggggaugggaacaaccuaccuggcccucauggcgaccuuuaagaugagaccuauguucgcugugggccugcucuuucggcgccugacaagcagagagguccuucugcucacgaucgggcugucccugguggccucuguggaacuucccagcucccuggaggaacucggagauggccuggccauggggauuaugauccucaaacugcuuaccgacuuccaaagccaucagcugugggcuacacuccugucucugaccuuuauuaagacagccuucucccuucacuaugcuuggaaaaccauggccaugguccugagcaucguuucucucuuuccccugugucucuccacgacaagccagaagaccaccuggcugccugugcuucugggaucucugggcugcaagccgcucacaauguuccugauugcggagaacaaaaucuggggccggaaguccuggccccuuaaugaagggaucauggccgugggaauugucagcauccugcucuccagccugcucaaaaacgaugugccucuggcuggcccccuuauugccgggggaaugcugaucgcuuguuacguuauuucuggcagcuccgccgaccugucucucgagaaggccgcugaggugagcugggaagaggaagcggagcauuccggggccucucacaacauccuggucgaagugcaggaugacggaaccaugaaaaucaaggaugaggagcgcgacgauacacuuacgauucugcucaaagcuacccugcucgccguuagcggcguguauccucuguccauccccgccacacuuuuugucugguacuucuggcaaaagaagaaacagagaucuggcgugcugugggacaccccuagcccucccgaagucgagcgggcugugcuggaugacgggauuuaucgcaucaugcagagaggacuccugggccggucccagguuggggugggagucuuccaagaaaauguguuucauacaauguggcacguuacccgcggcgccgugcuuauguaccaggggaagagacuggagcccagcugggcgucugucaaaaaggaccucauuuccuacggaggcggcuggcggcugagagggagcuggaacacgggagaggaaguccaggugaucgcuguugagcccggcaaaaauccuaagaacguccagaccgcccccgggacauucaagaccccggaaggagaggugggcgccauugcucucgauuuuaaaccugggacaucuggaucccccaucgugaaucgcgaaggcaagaucgucggccuguaugggaacggagugguuaccacaagcggcacguacguguccgccauugcgcaagcuaaagccucucaggaggggccucuucccgagaucgaagacgaggucuuccggaagagaaaucugaccauuauggaucugcaccccggaagcggcaaaacacgccgguaucucccugccaucgugagagaagcuauuaagcgcaagcugcggacccuuauccuggccccgaccagaguuguggcuuccgagauggccgaagcgcucaaagggaugcccauccgcuaccagacaacggccgucaagagcgagcauaccggcaaagagauuguggaccugaugugccacgcuacauuuaccaugcggcugcucucuccuguuagagugcccaacuauaauaugaucauuauggaugaagcccauuucacagacccuuccagcaucgcugcccggggauacauuucuacccgcgucggcaugggggaggccgcugcgaucuuuaugacggccacacccccuggaagcguggaggcuuucccgcaauccaacgccgugauccaggaugaggaaagagacauucccgagcggucuuggaauagcggcuaugaguggaucaccgauuuuccugggaagaccgucugguucguucccuccauuaaaucuggaaacgacaucgccaauugucuucgcaagaacggcaagagagugauucagcugagccggaaaacauuugauaccgaauaccagaagaccaaaaauaacgacugggacuacguggucaccacggauaucuccgagaugggggcuaacuucagagccgaccgcgugauugauccucggagaugccugaagcccguuauccucaaagacggcccggaacgcgugauccuggcgggaccuaugcccgucacaguggcuagcgccgcccaacggagaggccgcauugggcggaaucacaacaaggagggagaucaguauaucuacaugggccagccccuuaauaacgacgaggaucaugcucacuggaccgaagccaagaugcugcucgacaauauuaacacaccugaggggaucauucccgcgcuguucgaaccugagagagaaaaaucugccgcuguugauggagaguaucgccugagaggcgaggcccggaagaccuuuguggaacucaugcgcagaggggaccuuccggucuggcuguccuacaaaguggcuagcgagggcuuccaguauuccgaucggcgcuggugcuuugacggagaaagaaauaaccaaguccuggaggaaaauauggauguggagaucuggacgaaggagggcgaccggaaaaagcucagaccccgcuggcuggacgcccggaccuacucugauccucuugcucugagagaguucaaagaguuugccgcggggcgccggagcguuuccggagaccucauccuggaaauuggcaagcugccccagcaccucacacagagagcccagaacgcucuugauaaucuggugaugcugcauaacucugagcaagggggacgggccuaucgccacgcuauggaagaacucccugacaccaucgagacacugaugcuucuggcccucauugccgugcugaccggcggcgucacacuguucuuucucagcgggagaggacuuggcaagaccuccaucgggcugcuguguguuauggcuagcucugugcuccuguggauggcguccguggaaccccauuggauugccgcuagcaucauccuugaguucuuucugaugguccuccugauuccggaaccugaucggcagcgcacgccccaggacaaucagcuggccuacgugguuaucggacuccuuuucaugauucugacaguggccgcuaacgagaugggccugcucgagaccaccaaaaaggaucuggggaucggacacgucgccguggaaaaucaccaucacgcggccaugcuugacgucgaucugcauccugcuucugccuggacacucuacgcuguggccaccacaauuaucacgcccaugaugagacacaccauugagaacacaaccgcgaacaucucccugacagccaucgcuaaucaagccgcuauucugaugggccucgacaaaggcuggccuaucagcaagauggauauugggguuccccuucuggcccugggaugcuauucucaggugaacccgcucacccugacggcugccguccuuaugcugguggcgcauuacgccaucauuggcccugggcuccaggcuaaagccacccgggaagcucaaaagcgcacagccgccggaaucaugaagaaucccaccguugacggcaucguggcgauugaucuggaccccgucguguaugacgcuaaauuugagaagcagcuggggcagaucaugcuccuuauucuguguacaagccagauccugcucaugagaaccacgugggcccugugcgaauccauuacacuugcuaccggaccucugacaacccucugggagggcucuccgggcaaauucuggaacaccacaaucgccgugagcauggccaauaucuuucggggguccuaccuggcuggagccggccuggcguucagccucaugaagucccuugggggaggccgcagagggacgggagcccaaggcgagacccugggcgaaaaauggaagcggcagcugaaccagcucucuaagagcgaguucaauacauauaaaagauccgggauuauggaaguugaucgcucugaggcuaaggaaggacugaaacggggcgagaccacaaagcacgccgucagcagagggaccgcuaaacuucgcugguuuguggagcggaaccuggugaagcccgaaggaaaggucaucgaccucggcugugggagaggaggcugguccuacuauugcgccggccugaaaaagguuacggaggugaaaggguacacaaagggaggcccugggcacgaagaacccauuccuauggcgaccuacggauggaaucuggugaaacuccauucuggcaaggaugucuucuuuauucccccugaaaaaugugacacccuucugugcgauaucggggagagcuccccgaaccccacaaucgaggaaggacgcacccugcgggugcucaagaugguugagccuuggcugagaggcaaucaguucuguauuaagauccuuaaccccuauaugccuagcguggucgaaacacuggagcaaaugcagcgcaaacacggcgggaugcucgugcggaauccccugucuagaaacuccacgcaugagauguacuggguuagcugcggaaccggcaauaucgugucugccgucaacaugacaucccgcaugcugcucaaucgguuuaccauggcucacagaaagccgacauaugaacgcgacguggaucuggggaccggaacgagacacguggccgucgagccugaaguugcuaaccuugacauuaucggccagcggauugagaacaucaaacaugaacacaagagcaccuggcauuacgaugaggacaaucccuauaaaacaugggccuaccacgggucuuaugaggugaagcccuccggaagcgcuuccagcauggugaacggcgucgugaagcugcucaccaaaccuugggauguuauucccauggugacacagaucgccaugaccgacacaaccccuuucggccaacagcgcgucuuuaaggaaaaaguggacacgagaacaccgaaggcgaaacgggggaccgcccagaucauggagguuaccgcuagauggcuguggggauuccuuucucggaauaagaagccccgcauuuguacaagagaagaguuuacgcggaaagugcgcagcaacgccgcuaucggcgccgucuucguggaugaaaaucaauggaacuccgccaaggaggcgguugaggacgaaagauuuugggaucuggugcaucgggagcgcgaacuccacaaacaggggaagugcgcuaccugcgucuacaauaugaugggaaaaagagagaagaagcugggcgaguucgggaaagccaagggcucucgggccauuugguacauguggcugggagcucgcuuucucgaguucgaggcccugggcuucaugaacgaagaccacugguuuagcagagaaaauucccuuucugggguggaaggagagggccugcauaaacucggguauauccugcgggauauuagcaagaucccuggaggcaacauguacgcugacgauacagccgggugggacacccgcaucacagaggaugaccuucagaaugaagcgaaaauuaccgauaucauggagcccgaacacgcccugcucgcuaaggccauuuucaaacugacauaucagaacaaggucgugagaguucaacggccugcuaagaauggcaccgugauggacgucaucucccgcagagaucagcggggaucuggccagguggggacguacggacugaacaccuuuacaaauauggaggcccagcucauuagacaaauggaaagcgagggcaucuucucccccagcgagcuggaaaccccgaaccuugcggagcgcgcccuggacuggcucgaaaaauaugggguggagcggcugaagagaauggcuaucucuggagacgauuguguugugaaaccuauugacgaucgcuuugccacagcucuuaccgcccugaacgacaugggcaagguccggaaagauaucccccagugggaaccuuccaagggguggaaugacuggcaacaggugcccuucugcagccaucacuuucaccaacucauuaugaaggauggcagagagaucguugugccuugucgcaaccaggacgagcuggucggacgggcuagagugucucagggcgccggguggucccugcgcgaaacggcgugccucggaaaaagcuacgcccagauguggcaacugauguauuuccaucggagagaucuucgccuggcugccaaugccauuuguuccgcuguccccguggacuggguuccgacaucucggaccacauggagcauccacgcccaucaccaguggaugaccacggaggauaugcucuccguguggaacagagucuggauugaagagaauccuuggauggaagacaagacccauaucagcucuugggaggacgugcccuaccugggcaaacgggaggaucaguggugcgggucccuuaucggacugacagcgagagcuaccugggccacaaacauucaaguugccaucaaucaggugcgccggcucauuggcaacgaaaauuaccuggacuauaugaccagcaugaagagauuuaaaaacgagucugaucccgaaggggcucugugguga

SEQ ID NO: 19050 - RNA, 9879 nt, Artificial Sequence
  derived and/or modified CDS sequence (opt5) from DENV-1__GQ199804__SS-prME
agcgugaccaugcugcucaugcugaugcccacagcccuugcuuuccaccugacgaccagaggcggggagccucauaugaucgucuccaagcaggaacgggggaaaucucuccuguuuaagacaagcgccggcguuaacaugugcacccuuauugccauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugucauugggaccucuaucacccagaagggaaucauuuucauccuccugaugcuugugacaccuagcauggcgaugagaugcguuggcauugggucccgggauuuuguggagggacugagcggcgccacgugggucgacguggugcucgagcacgggucuugugucaccacaauggcuaaggauaaacccacccuggacaucgaacugcucaagacagagguuaccaacccugccgugcugcgcaaacuuugcauugaagcuaagaucuccaauacgacaaccgauagcagauguccgacccaaggagacgccacacugguggaggaacaggaugcgaacuucgucugccggcgcaccuuuguggacagaggcuggggcaauggguguggacucuucggcaaagggucucugauuacaugcgccaaguuuaagugcguuacgaaacuugagggaaagaucgugcaguacgagaaccugaaauauuccgucaucgugaccguucacacaggcgaccagcaucaaguggggaaugaaagcaccgagcacggaacaaccgcuacgauuacaccccaagccccuaccaccgaaauccagcucacagauuacggcgcucugacccuggacuguucuccccggacgggccucgauuucaacgagaugguccugcuuacaaugaaggaaaaauccuggcuggugcauaagcagugguuucucgaccugccucuucccuggaccagcggggccuccacaucucaagagaccuggaaucgccaggaucugcucgucaccuucaaaacagcccacgcuaagaagcaggaggugguugugcugggaagccaagaaggcgcgaugcacacggcccugaccggggcuacagagauucagaccuccggaacaaccacgaucuuugccggccaucucaaaugcagacugaagauggacaaacuuacacugaaggggaugagcuaugucauguguaccggcucuuucaaacucgaaaaggagguggccgaaacccagcacggaacaguucuggugcagauuaaguacgagggcaccgaugcuccgugcaaaaucccuuucuccacacaagacgagaagggggucacgcagaacggacggcugaucaccgccaaucccauugugacagauaaagaaaagccugugaacaucgaggcggaaccgcccuuuggcgagagcuauauuaucauuggggcuggagagaaagcccuuaagcucucuugguucaagaaaggcagcuccaucgggaagauguuugaagccaccgcuagaggcgcccgccggauggcuauccugggagacacagccugggauuucggcucuauugggggaguuuuuaccagcgucggcaaacuggugcaucagaucuucgggacggcguacggagugcucuuuuccggcgucagcuggaccaugaagauugggaucggcgugcugcuuacauggcugggacucaauucuagauccaccagccugucuaugacauguauugccguuggccuggugacccuuuaccucggggucauggugcaggcugacuccggaugcguuaucaacuggaaaggccgcgagcugaagugugggagcggaauuuucgugacaaaugaaguccacaccuggacggagcaauauaaguuucaggccgacuccccuaaacggcugucugcugccaucggcaaggcgugggaagagggggugugcggcaucagaagcgccacacgccucgagaacauuauguggaaacagaucuccaacgaacugaaucauauucuucuggagaacgauaugaaguucaccguuguggucggagacguggcuggcauccucgcccaggggaaaaagaugauucggccgcaacccauggaauacaaauauucuuggaaaagcuggggaaaggcuaaaaucaucggcgccgaugugcagaauaccacauuuauuaucgacgggccuaacacccccgaguguccugaugaccagagagccuggaauauuugggaagucgaggauuacggauucggcaucuuuacgacaaacauuuggcugaagcugcgcgacuccuauacccagguuugcgaucaccggcuuaugagcgcugcgaucaaagacucuaaggccgugcacgcugauaugggcuacuggaucgaguccgagaagaaugagacauggaagcucgccagagccagcuucauugaagugaagaccuguaucuggcccaaaucucauacacugugguccaacgggguccuggagagcgaaaugauuaucccgaagauuuauggaggcccuaucucucaacacaauuaccgccccggguacuucacccagacggcuggaccuuggcaucucggcaaacuggagcuugacuuugaucugugcgaggggaccacagugguuguggacgaacacugcggaaaccggggccccagccucagaaccacaaccgucacgggcaagaucauucacgagugguguugccgguccuguacacugccuccccugcgcuucagaggggaagacggaugcugguauggcauggagauccggccggugaaagagaaggaagagaaucuuguuaagagcauggugucugccggguccggagaagucgauagcuuuucccucggccugcuguguauuucuaucaugauugaggaagugaugagaagccgcuggucccggaaaaugcucaugaccgggacacuggcgguuuucuuucuucugaucaugggacagcucaccuggaacgaccugauuagacugugcaucauggugggcgcuaaugccucugaucgcaugggcauggggaccacauaccuugcccugauggcuacguucaagaugagaccuauguuugccgucggacuccuguuccggcgccucaccagcagagaggugcugcuucugacaaucggccucucccugguggcgucugucgagcugcccaacagccuugaagaacugggggacggacucgcuaugggcauuaugauccugaaacuccugaccgauuuucaaucccaucagcuuugggccacacugcucagccugaccuucauuaagacgacauuuucucugcacuaugccuggaaaaccauggcuaugguucuuuccaucgugagccuguucccccucugucugucuaccacaucccagaagaccacauggcucccugugcugcuugggagccugggaugcaagccgcugacgauguuucucauugccgaaaauaaaaucuggggccggcgcucuuggccccugaacgagggcaucauggcugucgggauuguguccauccuucugagcucccuccugaagaacgacguuccucucgccggaccccugauugcgggcgggaugcuuaucgccuguuacgugauuagcggaucuagcgcugaucugucccuggaaaaagccgcugaggucucuugggaggaagaggccgaacauagcggcgccucccacaauauccucguggagguucaggacgaugggaccaugaagaucaaagacgaagagagagaugacacacugaccauucuucugaaggcuacacuccuggcggugucuggagucuauccucucagcauccccgccacccuguucgugugguacuucuggcagaagaagaagcagcgguccggcguccuuugggauacgccuucucccccggagguggaacgcgcuguucuggacgacggcauuuauagaaucaugcagcgggggcugcucggacgcagccaggugggcgucgggguguuucaagagaacguuuuccauaccauguggcacgugacaagaggagccguccugauguaccagggcaaacggcuugaaccuuccugggccagcgugaagaaagaucugauuucuuacgggggaggcuggagacuccagggcuccuggaauaccggggaggaggugcagguuaucgcugucgaacccggaaagaacccuaaaaaugugcaaacagcccccggcaccuuuaagacaccggagggggaagugggagcgauugcucuggacuucaagccuggcacgagcgggucucccaucgucaaccgcgagggaaaaaucgugggccucuauggcaaugggguugugaccacauccggaaccuacgucagcgccauugcccaggcuaaggccucccaggaaggcccucugcccgagaucgaggaugaaguguuucggaaaagaaaccuuaccauuauggaccugcaccccgggucuggaaagacacgccgguaucugccugcgaucguuagagaggcuauuaaacgcaagcuccggacgcugauccuugccccgaccagaguggucgccagcgaaauggcugaggcccugaagggcaugcccauccgcuaccaaacaaccgcugugaaauccgaacauacagggaaggagauuguugaucucaugugccacgccaccuucacgaugcggcugcugagcccugugagaguccccaauuauaacaugaucauuauggacgaggcgcauuuuacagauccuucuuccaucgccgcucggggcuacauuagcacccgcgugggaaugggcgaagccgcugccaucuucaugaccgccacacccccugggucuguggaggcuuuuccgcagagcaaugcggucauccaggacgaagagagagauauucccgaacgguccuggaacucuggauaugaguggaucaccgacuucccuggcaaaacaguuugguuugugcccagcauuaaguccgggaaugauaucgccaacugucuccgcaaaaauggaaagagagugauucagcuuucucggaagaccuucgacacggaguaccagaaaacaaagaacaacgacugggauuacgucgugaccacagacaucagcgaaaugggcgcuaauuucagagccgaucgcguuauugacccucggagaugccugaaacccgugauccugaaggaugggccggagcgcgucauccucgccggcccuaugcccgugaccguugcuuccgccgcgcagcggagaggacgcauuggccggaaccacaauaaagaaggggaccaguauaucuacaugggacagccccugaacaaugaugaggaccaugcucacuggacggaggccaagaugcuucuggauaacauuaauaccccugaaggcaucauucccgcccucuuugagccugaaagagaaaagagcgcugccaucgacggggaauaucgccugagaggagaggcgcggaaaacauucguggagcugaugcgcagaggcgaucucccggucuggcuuucuuacaagguggccuccgaaggguuucaauauagcgaccggcgcuggugcuucgauggcgagagaaacaaucagguccuggaagagaacauggacguggaaaucuggaccaaagagggagagcggaagaaacugagaccccgcuggcucgacgcucggacauacuccgauccucuggcccuuagagaauuuaaggaguucgcugccggccgccggucuguuagcggggaccugauucucgaaaucggaaaacugccccagcaccugacccagagagcucaaaaugcccucgauaaccuugugaugcugcauaauuccgagcagggcgggcgggcguaucgccacgccauggaggaacugccugacacaauugagacccucaugcugcuugcucugaucgccgugcucacgggaggcgucacacuguuuuuccugucuggcagagggcucggaaagaccagcauuggccuucuguguguuauggcuuccagcgugcugcucuggauggccucuguggaaccccauuggaucgccgcuuccaucauucuggaguuuuuccuuaugguccugcucaucccggaaccugaucggcagcgcacaccccaagacaaccaacuggcguacgugguuauugggcugcucuuuaugauccuuaccguggccgcuaaugagaugggacugcuggagaccacaaagaaagaucucggcauugggcacgucgccguggaaaaccaccaucacgccgcuaugcuggacgucgaucuucauccugccagcgcguggacgcuguacgccguggcuaccacaaucauuacccccaugaugagacacacaaucgagaacaccacggccaauaucucucucaccgcuauugccaaccaggcggccauccugaugggacuggacaagggcuggccuauuuccaaaauggauaucggcguuccccuccuugcucuggggugcuauagccaggugaauccgcugacacucaccgccgcuguccugaugcuuguggcccauuacgcuauuaucggaccuggccugcaagccaaggcgacacgggaagcccagaaacgcaccgcugccgggaucaugaagaaccccacgguugacggaauuguggcuaucgaucucgaccccgucguguaugacgccaaguucgagaaacagcugggccagauuaugcugcucauccuuuguacaucucaaauucugcugaugagaaccacaugggcccucugcgaaagcaucacccuggcgaccgggccucuuacaacgcugugggagggauccccgggcaaguuuuggaauaccacaaucgcugugucuauggccaacauuuuccggggcagcuaccucgcuggggccggacuggccuucucccugaugaaaagccucggcgggggacgcagaggcaccggggcucagggagagacacuuggcgaaaaguggaaacggcagcugaaucagcuguccaagucugaguuuaacaccuauaagagaagcggcaucauggaaguugaucgcuccgaggccaaagaagggcucaagcggggagagacgacaaaacacgcggucucuagaggcaccgccaagcugcgcugguucguggagcggaaucuugugaaacccgaagggaaggucauugaccugggauguggcagagggggauggagcuacuauugcgcuggccucaagaaaguuaccgaggugaagggcuacacaaaagggggaccuggccacgaggagcccaucccuauggccaccuacggguggaaccuggugaagcugcauuccggaaaagaugucuuuuucauucccccugaaaagugugacacacuccuuugcgauaucggcgagucuagcccgaaucccacgauugaggaagggcgcacccugcgggugcugaaaaugguugagccuuggcucagaggaaaccaauuuuguaucaagauccugaaucccuauaugccuuccguggucgaaacacuugagcagaugcagcgcaagcacggcggcaugcuggugcggaacccccucagcagaaauucuacccaugagauguacuggguuuccugcgggacaggaaacauugugagcgcugucaauaugaccucucgcaugcugcugaaccgguucacgauggcccacagaaaaccgaccuaugaacgcgacguggaucucggcgcggggacaagacacguggccgucgagccugaaguugcuaaccuggacaucauuggacagcggaucgagaauauuaagcaugaacacaaauccaccuggcauuacgaugaggacaaccccuauaagacaugggccuaccacggcagcuaugaggugaaacccucuggguccgcuagcuccauggugaauggagucgugaaacuucugaccaagccuugggauguuauccccauggugacacaaaucgccaugaccgacacgacaccuuuuggccagcagcgcgucuucaaagaaaagguggacaccagaaccccgaaagcuaagcggggcacagcccaaauuauggagguuacggcgaaauggcucuggggguuucugagcagaaacaagaagccccggaucuguacccgcgaagaguucacaagaaaagugcggucuaaugccgcuauuggagccgucuuuguggaugaaaaccaguggaauagcgcuaaggaggccguugaggacgaacgcuucugggaucuugugcauagagagcgggaacugcacaaacagggcaagugcgcgaccugcgucuacaacaugauggggaaacgcgagaagaagcucggagaauuuggcaaagcgaagggguccagagcuaucugguacauguggcugggcgcccgguuccuggaguucgaggcccucggauuuaugaaugaagaccacugguucucucgcgagaacagccuguccggcguggaaggggagggacuucauaaacugggcuauauucucagagauaucucuaagaucccugggggaaauauguacgcugacgauacagccggcugggacacccggauuacagaggaugaccugcagaacgaagcucgcaucaccgauauuauggagcccgaacacgcccuucuggcgaaaagcaucuuuaagcucacguaucaaaauaaagucgugagaguucagcggccugccaagaacgggaccgugauggacgucauuucccgcagagaucagcggggcucuggacaggugggcacauacgggcugaauaccuucacaaacauggaggcucaacugaucagacagauggaaagcgagggaaucuuuucccccagcgagcucgaaaccccgaaccuggccgagcgcgugcuugacuggcuggaaaaguauggcguugagcggcucaaaagaauggcuauuucuggggacgauuguguggucaagccuaucgacgaucgcuucgccacggcgcugacagcccuuaaugacaugggaaaagugcggaaggauauuccccagugggaaccuuccaaaggcuggaacgacuggcagcaaguucccuuuugcagccaucacuuccaccagcugaucaugaaggaugggagagagauuguggucccuugucgcaaucaggacgagcucgugggccgggcuagagucucucagggagccggcuggucccugcgcgaaaccgcuugccugggaaagagcuacgcccaaauguggcagcucauguauuuucaucggagagaucugcgccuugcugccaacgcgaucuguuccgccgugcccguugacuggauuccgacaucucggaccacguggagcauccacgcucaucaccaguggaugaccacagaggauaugcuguccguguggaauagagucuggaucgaagagaacccuuggauggaagacaaaacccauauuagcucuuggggagacgugcccuaccucggcaagcgggaggaucaauggugcgggucccugaucggacuuacagccagagccaccugggcuacaaauauucagguugccaucaaccaggugcgccggcugauuggcaaugagaacuaccucgacuauaugaccagcaugaaaagauucaagaaugaaucugaucccgagggggcgcugugguga

SEQ ID NO: 19051 - RNA, 9879 nt, Artificial Sequence
  derived and/or modified CDS sequence (opt5) from DENV-1__GQ199805__SS-prME
agcgugaccaugcugcugaugcugaugcccaccgcccuugcuuuccaccugacgacccggggcggggaaccucauaugaucgucaccaagcaggaacggggaaagucccuucuguuuaagaccucugccggcguuaacaugugcacccuuauugccauggaccugggggaacucugugaagauaccaugacauacaagugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaagcagauucagcggguugaaaccugggcucugcgccaccccggcuucacagugaucgcccuuuuucuggcgcaugucauugggaccuccaucacccagaagggaaucauuuucauccuccugaugcuugugacaccuucuauggccaugagaugcguuggcauugggagccgggauuuuguggagggacuguccggcgcuacgugggucgacguggugcucgagcacgggagcugugucaccacaauggccaaggauaagcccacccuggacaucgaacugcucaagacagagguuaccaacccugcugugcugcgcaaacuuugcauugaagccaagaucucuaauacgacaaccgauuccagauguccgacccaaggagaggcgacacugauggaagaacaagacgccaacuucgugugccggcgcaccuuugucgauagaggcuggggcaauggguguggacucuucggcaaagggagccugauuacaugcgcuaaguuuaagugcgugacgaaacuugagggaaagaucguucaguacgaaaaccugaaauauucugugaucgucaccgugcacacaggcgaccagcaucaaguugggaaugaguccaccgaacacggaacaaccgccacgauuacaccccaggcuccuacaagcgagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggccuccaccucucaagagacauggaaucgccaggaccugcucgugaccuucaaaaccgcucacgcgaagaagcaggaagucgugguucugggaagccaagagggcgccaugcacacagcucugacgggggccaccgaaauucagacauccggaaccacaaccaucuuugccggccaucucaaaugcagacugaagauggauaaacuuacgcugaaggggaugagcuaugugauguguacaggcucuuucaaacucgagaaggaagucgcugagacccagcacggaaccgugcugguucagauuaaguacgagggcacagacgccccgugcaaaaucccuuucuccacccaagaugaaaagggggugacacagaacggacggcugaucacggcgaaucccauugucaccgacaaagagaagccugugaacaucgaagcugagccgcccuuuggcgagagcuauauugugaucggggccggagaaaaagcccuuaagcucucuugguucaagaaaggcagcuccauugggaagauguuugaggcuacagccagaggcgcucgccggauggccauccugggagauaccgcgugggacuucggcucuaucgggggaguuuuuacaagcgucggcaaacuggugcaucagauuuucgggaccgccuacggagugcucuuuuccggcgucagcuggacgaugaagaucgggcugggcgugcuucugaccuggcucggacucaauucuagauccacaagccugucuaugaccuguauugcuguuggccuugugacacucuaccugggggucauggugcaggccgauuccggaugcguuaucaacuggaaaggccgcgaacugaagugugggagcggaauuuucgugaccaaugagguccacacauggaccgaacaauauaaguuucaggcugacuccccuaaacggcucucugccgcgaucggcaaggccugggaggagggggugugcggcauuagaagcgcuacgcgccuggaaaacaucauguggaaacagaucuccaacgagcuuaaucauauucugcucgaaaacgacaugaaguucacaguuguggucggagauguggugggcauccuggcccaggggaaaaagaugauucggccgcaacccauggagcacaaauacucuuggaaaagcuggggaaaggcuaagaucauuggcgccgacguccagaauaccaccuuuaucaucgaugggccuaacacacccgaauguccugacgaucagagagccuggaauauuugggagguugaggacuauggauucggcaucuuuaccacgaacauuuggcugaaacuucgcgauucccacacacaggugugcgaccaucggcucaugagcgcugcgaucaaagauucuaaggccgugcacgcugacaugggcuacuggauugaauccgagaaaaaugaaaccuggaagcuggccagagccagcuucaucgaggucaagacauguaucuggcccaaaucucauacccugugguccaacggggugcucgaaagcgagaugauuaucccgaagauuuauggaggcccuaucucucaacacaauuaccgccccggguauuucacacagaccgcuggaccuuggcaccugggcaaacuugagcuggauuuugaccucugcgaagggacgaccguuguggucgaugagcauugcggaaaccggggccccagccugagaacaaccacagugaccggcaagauuauccacgaaugguguugccgguccuguacgcugccuccccuucgcuucaaaggggaggacggaugcugguacggcauggagaucagaccgguuaaggaaaaggaggaaaaucucgugaaaagcauggucucugccggguccggagagguggacagcuuuucccugggccugcucuguauuucuaucaugauugaagagguuaugcggagcagauggucccgcaagaugcugaugacagggacccuugcgguguuccugcuccugaucaugggacagcugacauggaacgaucuuacccggcugugcauuauggucggcgcuaaugccucugacagaaugggcauggggaccacauaccucgcccugauggcuacguuuaaaaugcgcccuauguucgccgugggacuccuguuuagacggcuuaccagccgcgaggugcugcuccugacaaucggccugucccuugucgcgucuguugaacugcccaacagccucgaggaacugggggauggacucgcuaugggcauuaugauccugaaacuucugaccgacuuccaaucccaucagcucugggccacacugcugagccuuaccuuuaucaaaacgacacugucucuccacuaugccuggaagaccauggcuauggugcuguccauugugagccucuucccccugugucuuucuaccacaucccagaagaccacauggcugccuguccugcucgggagccugggaugcaaaccgcuugccauguuucugaucgcugagaauaagauuuggggcagaaaaucuuggccccucaacgaaggcaucauggccguggggguuguguccauucugcucagcucccugcuuaagaacgaugucccucuggcgggaccccugaucgccggcgggaugcucaucgcuuguuacgugauuagcggaucuagcgccgaccugucccuugagaaagcugccgagguuucuugggaagaggaagccgagcauagcggcgcuucccacaauauccugguggaaguccaggaugacgggacgaugaagauuaaagaugaggagcgggacgauacccucacaauccugcucaaggcgacccugcuugccgugucuggagucuauccucugagcauucccgcuacacuguucgugugguacuuuuggcaaaagaaaaagcagcgcuccggcguucucugggacaccccuucucccccggaaguggagagagccguccuggaugacggcaucuaucggaucaugcagcgcgggcuucugggaagaagccaggugggcguugggguguuccaagaaaacgucuuccacacgauguggcaugugacccggggagccgugcucauguaccagggcaaacgccuggagccuuccugggcuagcguuaagaaagaccucauuucuuaugggggaggcuggagacugcagggcuccuggaauacaggggaggaaguccaggugaucgccguggagcccggaaagaacccuaagaauguccaaaccgcgcccggcacauuuaaaaccccggaaggggaggugggagcuauugcccuugauuucaagccuggcacaagcgggucucccaucguuaaccgggaaggaaaaauugugggccuguacggcaauggggucgugacgaccuccggaacauacguuagcgccaucgcucaggccaaggcgucccaggagggcccucugcccgagauugaagacgagguguuuagaaaacgcaaccucaccaucauggaucugcaccccgggucuggaaagacccggagauaucuuccugcuaucguccgcgaagccauuaagcggaaacugagaacacucauccuggccccgacgcgcgugguugcuagcgagauggccgaagcucugaagggcaugcccauucgguaccaaaccacagccgugaaauccgagcauaccgggaaggagaucgucgaccucaugugccacgcgacauucaccaugagacuucugagcccugugcgcgugcccaauuauaacaugauuaucauggaugaagcccauuuuacggacccuucuuccaucgcugcccggggcuacauuagcacaagagucggaaugggcgaggcugccgccaucuucaugaccgcuacacccccugggucuguugaagcguuuccgcagagcaaugccgugauucaggaugaggaacgggacauccccgagcgcuccuggaacucuggauaugaguggauuacagauuucccuggcaaaaccgugugguuuguccccagcaucaaguccgggaaugacaucgcuaacugucugagaaagaauggaaaacgggugauucagcucucucgcaagacauucgauaccgaauaccagaagacgaagaacaacgacugggacuauguugugacaaccgauaucagcgagaugggcgccaauuuuagagccgaccgggucauugauccuagacgcugccugaaacccgugauccuuaaggacgggccggaacggguuauucuggcuggcccuaugcccgugacagucgccuccgcggcucagagacgcggacggaucggcagaaaccacaauaaggagggggaucaguacauuuacaugggacagccccucaacaaugacgaggaucacgcccauuggaccgaagccaaaaugcugcuggacaacaucaauacgccugagggcaucauucccgcucucuucgaaccugagcgcgaaaagagcgccgcgaucgauggggaguaucggcuuagaggagaggcccgcaaaaccuucguggaacugaugagacggggcgaccugccggucuggcucucuuacaagguggcuuccgagggguuucaauauagcgaucgcagauggugcuucgacggcgaacggaacaaucagguucuggaggaaaacauggauguggagauuuggacaaaagagggagaacgcaagaaacuuagaccccgguggcuggacgccagaaccuacuccgacccucucgcucugcgcgaguuuaaggaguucgccgcuggccggagaucugugagcggggaucugauccucgagauuggaaaacuuccccagcaccugacacagcgcgcccaaaaugcgcuggacaaccucgucaugcugcauaauuccgaacagggcgggcgggccuauagacacgcuauggaggagcuuccugauaccaucgaaacacugaugcuccuggcccugaucgcuguucucaccggaggcgugacgcucuuuuuccugucuggccgggggcugggaaaaacaagcauuggccuccugugugugauggccuccagcguccuucuguggauggccucuguggagccccacuggaucgcugcguccauuauccucgaauuuuuccugaugguucugcucauuccggagccugaccgccagagaacaccccaggauaaccaacuugccuacguggucaucgggcugcuguuuaugauccucaccguggcugccaaugagaugggacugcuugaaacaaccaagaaagaccugggcauugggcaugucgccguggagaaccaccaucacgcuacaaugcucgauguugaccugcauccugccagcgcguggacgcuguaugccguggcuaccacaaucauuacccccaugaugcggcacacaaucgaaaacaccacggccaauauuucucucaccgcuaucgccaaccaggcggccauucuuaugggacuggauaagggcuggccuaucuccaaaauggacaucggcgucccccugcucgcucuggggugcuacagccaggugaauccgcuuacacugaccgccgcuguucucaugcugguggcccacuacgcuauuaucggaccuggccugcaagccaaggcgacacgcgaggcccagaagagaaccgcugccgggauuaugaaaaaccccacggucgauggaaucguggcuauugaccucgaucccgugguuuaugacgccaaguucgaaaaacagcuuggccagaucaugcugcugauccucuguacaucucaaauucugcuuaugcggaccacaugggcccugugcgagagcaucacccucgcgaccgggccucugacaacgcugugggagggauccccgggcaaguuuuggaauaccacaauugcugucucuauggccaacaucuuccgcggcagcuaccucgcuggggccggacuugccuuuucccugaugaaaagccugggcgggggaagacggggcaccggggcucagggagaaacacucggcgagaaguggaagcgccagcugaaucagcuuuccaaaucugaguucaacauuuauaagagaagcggcaucauggagguggaccgguccgaagccaaagaggggcugaagagaggagagaccacgcgccaugcggugucucggggcacagccaaacucagaugguucgucgaacgcaaucugguuaagcccgaggggaaggugaucgaucugggauguggcagagggggauggagcuacuauugcgcuggccucaaaaaggugaccgaagucaaaggcuacaccaaagggggaccuggccacgaggaacccauuccuauggccacauauggguggaaccuugugaaacugcauuccggaaaggacguguuuuucacacccccugagaaaugugauacccugcucugcgacaucggcgagucuagcccgaaucccacgauugaagaggggagaacccugcgcguucuuaagauggucgaaccuuggcugcggggaaaccaauuuuguaucaagauucucaaucccuacaugccuuccgugguugagacacuggagcagaugcagagaaaacacggcggcaugcuggugcgcaacccccucagcagaaauucuacccacgaaauguacugggucuccugcgggacaggaaacaucgugagcgcugugaauaugaccucuagaaugcugcuuaaccgcuucacgauggcccaucggaagccgaccuaugagagagaugucgaccugggcgcggggacacgccacguugccguggaaccugagguggcuaaccucgauauuaucggacagagaaucgaaaauauuaaacaugagcacaaguccaccuggcauuacgacgaggauaaccccuauaaaacaugggccuaccacggcagcuaugaagucaagcccucuggguccgcuagcuccauggugaauggaguugugaagcugcuuaccaaaccuugggacgucauccccauggugacacaaauugccaugaccgauacgacaccuuuuggccagcagcggguuuucaaggagaaaguggacacccgcaccccgaaggcuaaaagaggcacagcccaaaucauggaagucacggcgcgguggcuguggggguuucucagcagaaacaagaagccccggauuuguacccgcgaggaguucacaagaaaagugcggucuaaugccgcuaucggagccguuuuuguggacgagaaccaguggaauagcgcuaaggaggccgucgaagaugagcgcuucugggaccuggugcagaaagaaagagagcugcacaagcagggcaaaugcgcgaccugcgucuacaacaugauggggaagcgggaaaagaaacucggagaguuuggcaaggcgaaagggucccgcgcuaucugguauauguggcugggcgccagauuccuugaguuugaagcccugggauucaugaaugaggaucauugguucucucgggaaaacagccucuccggcguggagggggagggacugcacaaacuuggcuacauucugcgcgacaucucuaaaauuccugggggaaauauguacgcugaugacacagccggcugggauaccagaaucacagaagacgaucuccaaaacgaggcucggauuaccgacaucauggaacccgagcaugcccugcuggcgacgagcaucuuuaagcucaccuaucagaauaaaguugugcgcguccagagaccugccaagaacgggacagugauggaugugauuucccggcgcgaccagagaggcucuggacaaguuggcaccuacgggcugaauacauucaccaacauggaagcucagcuuauccggcagauggagagcgagggaauuuuucugcccuccgaacucgagacgcagaaccuggccgaaagagugcuugauuggcuggagaaguauggcgucgaacgccucaaacggauggcuaucagcggggacgacugugugguuaagccgauugaugacagauucgccacagcgcugaccgcccugaaugauaugggaaaagugcgcaaggacaucccucaaugggagcccucuaaaggcuggaacgauuggcagcaggucccuuuuugcucccaccacuuccaucagcucaucaugaaggacgggcgggagauugugguccccuguagaaaucaagaugaacuggugggccgcgcucggguuagccagggagccggcuggucucuuagagagacagcuugccuggggaaguccuacgcccagauguggcaacucauguauuuucaccgccgggaccugagacuugcugccaacgcgaucuguagcgccgugccugucgauugggugcccaccucccgcacgaccuggucuauucaugcucaccaucaguggaugacaaccgaagacaugcugagcguuuggaaucggguguggaucgaggaaaacccguggauggaggauaaaacacacgucuccagcuggggagacgugccuuaccucggcaagagagaggaccaguggugcgggucucugauuggacugaccgcccgggccacaugggcuuccaauauccagguggccauuaaccaaguuagacgccucaucggcaaugaaaacuaucuggauuacaugaccagcaugaaacgguucaagaaugagggggaccccgaaggcgcgcuuugguga

SEQ ID NO: 19052 - RNA, 9879 nt, Artificial Sequence
  derived and/or modified CDS sequence (opt5) from DENV-1__GQ199806__SS-prME
agcgugaccaugcugcugaugcugaugcccacagcccuugcuuuccaccugacgaccagaggcggggagccucauaugaucguguccaagcaggaacggggaaaaucucuccuguuuaagacaagcgccggcguuaacaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccagaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccauucuccgcaaacugugcaucgaagcgaagauuuccaauaccacgacagauagcagauguccgacccaaggagaggccacccuuguugaggaacaagacgcuaacuuugugugccggcgcacauucguggauagaggcuggggcaauggguguggacuguuuggcaaagggucucucaucacaugcgccaaguucaagugcgucacaaaacuggagggaaagaucgugcaguacgaaaaccuuaaauauuccguuauugugacgguccacaccggcgaccagcaucaaguggggaaugagagcacagaacacggaaccacagcuaccaucacgccccaggccccuucuaccgagauucagcugacagacuacggcgcccucacccuggauuguagcccccggacaggccuggacuuuaacgaaaugguucuccugaccaugaaggagaaaagcuggcuugugcauaagcagugguuccuggaucucccucugcccuggacguccggggcuucuacaagccaagagaccuggaaucgcaaagaccuucuggucacauuuaagaccgcgcacgccaagaaacaggaagcugugguccucggaucccaggagggcgccaugcacaccgcccugacaggggcuacggaaauccaaaccagcggaacaaccacaauuuucgccggccaucugaagugcagacucaaaauggauaagcugacccuuaaagggaugucuuaugugauguguacgggcuccuucaagcuggagaaggaaguugcggagacacagcacggaaccgugcucguccagaucaaauacgagggcaccgacgcuccgugcaagaucccuuuuagcacacaggaugaaaaaggggugacccaaaacggacggcugauuacagccaaucccaucguuacggacaaggagaaaccugugaacauugaagccgagccgcccuucggcgagucuuauaucgucauuggggcuggagaaaaggcccugaaacuuagcugguuuaaaaagggcuccucuaucgggaaaauguucgaggcuaccgccagaggcgcgcgccggauggccauccucggagauacagcuugggacuuuggcagcauugggggaguguucaccuccgugggcaagcugguucaucagaucuuugggacagccuacggaguccuguucagcggcgugucuuggaccaugaaaauugggaucggcgugcuccugacguggcuuggacucaauuccagaagcaccucucucuccaugacauguauugucgugggccugguuacccuguaccuuggggugaugguccaggcugauagcggaugcgugaucaacuggaagggccgcgaacucaaguguggguccggaauuuuuguuacaaaugaggugcacaccuggacagaacaguauaaauuccaagccgacucuccuaagcggcugagcgcggccaucggcaaggcuugggaggagggggucugcggcaucagauccgccacccgccuggaaaacauuauguggaagcagaucucuaacgagcucaaucauauucugcuugaaaacgacaugaaauuuacggugguugugggagaugucgcuggcauccuggcccaggggaagaaaaugauucggccgcagcccauggaguacaaguauagcuggaaguccuggggaaaagccaagaucaucggcgcugacgugcaaaauacaaccuucauuaucgaugggccuaacacccccgaauguccugacgaucagagagcguggaauauuugggagguggaggacuacggauuuggcaucuucacaaccaacauuuggcucaaacugcgcgauagcuauacgcaggucugcgaccaccggcugaugucugccgcuaucaaggauuccaaagccguucacgccgacaugggcuacuggaucgaaagcgagaagaaugaaacauggaaacuugcuagagccucuuucauugaggugaagaccuguaucuggcccaagucccauacacucuggagcaacggggugcuggaaucugagaugauuaucccgaaaauuuauggaggcccuaucagccagcacaauuaccgccccggguacuuuacccaaacagcgggaccuuggcaucugggcaagcucgagcuggauuucgaccuuugcgaagggaccacggucgugguugaugagcacugcggaaaccggggccccucccugagaaccacaaccgugacaggcaaaaucauucacgaaugguguugccggagcuguacccucccuccccugcgcuuuaagggggaggacggaugcugguauggcauggagaucagaccggucaaggaaaaagaggaaaaucuggugaagucuaugguuuccgcugggagcggagagguggacuccuucucucuuggccuccuguguauuagcaucaugauugaagaggucaugcgguccagauggucucgcaaaaugcugaugacggggacacucgccguguuuuuccugcuuaucaugggacagcugaccuggaacgaucucauucggcugugcaucaugguuggcgccaaugcuagcgacagaaugggcauggggacaaccuaccuggcccuuauggcgaccuuuaagaugcgcccuauguucgcugugggacugcucuuuagacggcugacaucccgcgagguccuccugcuuacgaucggccugucucucguggccagcguggaacugcccaacucccuggaggaacuuggggauggacuggccaugggcauuaugauccucaaacugcucaccgacuuccagagccaucaacugugggcuacacuucugucucucaccuuuauuaagacaaccuucucccugcacuaugccuggaagacgauggcuaugguccugagcaucguuucucuuuuuccccugugucucuccacaaccagccagaaaaccacauggcugccugugcuccuggggucucuuggaugcaagccgcugaccauguuccugauugccgagaauaaaaucuggggcagaaaguccuggccccucaacgaaggcaucauggcgguggggauugucagcauccugcuuuccagccugcucaaaaacgaugugccucuggccggaccccucauugcuggcgggaugcugaucgccuguuacguuauuucuggaagcuccgcugaccuuucucuggagaaggccgccgaggugagcugggaagaggaagcugagcauuccggcgcgucucacaauauccuggucgaagugcaggaugacgggacaaugaaaaucaaggaugaggagcgggacgauacgcucaccauucugcuuaaggccacacugcucgcuguuagcggaguguauccucuguccauccccgccacccucuucgucugguacuuuuggcagaaaaagaaacaacgcucuggcgugcugugggacacaccuuccccucccgaagucgagagagccgugcuugaugacggcauuuaucggaucaugcagcgcgggcugcugggaagaucccagguuggcgugggggucuuccaggaaaacguguuucauaccauguggcacguuacgcggggagcugugcucauguaccaaggcaagcgccuggagcccagcugggccucugucaaaaaggaccuuauuuccuacgggggaggcuggagacugcagggcagcuggaauaccggggaggaaguccaggugaucgcgguugagcccggaaagaacccuaaaaauguccagacagcucccggcaccuucaagacaucugaaggggaggugggagccauugcccucgauuuuaaaccgggcaccuccgggagcccuaucgugaaccgggaaggaaagaucgucggccuguauggcaauggggugguuacaacguccggaaccuacgugucugcuauugcccaagcgaaagcuagccaggacggcccccucccugagaucgaggaugaagucuucagaaagcgcaaccugacaauuauggaccuucaccccggguccggaaagacccggagauaucugcccgccaucgugcgcgaggccauuaaacggaagcugagaacccucauccuggcuccuacacgcguuguggccagcgaaauggcugaggcccuuaaaggcaugccgauccgguaccagacgaccgcggucaagucugaacauacagggaaagagauuguggaucugaugugccacgccaccuuuacaaugagacuccugucccccguucgcgugccuaauuauaacaugaucauuauggacgaggcucauuucaccgaucccagcucuaucgccgcucggggcuacauuagcacgagagucggaaugggcgaagccgccgcuaucuuuaugacagcgaccccucccggguccguggaggccuucccucaaucuaaugcugugauccaggacgaagaacgggauauuccggaacgcagcuggaacuccggauaugaguggaucaccgacuuucccggcaagacagucugguucguuccuucuauuaagagcgggaaugauaucgccaacugucugcgcaagaauggaaagcgggugauucagcucucccgcaaaaccuucgacacagaguaccagaagaccaaaaacaacgacugggauuacguggucacgacagacaucagcgaaaugggcgccaauuuuagagcugaucgggugauugaccccagacgcugccuuaagccuguuauccugaaggaugggcccgagcgggugauccuggccggcccgaugccugucaccguggcgucugcugcccaaagacgcggacggauuggcagaaaccacaauaaagaaggggaccaguauaucuacaugggacagccccucaacaaugaugaggaccaugcccacuggacagaggcuaagaugcugcuugauaacauuaauacccccgaaggcaucauuccugcccuguucgagcccgaacgcgagaaauccgcggccaucgacggggaauaucggcucagaggagaggcucgcaagacguuuguugagcugaugagacggggcgaucugccuguguggcucagcuacaaagucgccuccgaaggguuccaguauucugaccgcagauggugcuuugauggcgagcggaacaaucaagugcuugaagagaacauggacgucgaaaucuggaccaaggagggagagcgcaaaaagcugagaccgcgguggcuggacgcuagaacauacagcgauccccucgcccugcgcgaguucaaggaguuugcugccggccggagauccgugucuggggaccuuauucuggaaaucggaaaacucccucagcaccugacccagcgcgcgcagaaugcccuggauaaccucguuaugcuucauaauagcgagcaaggcgggcgggcuuauagacacgccauggaggaacugcccgacacaauugagacccugaugcuccuggcucuuaucgccgugcugacaggaggcgugacccucuucuuucuguccggccgggggcugggaaagacgagcauuggccuccuuugugucauggccucuuccguucugcuguggauggcuagcguggaaccucauuggaucgcggccucuaucauucucgaguucuuucugauggugcuucugauccccgaaccggaucgccagagaacaccucaggacaaccagcucgcuuacgucgugauugggcugcuguucaugauccucaccguugccgccaaugagaugggacuucuggagaccaccaagaaggaucugggcauugggcacguggcugucgaaaaccaccaucacgccgcgaugcucgacguggaucugcaucccgccuccgcuuggacccuuuacgccgucgcuacaacgaucauuaccccuaugaugcggcacacaaucgagaacaccacagccaauaucagccugaccgcgauugccaaccaagcugccauccucaugggacuggacaaaggcuggcccauuucuaagauggauaucggcgugccucugcucgcucuugggugcuauagccagguuaauccccugacgcugaccgccgcugugcucaugcuggucgcccauuacgcgauuaucggaccgggccuucaggccaaggcuacacgcgaagcccagaaaagaaccgcugccgggaucaugaagaacccuacaguggacggaauuguugccaucgaucuggaccccguggucuaugacgcgaaauuugagaagcagcucggccagauuaugcugcugauccucuguaccucccagauucuucugaugcggacgacaugggcucugugcgaaucuaucacccucgccacagggccccugaccacccuuugggagggaagcccuggcaaauucuggaauacaacgaucgcuguguccauggccaacauuuuccgcggcagcuaccuggccggggcuggacucgccuuuucccugaugaagucucugggcgggggaagacggggcaccggggcgcaaggagagacacucggcgaaaaguggaaacgccagcuuaaucagcugagcaaguccgaguucaacaccuauaaaagaucuggcaucauggaaguggaucggagcgaggccaaggaagggcugaaaagaggagagacaaccaagcacgcuguuucccgcggcacggccaagcuccggugguuugucgagagaaaucuggugaaaccggaagggaaggugauugaccuuggauguggccgcgggggauggucuuacuauugcgcuggccugaaaaaggucacagagguuaaaggcuacaccaaagggggacccggccacgaggaaccuauccccauggccaccuacggguggaaccucgugaaacugaauagcggaaaggauguguucuuuauuccucccgaaaagugugacacacugcucugcgauaucggcgaguccagcccuaacccgaccauugaggaagggcggacacuuagaguccugaaaaugguggagcccuggcugcgcggaaaucaguucuguaucaagauccucaacccuuauaugcccucuguuguggaaacgcuggagcaaaugcagcggaaacauggcggcaugcuugucagaaauccucugucccgcaacagcacccacgagauguacugggugucuugcgggacaggaaauauuguuuccgcggugaacaugaccagccggaugcuccugaacagauuuacaauggcccaucgcaagcccaccuaugaacgggacgucgaucugggcgcugggacgagacacguggccguggagccggaagucgcuaaucucgacaucauuggacagcgcaucgagaacauuaaauacgaacacaagucuaccuggcauuaugaugaggacaauccuuacaagacaugggccuaucacggcuccuacgagguuaaacccagcggguccgcuagcucuauggugaacggaguggucaagcugcuuaccaaacccugggaugugaucccuaugguuacacagaucgccaugaccgacacaacccccuucggccaacagagaguguuuaaggaaaaagucgacacgcggacaccuaaggcgaagcgcggcaccgcccagauuauggaggugaccgcuaaauggcuguggggguuccucagcagaaauaagaaaccgcggaucuguacaagagaagaguuuacgcggaagguucgcuccaacgccgcuauuggagccguguucgucgaugaaaaucaauggaacucugccaaagaggcgguggaggacgaaagauuuugggaucugguucaucgggagcgcgaacuucacaagcagggcaagugcgcuaccugcguguacaauaugauggggaaaagagagaagaaacugggagaguucggcaaggccaaagggagccgggccaucugguauauguggcucggcgcucgcuuccuggaguuugaggcccugggauucaugaacgaagaccauugguuuuccagagaaaauucucucagcggcgucgaaggggagggacugcacaaacuuggcuacauucugcgggauaucuccaaaauccccgggggaaacauguaugcugacgauacagccggcugggacacccgcauuacagaggaugaccuccagaaugaagcgaagaucaccgauauuauggagccugaacacgcccugcuugcuaagucuaucuucaaacugacauaccagaacaagguggucagagugcaacggcccgccaaaaaugggaccguuauggacgugauuagccgcagagaucagcggggcuccggacaggucggcacguaugggcucaacaccuuuacaaacauggaggcucagcugauccgccaaauggaaagcgagggaaucuucucuccuuccgagcuggaaacccccaaucucgccggcagagugcuggacuggcuugagaagcaugggguggaacggcugaaaagaauggcgauuagcggagacgauuguguugugaagccgaucgacgaucgcuuugccacagcucucaccgcccugaacgacaugggcaagguccggaaagauauuccucagugggagcccucuaagggguggaaugacuggcaacaggugccuuucugcucccaccauuuucaccaacuuaucaugaaagauggcagagaaauuguugugcccugucgcaaccaggacgagcuggucggacgggcuagagugagccagggcgccggguggucccuccgcgagacggcuugccugggaaagucuuacgcccagauguggcaacugauguauuuccaccggagagaucuccgccuggcggccaaugcuaucuguagcgccgucccuguggacuggguucccacaucccggaccacauggagcauucaugcccaccaucaguggaugaccacggaagauaugcuuucuguguggaacagagucuggaucgaggaaaauccguggauggaggacaaaacccacaucuccagcugggaagacgugccuuaccugggcaagcgcgaggaucaguggugcgggucucucauuggacugacagcucgggccaccugggcgacaaacauccaaguugcuauuaaucaggugagacggcuuaucggcaacgagaauuaccuggacuauaugaccagcaugaagagauuuaaaaacgaauccgaucccgagggggcccucugguga

SEQ ID NO: 19053 - RNA, 9879 nt, Artificial Sequence
  derived and/or modified CDS sequence (opt5) from DENV-1__GQ199809__SS-prME
agcgugaccaugcugcucaugcugaugcccaccgcccuugcuuuccaccugacgacccggggcggggaaccucauaugaucgugacaaagcaggaacggggaaaaucccuccuguuuaagaccucugccggcguuaacaugugcacccuuauugcgauggaccugggggaacucugugaagauaccaugacauacaaaugcccccgcaucaccgaagcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuauccagaacggacggcugauuacagcuaaucccaucgugacggacaaagagaagccugucaacauugaagccgagccgcccuuuggcgagagcuauaucgugauuggggugggagaaaaagcccuuaagcucucuugguucaagaaaggcagcuccaucgggaagauguuugaggcuaccgccagaggcgcucgccggauggccauccugggagauacagcgugggacuucggcucuauugggggaguuuuuaccagcgucggcaaacuggugcaucagaucuucgggacagccuacggagugcucuuuuccggcgucagcuggaccaugaagauugggaucggcgugcugcuuacguggcugggacucaauucuagauccaccagccugucuaugacauguauugcuguuggccuggugacccuuuaccucggggucauggugcaggccgauuccggaugcguuaucaacuggaaaggccgcgaacugaagugugggagcggaauuuucgugacaaaugagguccacaccuggacagaacaauauaaguuucaggcugacuccccuaaacggcugucugccgcgaucggcaaggccugggaggagggggugugcggcaucagaagcguuacccgccucgaaaacauuauguggaaacagaucuccaacgagcugaaucauauucuucuggaaaacgacaugaaguucacgguggucgugggagauguggucggcauccucgcucaggggaaaaagaugauucggccgcaacccauggagcacaaauacucuuggaaaagcuggggaaaggccaagaucaucggcgcugacguucagaauacaaccuuuauuaucgaugggccuaacacccccgaauguccugacgaucagagagccuggaauauuugggagguggaggacuauggauucggcaucuuuacaaccaacauuuggcugaagcugcgcgauuccuacacgcaggccugcgaccaccggcuuaugagcgcugcgaucaaagauucuaaggccgugcaugcugacaugggcuauuggaucgaauccgagaaaaaugaaacauggaagcucgccagagccagcuucauugaggucaagaccuguaucuggcccaaaucucacacacugugguccaacggggugcuggaaagcgagaugguuauuccgaagaucuacggaggcccuauuucucaacauaauuaucgccccggguacuucacccagacagcuggaccuuggcaccucggcaaacuggagcuugauuuugaccugugcgaagggaccacgguggucguggaugagcacugcggaaaccggggccccagccucagaaccacaaccguuacaggcaagaucauccaugaaugguguugccgguccuguacccugccuccccugcgcuucaaaggggaggacggaugcugguacggcauggagauuagaccggugaaggaaaaggaggaaaaucuugucaaaagcauggugucugccggguccggagagguugacagcuuuucccucggccugcuguguaucucuauuaugaucgaagaggugaugcggagcagauggucccgcaagaugcucaugacggggacacuggcggucuuccuucugcucauuaugggacagcugaccuggaacgaucugauccggcuuugcauuauggugggcgcuaaugccucugacagaaugggcauggggacaaccuaucuggcccucauggcuaccuuuaaaaugcgcccuauguucgccgugggacugcucuuuagacggcugacaagccgcgagguccuucugcucacgaucggccugucccugguugcgucuguggaacuucccaacagccuggaggaacucggggauggacuggcuaugggcaucaugauucucaagcugcuuaccgacuuccaaucccaccagcugugggccacacuccugagccugaccuuuaucaaaacaacccuuucucugcauuacgccuggaagacgauggcuauggugcucuccauugucagccuguucccccucugucugucuacaaccucccagaagaccacauggcuuccugugcugcuggggagccucggaugcaaaccgcugaccauguuucuuaucgccgagaauaagauuuggggcagaaaaucuuggccccugaacgaaggcaucauggcuguugggguggucuccauccuccugagcucccuccugaagaacgaugugccucuugccggaccccugauugcgggcgggaugcugaucgccuguuauguuauuagcggaucuagcgcugaccucucccuggagaaagccgcugaggugucuugggaagaggaagccgagcacagcggcgccucccauaauauccuugucgaagugcaggaugacgggacaaugaagauuaaagaugaggagcgggacgauacgcugaccauccuccugaaggcuacacuccuggcggucucuggaguguacccucuuagcauccccgccacccuguucguuugguauuuuuggcaaaagaaaaagcagcgcuccggcgugcugugggacacaccuucucccccggaagucgagagagcugugcucgaugacggcauuuaccggaucaugcagcgcgggcugcuuggaagaagccagguuggcgugggggucuuccaagaaaacguguuccacaccauguggcacgugacgcggggagccguucugauguaucagggcaaacgccucgagccuuccugggccagcgucaagaaagaccugauuucuuacgggggaggcuggagacuccagggcuccuggaauaccggggaggaaguccaggugaucgcugucgagcccggaaagaacccuaagaaugugcaaacagcccccggcaccuuuaaaacaccggaaggggagguuggagcgauugcucuggauuucaagccuggcaccagcgggucucccaucgugaaccgggaaggaaaaauugucggccuuuacggcaauggggugguuacaacguccggaaccuaugugagcgccaucgcccaggcuaaggccucccaggagggcccucugcccgagaucgaagacgaggucuuuagaaaacgcaaccugacaauuauggaucuccaucccgggucuggaaagacccggagauaccugccugcgaucgugcgcgaagcuauuaagcggaaacuuagaacccugauccucgccccgacacgcguuguggccagcgagauggcugaagcccugaagggcaugcccauucgguaucaaacgaccgcugucaaauccgagcacacagggaaggagaucguggaccugaugugccaugccaccuucacaaugagacuccuuagcccugugcgcguccccaauuacaacaugaucauuauggaugaagcgcacuuuaccgacccuucuuccaucgccgcucggggcuauauuagcacgagaguuggaaugggcgaggccgcugccaucuucaugacagccacacccccugggucuguggaggcuuuuccgcagagcaaugcggugauucaggaugaggaacgggacauccccgagcgcuccuggaacucuggauacgaguggaucaccgauuucccuggcaaaacagucugguuugugcccagcauuaaguccgggaaugacaucgccaacugucugagaaagaauggaaaacggguuauucagcugucucgcaagaccuucgauacagaauaucagaagaccaagaacaacgacugggacuacguggucacgacagauaucagcgagaugggcgcuaauuuuagagccgaccgggugauugauccuagacgcugccucaaacccguuauccugaaggacgggccggaacgggugauucuugccggcccuaugcccgucaccguggcuuccgccgcgcagagacgcggacggaucggcagaaaccauaauaaggagggggaucaguacaucuauaugggacagccccugaacaaugacgaggaucacgcucacuggacagaagccaaaaugcuccuggacaacauuaauaccccugagggcaucauucccgcccuguucgaaccugagcgcgaaaagagcgcugccaucgauggggaguaccggcucagaggagaggcgcgcaaaacguucgucgaacuuaugagacggggcgaccugccgguguggcugucuuauaagguugccuccgagggguuucaauacagcgaucgcagauggugcuucgacggcgaacggaacaaucaggugcucgaggaaaacauggauguggagauuuggaccaaagagggagaacgcaagaaacugagaccccgguggcuugacgcuagaacauauuccgacccucuggcccuccgcgaguuuaaggaguucgcugccggccggagaucugucagcggggaucugauccuggagaucggaaagcucccccagcaucuuacccagcgcgcucaaaaugcccuggacaaccugguuaugcuccacaauuccgaacagggcgggcgggcguacagacaugccauggaggagcugccugauacaauugaaacccuuaugcugcucgcucugaucgccgugcugacaggaggcgugacccucuuuuuccuuucuggccgggggcugggaaaaacgagcauuggccugcucugugucauggcuuccagcgugcugcuuuggauggccucuguugagccccacuggaucgccgcuuccauuauccuggaauuuuuccucauggugcugcugaucccggagccugaccgccagagaacaccccaggauaaccaacucgcguaugucgugauugggcuucuguuuaugauccugaccgucgccgcuaaugagaugggacuccuggaaaccacaaagaaagaccuuggcauugggcacguggccguugagaaccaucaccaugccaccaugcuggauguggaccuccacccugcuagcgccuggacacuguacgcggucgccacgaccaucauuacacccaugaugcggcauaccaucgaaaacacaaccgcuaauauuucucugacggccaucgcuaaccaggccgcgauccucaugggacuugauaagggcuggccuauuuccaaaauggacaucggcgugccccugcuggcccucgggugcuacagccagguuaauccgcugacccuuacagcugccgugcugaugcucgucgcucacuaugccauuaucggaccuggccugcaagcuaaggccacccgcgaggcgcagaagagaacagccgcugggauuaugaaaaaccccaccguggauggaaucguggccaucgaccuggaucccguugucuacgacgcuaaguucgaaaaacagcucggccagauuaugcuucugauccuguguacgucucaaauucuccugaugcggacaaccugggcccuuugcgagagcaucacacuggccaccgggccucucaccacacugugggagggauccccgggcaaguuuuggaauacgaccauugcggugucuauggcuaacaucuuccgcggcagcuaucuggccggggcuggacucgccuuuucccuuaugaaaagccugggcgggggaagacggggcacaggggcccagggagaaacccugggcgagaaguggaagcgccagcucaaucagcuguccaaaucugaguucaacaucuacaagagaagcggcauuauggagguggaccgguccgaagcuaaagaggggcuuaagagaggagagacaacccgccacgccgucucucggggcacggcgaaacugagaugguucguugaacgcaaucucgugaagcccgaggggaaggugaucgaucugggauguggcagagggggauggagcuauuacugcgccggccugaaaaaggucacagaagugaaaggcuauaccaaagggggaccuggccaugaggaacccauuccuauggcuaccuacggguggaaccucguuaaacuucacuccggaaaggacguguuuuucacacccccugagaaaugugauacccugcugugcgacaucggcgagucuagcccgaaucccacaauugaagaggggagaacgcuccgcguccugaagaugguggaaccuuggcuucggggaaaccaauuuuguaucaagauucugaaucccuacaugccuuccguuguggagacccucgagcagaugcagagaaaacauggcggcaugcugguccgcaacccccugagcagaaauucuacacacgaaauguauuggguguccugcgggaccggaaacaucgugagcgccgucaauaugacaucuagaaugcuccugaaccgcuucaccauggcucaccggaagccgacguacgagagagauguugaccuuggcgccgggacccgccauguggcgguggaaccugaggucgccaaccuggauaucauuggacagagaaucgaaaauauuaaacacgagcauaaguccacauggcacuaugacgaggauaaccccuacaaaaccugggcuuaucauggcagcuacgaagugaagcccucuggguccgccagcuccaugguuaauggaguggucaagcuccugacaaaaccuugggacgugauccccaugguuacccaaauugcuaugacagauaccacgccuuuuggccagcagcggguguucaaggagaaagucgacacacgcaccccgaaggccaaaagaggcaccgcucaaaucauggaagugacagcccgguggcuuuggggguuucugagcagaaacaagaagccccggaucuguacgcgcgaggaguucaccagaaaaguucggucuaaugcggccauuggagcuguguuugucgacgagaaccaguggaauagcgccaaggaggcuguggaagaugagcgcuucugggaccucguccagaaagaaagagagcugcacaagcagggcaaaugcgccacaugcguguauaacaugauggggaagcgggaaaagaaacugggagaguuuggcaaggccaaagggucccgcgcgaucugguacauguggcucggcgcuagauuccuggaguuugaagcccuuggauucaugaaugaggaucacugguucucucgggaaaacagccuguccggcguugagggggagggacuccauaagcugggcuacauucuucgcgacaucucuaaaauuccugggggaaauauguaugccgaugacaccgcuggcugggauacaagaaucaccgaagacgaucugcaaaacgaggccaagaucacagacauuauggaacccgagcacgcucuccuggccaccagcaucuuuaaacugacguaccagaauaaggugguccgggugcagcgcccugcgaagaacgggaccgugauggauguuauuuccagacgggaccagcgcggcucuggacaagugggcacauaugggcucaauaccuucacaaacauggaagcccagcugaucagacagauggagagcgagggaauuuuucuucccuccgaacuggagaccccgaaccucgcugaacggguccuggauuggcuugagaaacauggcguggaaagacugaagcgcauggccaucagcggggacgacuguguugugaaaccuaucgaugaccgguucgcuacggcccucacagcgcugaaugauaugggaaaggucagaaaagacauuccccagugggagccuucuaagggcuggaacgauuggcaacaggugcccuuuugcucccaccacuuccaucagcugaucaugaaggacgggcgcgagauugucgugccuugucggaaucaggaugaacucguuggcagagcccgcgugagccaaggagcuggcuggucucugcgggagaccgccugccuugggaaauccuacgcucagauguggcagcugauguauuuucacagacgcgaccuccggcuggccgcuaacgccaauuguagcgcgguccccguggauuggguuccgacauccagaaccacguggucuauccaugcccaccaucaauggaugaccacagaagacaugcuuagcguguggaaccgcgucuggauugaggaaaauccuuggauggaggauaagacccacguguccagcuggggagacgugcccuaccugggcaaacgggaggaccaguggugcgggucucucaucggacugacagcuagagccaccugggccuccaacauucagguugcuaucaaucagguccggagacugaucggcaacgaaaauuaucucgauuacaugacaagcaugaagcgcuucaaaaacgagggggaccccgaaggcgcccugugguga

SEQ ID NO: 19054 - RNA, 9879 nt, Artificial Sequence
  derived and/or modified CDS sequence (opt5) from DENV-1__GQ199810__SS-prME
uccgugaccaugcugcucaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugccauggaccugggggaacucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuuccugacacaagaugaaaagggggugacgcagaacggacggcuuaucaccgcgaaucccauugucacagacaaagagaagccugugaacaucgaagcugagccgcccuuuggcgaguccuauauuaucauuggggccggagaaaaagcccucaagcugagcugguucaagaaaggcucuagcaucgggaagauguuugaggcuaccgccagaggcgcucgccggauggccauccugggagauacagcgugggacuucggcuccauugggggaguguuuaccucuguuggcaaacucguccaucagaucuucgggacggccuacggagugcuguuuagcggcguguccuggaccaugaagauugggaucggcguccuucugacauggcucggacugaauagcagaucuaccucccugagcaugacauguauugcugugggccuuguuacccucuaccugggggugaugguccaggccgauucuggaugcgugaucaacuggaaaggccgcgaacugaaguguggguccggaauuuucguuacaaaugaggugcacaccuggacggaacaauauaaguuucaggcugacagcccuaaacggcucuccgccgcgaucggcaaggccugggaggagggggucugcggcaucagaucugcuacacgccuggaaaacauuauguggaaacagaucagcaacgagcuuaaucauauucugcucgaaaacgacaugaaguucaccgugguugugggagaugucgccggcauccuggcucaggggaaaaagaugauucggccgcaacccauggaguacaaauauuccuggaagucuuggggaaaggccaaaaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaaacuucgcgauagccacacccaggucugcgaccaccggcucauguccgcggccaucaaagauagcaaggcuguucaugccgacaugggcuauuggaucgaaucugagaaaaaugaaacauggaagcuggccagagcuuccuucauugaggugaagaccuguaucuggcccaaaagccacacacuguggucuaacggggugcucgaauccgagaugauuaucccgaagauuuacggaggcccuaucagccaacauaauuaucgccccggguacuucacccagacggccggaccuuggcaccugggcaaacuugagcuggauuuugaccucugcgaagggaccacagucgugguugaugagcacugcggaaaccggggccccucucugagaaccacaaccgugacgggcaagaucauucaugaaugguguugccggagcuguacacugccuccccuucgcuucagaggggaggacggaugcugguacggcauggagauccggccggucaaagaaaaggaggaaaaucucgugaaguccaugguuagcgcggggucuggagagguggacuccuuuagccugggccugcucuguauuuccaucaugauugaagaggucaugagaucucgcuggagccggaaaaugcugaugaccgggacacuugcuguguucuuucugcucaucaugggacagcugaccuggaacgaucugauuagacuuugcaucaugguuggcgccaaugccuccgaccgcaugggcauggggaccacauaucuggcucucauggccacguucaagaugagaccuauguuugcggugggacuccuguuccggcgccugaccucuagagagguccuucugcucacaaucggccugagccugguggcuuccguggaacuucccaacucucuggaggaacucggggauggacuggccaugggcauuaugauccucaaacugcuuaccgacuuucaaagccaccagcugugggccacacuccugucccugaccuucauuaagacgacauuuagccuucauuacgcuuggaaaaccauggccaugguccugucuaucguuucccucuucccccugugucucagcaccacaucucagaagaccacauggcugccugugcuucuggggucccugggaugcaagccgcucacgauguuucugauugcugagaauaaaaucuggggccggcgcagcuggccccuuaacgaaggcaucauggccguggggauugucucuauccugcucuccagccugcucaagaacgaugugccucuggcgggaccccuuauugccggcgggaugcugaucgcuuguuauguuauuuccggaagcucugccgaccugagccucgagaaagcugccgagguguccugggaagaggaagucgagcacucuggcgccagccauaauauccugguggaaguucaggaugacgggaccaugaagaucaaagaugaggagagagacgauacacuuaccauucugcucaaggcuacacugcucgcgguguccggagucuacccucugucuauccccgccacccuuuucgugugguauuucuggcagaagaagaagcagcggagcggcguccugugggacacgccuagcccucccgaaguggagcgcgcuguucuggaugacggcauuuacagaaucaugcagcgggggcuccugggacgcucucaggugggcgucgggguguuucaagaaaacguuuuccacaccauguggcacgugacaagaggagccguccuuauguaucagggcaaacggcuggagcccagcugggccuccgugaagaaagaccucauuagcuacgggggaggcuggagacugcagggcucuuggaauaccggggaggaagugcagguuaucgcugucgagcccggaaagaacccuaaaaaugugcaaacagcccccggcaccuuuaagacaccggaaggggaggugggagcgauugcucucgauuucaagccuggcacguccgggagccccaucgucaaccgcgaaggaaaaaucgugggccuguacggcaaugggguugugaccacaucuggaaccuaugucuccgccauugcccaggcuaaggccagccaggagggcccucuucccgagaucgaagacgagguguuucggaaaagaaaccugaccauuauggaucugcaucccggguccggaaagacacgccgguaccucccugcgaucguuagagaagcuauuaaacgcaagcugcggacgcuuauccuggccccgaccagaguggucgccucugagauggcugaagcccucaagggcaugcccauccgcuaucaaacaaccgcugugaaaagcgagcacacagggaaggagauuguugaccugaugugccaugccaccuucacgaugcggcugcucuccccugugagaguccccaauuacaacaugaucauuauggaugaagcgcacuuuacagacccuagcucuaucgccgcucggggcuauauuuccacccgcgugggaaugggcgaggccgcugccaucuucaugaccgccacacccccugggagcguggaggcuuuuccgcagucuaaugcggucauccaggaugaggaaagagacauucccgagcggagcuggaacuccggauacgaguggaucaccgauuucccuggcaaaacaguuugguuugugcccucuauuaagagcgggaaugacaucgccaacugucuucgcaaaaauggaaagagagugauucagcugucccggaagaccuucgauacggaauaucagaagaccaagaacaacgacugggacuacgucgugaccacagauaucucugagaugggcgcuaauuucagagccgaccgcguuauugauccucggagaugccugaaacccgugauccucaaggacgggccggaacgcgucauccuggccggcccuaugcccgugaccguugcuagcgccgcgcagcggagaggacgcauuggccggaaccauaauaaagagggggaucaguacaucuauaugggacagccccuuaacaaugacgaggaucacgcucacuggacggaagccaagaugcugcucgacaacauuaauaccccugagggcaucauucccgcccuguuugaaccugagagagaaaaguccgcugccaucgauggggaguaccgccugagaggagaggcgcggaaaacauucguggaacucaugcgcagaggcgaccuuccggucuggcugagcuauaagguggccucugagggguuucaauacuccgaucggcgcuggugcuucgacggcgaaagaaacaaucagguccuggaggaaaacauggauguggagaucuggaccaaagagggagaacggaagaaacucagaccccgcuggcuggacgcucggacauauagcgacccucuugcccugagagaguuuaaggaguucgcugccggccgccgguccguuucuggggaucucauucuggagaucggaaaacugccccagcaucucacccagagagcucaaaaugcccuugacaaccuggugaugcugcacaauagcgaacagggcgggcgggcguaccgccaugccauggaggagcucccugauacaauugaaacccugaugcuucuggcucucaucgccgugcugacgggaggcgucacacuguuuuuccucuccggcagagggcuuggaaagaccucuauuggccugcuguguguuauggcuagcuccgugcuccuguggauggccagcguggagccccacuggaucgccgcuucuaucauucuugaauuuuuccugaugguccuccugaucccggagccugaccggcagcgcacaccccaggauaaccaacuggcguaugugguuauugggcuccuuuuuaugauccugacaguggccgcuaaugagaugggacugcucgaaaccacaaagaaagaccugggcauugggcacgucgccguggagaaccaucaccaugccgcuaugcuugaugucgaccugcacccugccuccgcguggacgcucuacgccguggcuaccacaaucauuacccccaugaugagacauacaaucgaaaacaccacggccaauaucagccugaccgcuauugccaaccaggcggccauccugaugggacucgauaagggcuggccuauuucuaaaauggacaucggcguuccccuucuggcucuggggugcuacucccaggugaauccgcucacacugaccgccgcuguccuuaugcugguggcccacuaugcuauuaucggaccuggccuccaagccaaggcgacacgggaggcccagaaacgcaccgcugccgggaucaugaagaaccccacgguugauggaauuguggcuaucgaccuggaucccgucguguacgacgccaaguucgaaaaacagcugggccagauuaugcuccuuauccuguguacaagccaaauucugcucaugagaaccacaugggcccugugcgagucuaucacccuugcgaccgggccucugacaacgcucugggagggaagcccgggcaaguuuuggaauaccacaaucgcuguguccauggccaacauuuuccggggcucuuaucuggcuggggccggacuggccuucagccucaugaaaucccuuggcgggggacgcagaggcaccggggcucagggagaaacacugggcgagaaguggaaacggcagcugaaucagcucagcaaguccgaauuuaacaccuacaagagaucuggcaucauggagguugaccgcagcgaagccaaagaggggcugaagcggggagagacgacaaaacacgcggucuccagaggcaccgccaaacuucgcugguucguggaacggaaucuggugaaacccgaggggaaggucauugaucucggauguggcagagggggauggucuuauuacugcgcuggccugaagaaaguuaccgaagugaagggcuauacaaaagggggaccuggccaugaggaacccaucccuauggccaccuacggguggaaccuggugaagcuccacagcggaaaagacgucuuuuucauucccccugagaagugugauacacuucugugcgacaucggcgaguccucuccgaaucccacgauugaagaggggcgcacccugcgggugcucaaaaugguugaaccuuggcugagaggaaaccaauuuuguaucaagauccuuaaucccuacaugccuagcguggucgagacacuggagcagaugcagcgcaagcauggcggcaugcucgugcggaacccccuguccagaaauagcacccacgaaauguauuggguuucuugcgggacaggaaacauuguguccgcugucaauaugaccagccgcaugcugcucaaccgguucacgauggcccacagaaaaccgaccuacgagcgcgauguggaccugggcgcggggacaagacauguggccgucgaaccugagaucgcuaaccuugauauuaucggacagcggauugaaaauaucaagcacgagcauaaaucuaccuggcacuaugacgaggauaaccccuacaagacaugggccuaucauggcuccuacgaaguuaaacccagcgggucugcuuccagcauggugaauggaguggucaagcugcucaccaagccuugggacgugauccccaugguuacacaaauugccaugaccgauacgacaccuuuuggccagcagcgcguguucaaagagaaggucgacaccagaaccccgaaagcuaagcggggcacagcccaaaucauggaagugacggcgaaauggcuguggggguuucuuuccagaaacaagaagccccggauuuguacccgcgaggaguucacaagaaaaguucggagcaaugccgcuaucggagccguguuugucgacgagaaccaguggaacucugcuaaggaggccguggaagaugagcgcuucugggaccugguucacagagaacgggagcuccacaaacagggcaagugcgcgaccugcguguauaacaugauggggaaacgcgaaaagaagcugggagaguuuggcaaagcgaaggggagcagagcuauuugguacauguggcugggcgcccgguuccucgaguucgaagcccugggauuuaugaaugaggaucauugguucucccgcgaaaacucucuuagcggcgucgagggggagggacugcacaaacucggcuacauccugagagacaucuccaagauuccugggggaaauauguaugcugaugacacagccggcugggauacccggaucacagaagacgaucuucagaacgaggcucgcauuaccgacaucauggaacccgagcaugcccugcucgcgaaaucuauuuuuaagcugacguaccaaaauaaaguggucagagugcagcggccugccaagaacgggaccguuauggaugugaucagccgcagagaccagcggggcuccggacaggucggcacauaugggcugaauaccuucacaaacauggaagcucaacucaucagacagauggagucugagggaauuuuuagccccuccgaacuggagaccccgaaccuugccgaacgcgugcuggauuggcucgagaaguacggcguggaacggcugaaaagaauggcuaucagcggggacgacuguguugugaagccuauugaugaccgcuucgccacggcgcuuacagcccugaaugauaugggaaaaguccggaaggacaucccccagugggagccuucuaaaggcuggaacgauuggcagcaagugcccuuuugcucccaccacuuccaucagcucauuaugaaggacgggagagagaucguugugccuugucgcaaucaggaugaacuggucggccgggcuagagugagccagggagccggcuggucucugcgcgagaccgcuugccucgggaaguccuaugcccaaauguggcagcugauguacuuucaccggagagaccuucgccuggcugccaacgcgauuuguagcgccguccccguggauuggaucccgacaucccggaccacguggucuauccaugcucaccaucaguggaugaccacagaagacaugcucagcguuuggaauagaguguggauugaggaaaacccuuggauggaggauaaaacccacaucuccagcuggggagacguccccuaucugggcaagcgggaggaccaauggugcgggucucuuauuggacugacagccagagccaccugggcuacaaauauccagguggccauuaaccagguucgccggcucaucggcaaugaaaacuaccuggauuacaugaccuccaugaaaagauucaagaaugagggggaccccgaaggcgcgcugugguga

SEQ ID NO: 19055 - RNA, 9879 nt, Artificial Sequence
  derived and/or modified CDS sequence (opt5) from DENV-1__GQ199811__SS-prME
agcgugacaaugcugcugaugcugaugcccacagcccuugcuuuccaccugacgacccggggaggggagccucauaugauugucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaggaacaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaauuacauccugcuugaaaacgacaugaagcugacgguuguggucggagauguggcuggcauucucgcccaggggaaaaagaugauccggccgcaacccauggaguauaaauacagcuggaaguccuggggaaaggccaaaauuaucggcgcugacgugcagaauacaaccuuuaucauugaugggccuaacacccccgaauguccugacgaucagagagcguggaauaucugggaggucgaggacuauggauucggcauuuuuacaaccaacaucuggcugaagcugcgcgauagcuacacgcagguuugcgaccaucggcuuaugucugccgcuauuaaagauuccaaggccgugcacgccgacaugggcuauuggaucgaaagcgagaaaaaugaaacauggaagcucgcuagagccucuuucaucgaggugaagaccuguauuuggcccaaaucccacacacuguggagcaacgggguccuggaaucugagaugaucauuccgaagaucuacggaggcccuauuagccaacauaauuaccgccccggguauuucacccagacagcgggaccuuggcaccucggcaaacuggagcuugauuuugaccugugcgaagggaccacggugguuguggaugagcauugcggaaaccggggccccucccucagaaccacaaccgucacaggcaagaucauccacgaaugguguugccggagcuguacccugccuccccugcgcuucaaaggggaggacggaugcugguacggcauggagauuagaccggugaaggaaaaggaggaaaaucuuguuaaaucuaugguguccgcugggagcggagaggucgacuccuuuucucucggccugcuguguaucagcauuaugaucgaagaggugaugcgguccagauggucucgcaagaugcucaugacggggacacuggccguuuucuuucuucugauuaugggacagcucaccuggaacgaucugauccggcugugcauuauggugggcgccaaugcuagcgacagaaugggcauggggacaaccuaucuugcccugauggcgaccuucaaaaugcgcccuauguuugcugucggacuccuguucagacggcucacaucccgcgaggugcugcuucugacgaucggccucucucugguggccagcgucgaacugcccaacucccuugaggaacugggggauggacucgccaugggcaucaugauucugaagcuccugaccgacuuucaaagccaccagcuuugggcuacacugcucucucugaccuucguuagaacaaccuuuucccugcauuacgccuggaaaacgauggcuauggugcuuagcaucgugucucuguucccccucugucuguccacaaccagccagaagaccacauggcucccuguccugcuugggucucugggaugcaagccgcugaccauguuucucauugccgagaauaaaaucuggggccggaaguccuggccccugaacgaaggcauuauggcgguggggaucguuagcauccuucuguccagccuccugaaaaacgaugugccucucgccggaccccugauugcuggcgggaugcuuaucgccuguuaugucauuucuggaagcuccgcugaccugucucuggagaaggccgccgugguuagcugggaggaagaggcugaacacuccggcgcgucucauaauauccucguggagguccaggaugacgggacaaugaaaauuaaggaugaagaaagagacgauacgcugaccauccuucugaaagccacacuccuggcugugagcggagucuacccucucuccauccccgccacccuguucgugugguauuucuggcaaaagaagaaacagagaucuggcguucuuugggacacaccuuccccucccgagguggaacgggccguccuggaugacggcauuuaccgcaucaugcagagagggcugcucggacggucccaggugggcguugggguguuucaagagaacgucuuccacaccauguggcaugugacgcgcggagcugugcugauguaccagggcaagagacuugaacccagcugggccucuguuaaaaaggaccugauuuccuaugggggaggcuggcggcuccagggcagcuggaauaccggggaggagguccaggugaucgcgguggaacccggcaagaauccuaagaauguccaaacagcucccggcaccuuuaagacaucugagggggaagugggagccauugcccuggauuucaaaccgggcaccuccgggagcccuaucguuaacagagagggaaagauugugggccucuacggcaauggggucgugacaacguccggaaccuauguuucugcuaucgcccaggcgaaagcuagccaggaaggcccccugccugagaucgaggacgaaguguuucgcaagcggaaccuuacaauuauggaucugcaccccggguccggaaaaaccagacgcuaccugcccgccaucguccgggaggccauuaagagaaagcuccgcacccugauccuugcuccuacacgggugguugccagcgaaauggcugaggcccugaaaggcaugccgauuagauaucaaacgaccgcggugaagucugaacacacagggaaagagaucgucgaccucaugugccaugccaccuucacaaugcgccugcugucccccgugcgggugccuaauuacaacaugaucauuauggaugaggcucacuuuaccgaccccagcucuaucgccgcuagaggcuauauuagcacgcgggucggaaugggcgaagccgccgcuaucuucaugacagcgaccccucccggguccguugaggccuuuccucagucuaaugcugugauucaggaugaggaacgcgacaucccggaaagaagcuggaacuccggauacgaguggaucaccgauuuccccggcaagacagugugguuugucccuucuauuaaaagcgggaaugacaucgccaacugucuccggaagaauggaaagcgcgugauucagcuuuccagaaaaaccuucgauacagaguaccaaaagaccaaaaacaacgacugggacuauguugugacgacagauaucagcgaaaugggcgccaauuuccgggcugacagagucauugauccccgccggugccugaagccugugauccugaaagacgggcccgagagaguuauucucgccggcccgaugccugugaccgucgcgucugcugcccagcgccggggaagaaucggccgcaaccauaauaaggaaggggaucaguacaucuauaugggacagccccugaacaaugacgaggaucacgcccauuggacagaggcuaagaugcuucuggacaacauuaauacccccgaaggcaucauuccugcccucuuugagcccgaacgggagaaauccgcggccaucgauggggaauacagacugcgcggagaggcuagaaagacguucguggagcugaugcggcgcggcgaccucccugucuggcuuagcuauaaaguggccuccgaaggguuucaauacucugauagacgguggugcuucgacggcgagcgcaacaaucagguucuggaagagaacauggauguggaaauuuggaccaaggagggagagcgcaagaagcugcggccgagauggcucgacgcucgcacauauagcgacccccuggcccuucgggaauuuaaagaguucgcugccggcagacgcuccgugucuggggaucugauccucgaaaucggaaagcugccucagcaccugacccagcgggcgcaaaaugcccucgacaaccuugucaugcugcacaauagcgagcagggcgggagagcuuaccggcaugccauggaggaacugcccgauacaauugagacccucaugcugcuugcucugaucgccguucucacaggaggcgugacccuguuuuuccuguccggccgcgggcucggaaagacgagcauuggccuucugugugugauggccucuuccguccugcucuggauggcuagcguggaaccucacuggaucgcggccucuauuauccuggaguuuuuccuuaugguucugcucauccccgaaccggacagacagcggacaccucaggauaaccaacuggcuuacguggucauugggcugcucuuuaugauccuuaccguggccgccaaugagaugggacugcuggagaccaccaagaaggaccucggcauugggcaugucgcuguggaaaaccaccaccaugccgcgaugcuggauguugaccuucaccccgccuccgcuuggacccuguaugccguggcuacaacgaucauuaccccuaugaugcgccauacaaucgagaacaccacagccaauauuagccucaccgcgaucgccaaccaggcugccauccugaugggacuggauaaaggcuggcccauuucuaagauggacaucggcgucccucuccuugcucuggggugcuacagccaggugaauccccugacgcucaccgccgcuguucugaugcuuguggcccacuaugcgauuaucggaccgggccugcaagccaaagcuacaagagaagcccagaagcggaccgcugccgggauuaugaagaacccuacagucgauggaaucguggccaucgaccucgaucccgugguuuacgacgcgaaauucgagaagcagcugggccagauuaugcugcucauccuuuguaccucccaaauucugcugaugcgcacgacaugggcucucugcgaaucuaucacccuggccacagggccccuuaccacccugugggagggaagcccuggcaaauuuuggaauacaacgauugcugucuccauggccaacaucuucagaggcagcuaucucgccggggcuggacuggccuucucccugaugaagucucucggcgggggacggcgcggcaccggggcgcagggagagacacuuggcgaaaaauggaagagacagcugaaucagcugagcaaguccgaguuuaacaccuacaaacggucuggcaucauggaaguggacagaagcgaggccaaggaagggcucaaacgcggagagacaaccaagcaugcugugucccggggcacggccaaacugagaugguucgucgagcgcaaucuuguuaagccggaagggaaggugauugaucugggauguggcagagggggauggucuuauuacugcgcuggccucaaaaaggugacagaggucaaaggcuacaccaaagggggacccggccacgaggagccuauccccauggccaccuauggguggaaccuggugaaacugcacagcggaaaggacgucuuuuucauuccucccgaaaaaugugauacacuccuuugcgacaucggcgaguccagcccuaauccgaccauugaggaagggagaacacugcgcgugcugaagauggucgagcccuggcuccggggaaaccaauuuuguaucaagauucugaauccuuacaugcccucugugguugaaacgcuugagcagaugcagagaaaacauggcggcaugcuggugcgcaacccucucucccggaauagcacccacgagauguauugggucucuugcgggacaggaaacaucguguccgcggugaauaugaccagcagaaugcugcugaaccgcuucacaauggcccaucggaagcccaccuacgaaagagaugucgaccucggcgcugggacgcgccacguugccguggagccggaaguggcuaaccuggauaucauuggacagagaaucgagaauauuaaacacgaacauaagucuaccuggcacuaugacgaggauaacccuuacaaaacaugggccuaucauggcuccuacgaggucaagcccagcggguccgcuagcucuauggugaauggaguugugaaacuucugaccaaacccugggacgucaucccuauggugacacaaauugccaugaccgauacaacccccuuuggccagcagcggguuuucaaggaaaaaguggacacgcgcacaccuaaggcgaaaagaggcaccgcccaaaucauggaggucaccgcuaaguggcucuggggguuucugagccggaacaagaaaccgagaaucuguacacgggaagaguucacgcgcaaggugagauccaaugccgcuauuggagccguuuuuguggacgaaaaccaguggaacucugccaaagaggcggucgaggaugaacgguucugggaccuugugcaccgcgagagagaacugcauaagcagggcaaaugcgcuaccugcgucuacaacaugauggggaagcgggagaagaaacucggagaauuuggcaaggccaaagggagccgcgccaucugguauauguggcugggcgcuagauuccuggaguucgaggcccucggauuuaugaaugaagaucacugguucucccgggagaacucucugagcggcguggaaggggagggacuucacaagcugggcuacauucuccgcgacaucuccaaaauucccgggggaaauauguaugcugaugacacagccggcugggauaccagaaucacagaggacgaucugcagaacgaagcgaagaucaccgacauuauggagccugaacaugcccuucuggcuaaaucuaucuuuaagcucacauaccaaaauaagguugugcggguccagcgccccgccaaaaacgggaccgugauggaugugauuagcagacgggaccagcgcggcuccggacagguuggcacguaugggcugaauaccuucacaaacauggaggcucaacugaucagacagauggaaagcgagggaaucuuuucuccuuccgagcucgaaacccccaaccuggccggccgggugcuugauuggcuggagaagcacggggucgaaagacucaaacgcauggcgaucagcggagacgacugugugguuaagccgaucgaugaccgguucgccacagcucugaccgcccuuaaugauaugggcaaagugagaaaggacauuccucagugggagcccucuaagggguggaacgauuggcagcaagucccuuuuugcucccaucacuuccaccagcugaucaugaaagacggccgcgaaauugugguccccugucggaaucaggaugagcucgugggcagagcucgcguuagccagggagccggguggucccugcgggagacggcuugccugggaaagucuuacgcccaaauguggcagcucauguauuuucauagacgcgaccugcggcuugcggccaacgcuaucuguagcgccgugccugucgauugggugcccacauccagaaccacauggagcauucacgcccaucaccaguggaugaccacggaagacaugcugucuguuuggaaucgcguguggaucgaggaaaacccguggauggaggauaaaacccauauuuccagcuggggcgacgucccuuaccucgggaagcgggaagaccaauggugcggaucucugaucggccuuacagcuagagccaccugggcgacaaauauccagguggcuauuaaccaggugcggagacugcucgggaaugagaacuaccuggauuauaugaccagcaugaaacgcuucaagaaugaguccgaccccgaaggcgcccugugguga

SEQ ID NO: 19056 - RNA, 9879 nt, Artificial Sequence
  derived and/or modified CDS sequence (opt5) from DENV-1__FJ882549__SS-prME
agcgugaccaugcugcucaugcugaugcccacggcccuugcuuuccaccugacgaccagaggcggggaaccucauaugaucgucuccaagcaggaacggggaaagucucuccuguuuaagaccagcgccggcguuaauaugugcacccuuaucgcgauggaccugggggaacucugugaagauacaaugaccuacaagugcccgagaaucacagagguggaacccgacgauguggacuguuggugcaauaccacggauaccugggucacauauggaaccuguucccaaacaggcgagcaccggcgggacaagcgcucuguggcucuggccccucauguugggcugggacucgagaccagagccgaaacguggaugagcuccgagggcgcuuggaagcagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaggauaagcccacacuggacaucgaacugcucaaaaccgagguuacaaacccugcugugcugcggaaacuuugcauugaagccaaaaucuccaauaccacgacagauagccgcuguccgacccaaggagaggcgacccugguggaagaacaggacgccaacuucgucugcagacggacauuuguggaucgcggcuggggcaauggguguggacucuucggcaaggggucucugauuaccugcgcuaaguuuaaaugcguuacaaaacuugagggaaaaaucgugcaguacgaaaaccugaaguauuccgucaucgugacgguucacaccggcgaccagcaucaaguggggaaugagagcacagaacacggaaccacagccaccauuacgccccaggcuccuaccucugagauccagcucacagacuacggcgcccugacccuggauuguucccccagaacaggccucgacuucaacgaaaugguccugcuuaccaugaaagaaaaguccuggcuggugcauaaacagugguuucucgaucugccucuucccuggacguccggggccucuacaagccaagagaccuggaaucggcaggaccugcucgucacauucaagaccgcucacgcgaagaaacaggaagugguugugcugggaucccaagagggcgccaugcacaccgcucugacaggggccacggaaauucagaccagcggaacaaccacaaucuuugccggccaucucaagugccgccugaaaauggauaaacuuacccugaaagggaugucuuaugucauguguacgggcuccuucaagcucgagaaggaaguggcugagacacagcacggaaccguucuggugcagauuaaauacgagggcaccgacgccccgugcaagaucccuuucagcacacaagaugaaaaaggggucacccagaacggaagacugaucacagcgaaucccauugugacggacaaggagaaaccugugaacaucgaagcugagccgcccuuuggcgagucuuauauuguuaucggggccggagaaaaggcccuuaagcucagcugguucaaaaagggcuccucuauugggaaaauguuugaggcuaccgcccggggcgcuagacgcauggccauccugggagauacagcgugggacuucggcagcaucgggggagucuuuaccuccgugggcaagcuggugcaucagauuuucgggacagccuacggaguccucuuuagcggcgugucuuggaccaugaaaaucgggauuggcguucugcuuacguggcugggacucaauucccggagcaccucucuguccaugacauguaucgcugugggccuggucacccuuuaccucggggugaugguucaggccgauagcggaugcgugauuaacuggaagggcagagaacugaaguguggguccggaaucuucgucacaaaugaggugcacaccuggacagaacaauauaaauuucaggcugacucuccuaagcgccugagcgccgcgauuggcaaagccugggaggaggggguuugcggcauccgguccgcuaccagacucgaaaacaucauguggcgccagauuucuaacgagcugaaucauauccuucuggaaaacgacaugaaguucacgguggucgugggagauguggucggcauucucgcccaggggaaaaagaugauccggccgcaacccauggagcacaaauacagcuggaaguccuggggaaaggcuaaaauuaucggcgccgacguucagaauacaaccuuuaucauugaugggccuaacacccccgaauguccugacgaucagagagccuggaauaucugggagguggaggacuauggauucggcauuuuuacaaccaacaucuggcugaagcugcgcgauagcuacacacaggugugcgaccaccggcuuaugucugcugcgauuaaagauuccaaggccguccaugcugacaugggcuauuggaucgaaagcgagaaaaaugaaacauggaagcucgccagagccucuuucaucgaggugaagaccuguauuuggcccaaaucccacacacuguggagcaacgggguucuggaaucugagaugaucauuccgaagaucuacggaggcccuauuagccaacauaauuaucgccccggguacuucacccagacagcuggaccuuggcaccucggcaaacuggagcuugauuuugaccugugcgaagggaccacgguggucguggaugagcacugcggaaaccggggccccucccucagaaccacaaccguuacaggcaagaucauccaugaaugguguugccggagcuguacccugccuccccugcgcuucaaaggggaggacggaugcugguacggcauggagauuagaccggugaaggaaaaggaggaaaaucuugucaaaucuaugguguccgccgggagcggagagguugacuccuuuucucucggccugcuguguaucagcauuaugaucgaagaggugaugcgguccagauggucucgcaagaugcucaugacggggacacuggcggucuucuuucuucugauuaugggacagcucaccuggaacgaucugauccggagcugcauuauggugggcgcuaaugccuccgacagaaugggcauggggacaaccuaucuggcccuuauggcuaccuucaaaaugcgcccuauguuugccgugggacuccuguucagacggcugacaucucgcgagguccuccugcuuacgaucggccugagccucguugcguccguggaacugcccaacagccuggaggaacuuggggauggacuggcuaugggcaucaugauucucaagcugcucaccgacuuucaaucuuaccagcugugggccacacuucugucccucaccuucaucaaaacaaccuuuagccugcacuaugccuggaagacgauggcuauggugcugucuauugucucccuucugccccucugucugagcacaaccucucagaagaccacauggcucccugugcugcuugggucccugggaugcaaaccgcugaccauguuccucaucgccgagaauaagauuuggggcagaaaaagcuggccccugaacgaaggcaucauggcuguugggaucguguccauucuucugagcucucuccugaagaacgaugucccucucgccggaccccugaucgcgggcgggaugcuuauugccuguuacgugaucagcggauccucugcugaccugagccuggagaaagccgcugagguuuccugggaagaggaagccgagcauucuggcgccagccacaauauucucguggaaguccaggaugacgggacaaugaagaucaaagaugaggagcgggacgauacgcugaccauccuucugaaggcuacacuccuggcgguguccggagucuauccucucucuauucccgccacccuguuugugugguacuucuggcaaaagaaaaagcagcgcagcggcguucuuugggacacaccuagcccucccgaaguggagagagcuguccuggaugacggcaucuaucggauuaugcagcgcgggcugcucggaagaagccaggugggcguugggguguuccaagaaaacgucuuucauaccauguggcacgugacgcggggagccgugcugauguaccagggcaaacgccuugagcccucuugggccuccguuaagaaagaccugaucagcuacgggggaggcuggagacuccagggcucuuggaauaccggggaggaaguccaggugauugcuguggagcccggaaagaacccuaagaauguccaaacagcccccggcaccuucaaaacaccggaaggggaggugggagcgaucgcucuggauuuuaagccuggcaccuccgggagccccauuguuaaccgggaaggaaaaaucgugggccucuauggcaauggggucgugacaacguccggaaccuacguuucugccaucgcccaggcuaaggccagccaggagggcccucugcccgagauugaagacgagguguucagaaaacgcaaccuuacaaucauggaucugcaccccggguccggaaagacccggagauaucugccugcgauuguccgcgaagcuaucaagcggaaacucagaacccugauucuugccccgacacgcgugguugccagcgagauggcugaagcccugaagggcaugcccauccgguaccaaacgaccgcugugaaaucugagcauacagggagagagaucgucgaccucaugugccacgccaccuuuacaaugcgccugcuguccccugugcgggugcccaauuauaacaugauuaucauggaugaagcgcauuucaccgacccuagcucuauugccgcuagaggcuacaucagcacgcgggucggaaugggcgaggccgcugccauuuuuaugacagccacacccccuggguccguugaggcuuucccgcagucuaaugcggugauccaggaugaggaacgcgacauccccgagagaagcuggaacuccggauaugaguggauuaccgauuuuccuggcaagacagugugguucguccccucuaucaaaagcgggaaugacauugccaacugucuccggaagaauggaaagcgcgugauccagcuuuccagaaaaaccuuugauacagaauaccaaaagaccaaaaacaacgacugggacuacguugugacgacagauauuagcgagaugggcgcuaauuuccgggccgacagagucaucgauccucgccggugccugaagcccgugauucugaaagacgggccggaaagaguuauccucgccggcccuaugcccgugaccgucgcuucugccgcgcagcgccggggaagaaucggccgcaaccacaauaaggagggggaucaguauauuuacaugggacagccccugaacaaugacgaggaucaugcucacuggacagaagccaagaugcuucuggacaacaucaauaccccugagggcauuauccccgcccucuucgaaccugagcgggaaaaauccgcugccauugauggggaguauagacugcgcggagaggcgagaaagacguuuguggaacugaugcggcgcggcgaccucccggucuggcuuagcuacaaaguggccuccgagggguuccaauauucugauagacgguggugcuuugacggcgaacgcaacaaucagguucuggaggaaaacauggauguggagaucuggaccaaggagggagaacgcaagaagcugcggcccagauggcucgacgcucgcacauacagcgacccucuggcccuucgggaguucaaagaauuugcugccggcagacgcuccgugucuggggaucugauccucgagauuggaaagcugccccagcaccugacccagcgggcucaaaaugcccucgacaaccuugucaugcugcauaauagcgaacagggcgggagagcguaucggcacgccauggaggagcugccugauacaaucgaaacccucaugcugcuugcucugauugccguucucacaggaggcgugacccuguucuuucuguccggcaaggggcucggaaaaacgagcaucggccuucugugugugauggcuucuuccgcccugcucuggauggccagcgucgagccccauuggauugcugcgucuaucauccuggaguucuuucuuauggugcugcucauuccggagccugaccgccagagaacaccccaggauaaccaacuggccuacguugugaucgggcuccuguucaugauucuuaccgucgcugccaaugagaugggacugcuggaaaccacaaagaaagaccucggcaucgggcacguggccgucgagaaccaccaucacgcuaccaugcuggauguggaccuucauccugccuccgcguggacacuguacgccguugcuacgaccauuaucacacccaugaugcggcacaccauugaaaacacaaccgccaauaucagccucacggcuaucgccaaccaggcggccauucugaugggacuggauaagggcuggccuaucucuaaaauggacauuggcgugccccuccuugcucuggggugcuauagccaggucaauccgcugacccucacagccgcugugcugaugcuuguugcccauuacgcuaucauuggaccuggccugcaagccaaggcgacccgcgaggcccagaagagaacagcugccgggaucaugaaaaaccccaccguggauggaaucgucgcuauugaccucgaucccgugguguaugacgccaaguuugaaaaacagcugggccagaucaugcugcucauucuuuguacgucccaaauccugcugaugcggacaaccugggcccucugcgagucuauuacacuggcgaccgggccucuuaccacacugugggagggaagcccgggcaaguucuggaauacgaccaucgcuguuuccauggccaacaucuuucgcggcagcuaccucgcuggggccggacuggccuucucccugaugaaaucucucggcgggggaagacggggcacaggggcucagggagaaacccuuggcgagaaguggaagcgccagcugaaucagcugagcaaauccgaguucaacacauauaagagaucuggcauuauggaggucgaccggagcgaagccaaagaggggcucagacgcggagagaccacgaagcacgcggugucccggggcacagccaaacugagaugguuuguggaacgcaaucuugucaagcccgaggggaagguuaucgaucugggauguggcagaggcggguggucuuacuauugcgcugggcucaaaaaggugaccgaagugaaaggcuacaccaaagggggaccuggccacgaggaacccauuccuauggccacauacggguggaaccuggucaaacugcauagcggaaaggacguguucuuuauucccccugagaaaugugauacccuccuuugcgacauuggcgaguccagcccgaaucccacaaucgaagaggggagaacgcugcgcguucugaagaugguggaaccuuggcuccggggaaaccaauucuguauuaagauccugaaucccuauaugccuucugucguggagacccuugagcagaugcagagaaaacacggcggcaugcugguucgcaacccccucucccggaauagcacacaugaaauguacugggugucuugcgggaccggaaacaucgucuccgcugugaauaugacaagcagaaugcugcugaaccgcuuuaccauggcccaccggaagccgacguaugagagagauguggaccucggcgcggggacccgccacgucgccguugaaccugagguggcuaaccuggauauuaucggacagagaauugaaaauaucaaacaugagcacaagucuacauggcauuacgacgaggauaaccccuauaaaaccugggccuaccacggcuccuaugaagugaagcccagcggguccgcuagcucuauggucaauggagugguuaaacuucugacaaaaccuugggacgugauucccauggucacccaaaucgccaugacagauaccacgccuuucggccagcagcgggugcucaaggagaaaguugacacacgcaccccgaaggcuaaaagaggcaccgcccaaaucauggaagugacagcgaaguggcuguggggguuucuuagccggaacaagaaacccagaauuuguacgcgggaggaguucacccgcaaggucagauccaaugccgcuaucggagccguguuuguugacgagaaccaguggaacucugcuaaagaggccguggaagaugagcgguucugggaccugguccaucgcgaaagagagcuccacaagcagggcaaaugcgccacaugcguguacaacaugauggggaagcgggaaaagaaacugggagaguuuggcaaggcgaaagggagccgcgcuauuugguacauguggcugggcgccagauuccucgaguuugaagcccugggauucaugaaugaggaucacugguucucccgggaaaacucucuuagcggcgucgagggggagggacugcauaagcucggcuauauccugcgcgacauuuccaaaaucccugggggaaauauguacgcugaugacaccgccggcugggauacaagaaucaccgaagacgaucuucagaacgaggcuaagauuacagacaucauggaacccgagcacgcccugcucgcgaccucuauuuuuaaacugacguaucaaaauaaggugguucgggugcagcgcccugccagaaacgggaccgucauggaugugaucagccggcgcgaccagagaggcuccggacaggugggcacauacgggcugaauaccuucacaaacauggaagcucaacucauucggcagauggagagcgagggaaucuuuucucccuccgaacuggagaccccgaaccuugccgaaagaguucuggauuggcucgagaagcauggcguggaacgccugaaacggauggcuaucagcggggacgacugugucgugaagccuauugaugacagauucgccacggcgcuuucugcccugaaugauaugggaaaaguucgcaaggacaucccccagugggagccuuccaaaggcuggaacgauuggcagcaagugcccuuuugcagccaccacuuccaucagcucauuaugaaggacgggcgggagaucgucgugccuuguagaaaucaggaugaacuggucggccgcgcucgggugucccagggagccggcuggucucugagagagacagcuugccucggaaagagcuaugcccaaauguggcagcugauguacuuucaccgccgggaccuuagacuggcugccaacgcgauuuguuccgccguucccguggauugggucccgaccagccgcacaaccuggucuauccaugcucaccaucaguggaugacgaccgaagacaugcucuccguguggaaucggguuuggauugaggaaaacccuuggauggaggauaaaacacacaucagcucuuggggagacgugcccuaucugggcaagagagaggaccaauggugcgggagccuuaucggacugaccgcccgggccacaugggcuaccaauauucaggucgccaucaaccaggugagacgccucauuggcaaugaaaacuaccuggauuacaugacauccaugaaacgguucaagaaugagucugaccccgaaggggcgcugugguga

SEQ ID NO: 19057 - RNA, 9879 nt, Artificial Sequence
  derived and/or modified CDS sequence (opt5) from DENV-1__GQ199814__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaauaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagauaagccugugaacaucgaggccgaaccgcccuucggcgagucuuauauugugaucggggccggagagaaagcucugaaacuuagcugguuuaagaaaggcuccucuauugggaagauguucgaagccaccgcuagaggcgcccgccggauggcgauccucggagacacagccugggauuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugacagcggaugcguuauuaacuggaaaggccgcgagcucaaguguggguccggaaucuuugugacaaaugaaguccacaccuggacagagcaauauaaguuccaggccgacucuccuaaacggcugagcgcggccauuggcaaggcuugggaagagggggugugcggcaucagauccgccacccgccuggagaacaucauguggaaacagauuucuaacgaacucaaucauauccugcuugagaacgauaugaaguuuacgguuguggucggagacguggcuggcauucuggcccaggggaaaaagaugauccggccgcaacccauggaauacaaauauagcuggaaguccuggggaaaggccaaaauuaucggcgcugaugugcagaauacaaccuucaucauugacgggccuaacacccccgaguguccugaugaccagagagcguggaauaucugggaagucgaggauuacggauuuggcauuuucacaaccaacaucuggcucaagcugcgcgacagcuauacgcagguuugcgaucaccggcugaugucugccgcuauuaaagacuccaaggccgugcacgccgauaugggcuacuggaucgagagcgagaagaaugagacauggaaacuugcuagagccucuuucaucgaagugaagaccuguauuuggcccaaaucccauacacucuggagcaacgggguccuggagucugaaaugaucauuccgaagaucuauggaggcccuauuagccaacacaauuaccgccccggguacuuuacccagacagcgggaccuuggcaucugggcaaacucgagcuggacuucgaucuuugcgaggggaccacggugguuguggacgaacacugcggaaaccggggccccucccugagaaccacaaccgucacaggcaagaucauccacgagugguguugccggagcuguacccucccuccccugcgcuuuaaaggggaagacggaugcugguauggcauggagauuagaccggugaaggagaaggaagagaaucugguuaaaucuaugguguccgcugggagcggagaagucgauuccuucucucuuggccuccuguguaucagcauuaugacggaggaagugaugcgguccagauggucucgcaagaugcugaugacagggacccucgccgucuuuuuccugcuuaucaugggacagcugacauggaacgaccucauucggcugugcaucauggugggcgccaaugcuagcgauagaaugggcauggggaccaccuaccuggcccuuauggcgacauuuaaaaugcgcccuauguucgcugucggacugcucuuuagacggcugacgucccgcgaggugcuccugcuuaccauuggccugucucucguggccagcgucgagcugcccaacucccuggaagaacuuggggacggacuggccaugggcaucaugauccucaagcugcucacagauuuccaaagccaucagcugugggcuacccuucugucucucacauuuauuaaaaccacguucucccugcacuaugccuggaagacaauggcuaugguucugagcaucgugucucuuuuuccccugugucucuccaccaccagccagaagacaaccuggcugccugugcuccuggggucucuuggaugcaaaccgcugacaauguuccugauugccgaaaauaagaucuggggcagaaaauccuggccccucaacgagggcauuauggcggucgggaucgugagcauccugcuuuccagccugcucaagaacgacguuccucuggccggaccccucauugcuggcgggaugcugaucgccuguuacgugauuucuggaagcuccgcugaucuuucucuggaaaaagccgccgaggucagcugggaggaagaggcugaacauuccggcgcgucucacaauauccugguggagguucaggacgaugggacgaugaagauuaaagacgaagaacgggaugacacccucacaauccugcuuaaggccacccugcucgcugugagcggagucuauccucuguccauccccgccacacucuucgugugguacuuuuggcaaaagaaaaagcagcgcucuggcguccugugggauaccccuuccccucccgagguggaaagagccguucuugacgacggcauuuaucggaucaugcagcgcgggcugcugggaagaucccaggugggcgucgggguguuccaagagaacguuuuucauacgauguggcacgugacccggggagcuguccucauguaccagggcaaacgccuggaacccagcugggccucugugaagaaagaucuuauuuccuacgggggaggcuggagacugcagggcagcuggaauacaggggaggaggugcagguuaucgcggucgaacccggaaagaacccuaagaaugugcaaaccgcucccggcacauucaaaaccucugagggggaagugggagccauugcccucgacuuuaagccgggcacauccgggagcccuaucgucaaccgggagggaaaaauugugggccuguauggcaaugggguugugacgaccuccggaacauacgucucugcuaucgcccaggcgaaggcuagccaggaaggcccccucccugagaucgaggaugaaguguucagaaaacgcaaccugaccauuauggaccuucaccccggguccggaaagacccggagauaucugcccgccaucguucgcgaggccauuaagcggaaacugagaacacucauccuggcuccuacgcgcguggucgccagcgaaauggcugaggcccuuaagggcaugccgauucgguaccaaaccacagcggugaaaucugaacauaccgggaaggagaucguugaucugaugugccacgccacauuuaccaugagacuccugucccccgugcgcgucccuaauuauaacaugaucauuauggacgaggcucauuucacggaucccagcucuaucgccgcucggggcuacauuagcacaagagugggaaugggcgaagccgccgcuaucuuuaugaccgcgaccccucccggguccguggaggccuucccucagucuaaugcugucauucaggacgaggaacgggauaucccggaacgcagcuggaacuccggauaugaguggaucacagacuuucccggcaaaaccguuugguucgugccuucuauuaagagcgggaaugauaucgccaacugucugagaaagaauggaaaacgggugauucagcucucccgcaagacauucgacaccgaguaccagaagacgaagaacaacgacugggauuacgucgugacaaccgacaucagcgaaaugggcgccaauuuuagagcugaucggguuauugaccccagacgcugccuuaaaccugugauccugaaggaugggcccgagcgggucauucuggccggcccgaugccugugacaguugcgucugcugcccagagacgcggacggaucggcagaaaccacaauaaggaaggggaccaguauguguacaugggacagccccucaacaaugaugaggaccaugcccacuggaccgaggcuaaaaugcugcuugauaacaucaauacgcccgaaggcauuaucccugcccuguucgagcccgaacgcgagaaguccgcggccauugacggggaauaucggcucagaggagaggcucgcaaaaccuuugucgagcugaugagacggggcgaucugccuguguggcucagcuacaaggucgccuccgaaggguuccaauauucugaccgcagauggugcuuugauggcgagcggaacaaucaggugcuugaagagaacauggacguugaaaucuggacaaaagagggagagcgcaagaaacugagaccgcgguggcuggacgcuagaaccuacagcgauccccucgcccugcgcgaguucaaggaguuugcugccggccggagauccgugucuggggaccuuauucuggaaaucggaaagcucccucagcaccugacacagcgcgcgcaaaaugcccuggauaaccucgugaugcuucauaauagcgagcagggcgggcgggcuuauagacacgccauggaggaacugcccgacaccaucgagacacugaugcuccuggcucuuauugccguccugaccggaggcguuacgcuguucuuucuguccggccgggggcugggaaaaacaagcaucggccuccuuugugugauggccucuuccgugcugcuguggauggcuagcgucgaaccucauuggauugcggccucuaucauucucgaguucuuucugauggugcuucugauccccgaaccggaucgccagagaaccccucaggacaaccaacucgcuuacguugugaucgggcugcuguucaugauucucaccgucgccgccaaugagaugggacuucuggagacaaccaagaaagaucugggcaucgggcacguggcugucgaaaaccaccaucacgccgcgaugcucgacguggaucugcaucccgccuccgcuuggacacuuuacgccguugcuacgaccauuaucacaccuaugaugcggcacaccauugagaacacaaccgccaauaucagccugacggcgauugccaaccaggcugccauccucaugggacuggacaagggcuggcccaucucuaaaauggauauuggcgugccucugcucgcucuugggugcuauagccaggucaauccccugacccugacagccgcugugcucaugcugguugcccauuacgcgaucauuggaccgggccuucaagccaaggcuacccgcgaagcccagaagagaacagcugccgggaucaugaaaaacccuaccguggacggaauugucgccaucgaucuggaccccgugguguaugacgcgaaguuugagaaacagcucggccagaucaugcugcugauucucuguacgucccaaauccuucugaugcggacaaccugggcucugugcgaaucuauuacacucgccaccgggccccugaccacacuuugggagggaagcccuggcaaguucuggaauacgaccaucgcuguuuccauggccaacauuuuccgcggcagcuaccuggccggggcuggacucgccuuuucccugaugaaaucucugggcgggggaagacggggcacaggggcgcagggagagacccucggcgaaaaguggaagcgccagcuuaaucagcugagcaaauccgaguucaacacauauaagagaucuggcaucauggaagucgaucggagcgaggccaaagaagggcugaagagaggagagaccacgaaacacgcugugucccgcggcacagccaagcuccggugguuuguggagagaaaucuggucaagccggaagggaaaguuaucgaccuuggauguggccgcgggggauggucuuacuauugcgcuggccugaagaaagugaccgaggugaagggcuacaccaaagggggacccggccacgaggaaccuauucccauggccacauacggguggaaccucgucaagcugcauagcggaaaagauguguucuuuaucccucccgaaaagugugacacccugcucugcgauauuggcgaguccagcccuaauccgacaaucgaggaagggcggacgcuuagaguucugaagaugguggagcccuggcugcgcggaaaccaauucuguauuaaaauccucaauccuuauaugcccucugucguggaaacccuggagcagaugcagcggaagcacggcggcaugcuuguuagaaacccucugucccgcaauagcacacaugagauguacugggugucuugcgggaccggaaacauugucuccgcggugaauaugacaagccggaugcuccugaacagauuuaccauggcccaccgcaaacccacguaugaacgggacguggaucugggcgcugggaccagacacgucgccguugagccggaaguggcuaaccucgacaucaucggacagcgcauugagaauaucaagcaugaacacaaaucuacauggcauuacgaugaggacaacccuuauaagaccugggccuaccacggcuccuaugaggugaagcccagcggguccgcuagcucuauggucaauggagugguuaaacugcuuacaaagcccugggaugugauuccuauggucacccaaaucgccaugacagacaccacgcccuucggccagcagagaguguuuaaagaaaagguugacacacggaccccuaaagcgaagcgcggcaccgcccaaauuauggaggugacagcuaaguggcuguggggguuccucagcagaaacaaaaagccgcggaucuguacgagagaagaguuuacccggaaaguccgcuccaaugccgcuaucggagccguguucguugaugaaaaccaguggaacucugccaaggaggcgguggaggacgaaagauuuugggaucugguccaucgggagcgcgaacuucacaaacagggcaagugcgcuacaugcguguacaacaugauggggaagagagagaaaaagcugggagaguucggcaaagccaaggggagccgggccauuugguacauguggcucggcgcucgcuuccuggaguuugaggcccugggauucaugaaugaagaccacugguuuuccagagagaacucucucagcggcgucgaaggggagggacugcauaaacuuggcuauauccugcgggauauuuccaagauccccgggggaaauauguacgcugacgauaccgccggcugggacacacgcauuaccgaggaugaccuccagaacgaagcgaaaaucacagauaucauggagccugaacacgcccugcuugcuaagucuauuuucaagcugaccuaucaaaauaaagugguuagagugcagcggcccgccaagaacgggacggucauggacgugaucagccgcagagaucagcggggcuccggacaggugggcaccuacgggcucaauacauuuaccaacauggaggcucaacugauucgccagauggaaagcgagggaaucuucucuccuuccgagcuggaaacacccaaccucgccggcagaguucuggacuggcuugagaaacaugggguggaacggcugaagagaauggcgauuagcggagacgauugugucgugaaaccgaucgacgaucgcuuugccaccgcucucacggcccugaaugacaugggcaagguucggaaggauaucccucagugggagcccucuaaaggguggaacgacuggcagcaagugccuuucugcucccaccacuuucaucagcuuauuaugaaggauggcagagaaaucgucgugcccugucgcaaucaggacgagcuggucggacgggcuagagugagccagggcgccggguggucccuccgcgagacagcuugccugggaaaaucuuaugcccaaauguggcagcugauguacuuccaccggagagaucuccgccuggcggccaacgcuauuuguagcgccguuccuguggacuggguccccaccucccggacaaccuggagcauccaugcccaccaucaguggaugacgaccgaagauaugcuuucuguguggaauagaguuuggauugaggaaaacccguggauggaggacaagacacacaucuccagcuggggcgacgugccuuaucuggggaaacgcgaagaucaauggugcggaucucucauuggccugaccgcucgggccacaugggcgaccaauauccaggucgcuaucaaccaggugagacggcuuauugggaaugagaacuaccuggacuacaugacaagcaugaagagauuuaagaaugaguccgaucccgaaggcgcccucugguga

SEQ ID NO: 19058 - RNA, 9879 nt, Artificial Sequence
  derived and/or modified CDS sequence (opt5) from DENV-1__GQ199816__SS-prME
agcgugaccaugcugcugaugcugaugcccaccgcccuugcuuuccaccugacgaccagaggaggggaaccucauaugaucgucuccaagcaggaacggggaaaaucucuccuguuuaagacaagcgccggcguuaacaugugcacccuuauugccauggaccugggggaguucugugaagauacaaugaccuacaaaugcccccgcaucacagaagcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagaagguugaaacaugggcucuccggcaccccggcuuuaccgugaucgcccuguuccuugcgcaugccauugggacaucuaucacccagaagggaaucauuuuuauccugcucaugcuggucaccccuagcauggcuaugcgcugcgugggcauuggguccagagauuucguugagggacuuagcggcgccacauggguggacgucgugcuggagcacgggucuugugugacgaccauggcuaaagauaagcccacacucgacaucgaacugcugaaaaccgaggucacaaacccugccguucuccggaagcugugcauugaagcgaaaaucuccaauaccacgacagauagccgcuguccgacccaaggagaggccacccuuguggaagaacaggacgcuaacuuugugugcagacggacauucgucgaucgcggcuggggcaauggguguggacuguuuggcaaggggucucucauuaccugcgccaaguucaaaugcgugacaaagcuggagggaaaaacgguucaguacgaaaaccuuaaguauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguucccccagaaccggccuggacuuuaacgaaauggugcuccugacgaugaaagagaaggcuuggcuuguccauaaacagugguuccuggaucucccucugcccuggacaagcggggcguccaccucucaagagacauggaaucggaaggaccuucuggugaccuuuaagaccgcccacgcuaaaaagcaggaagucgugguucucggaagccaggagggcgccaugcacacagcccugacgggggcuaccgaaauccaaacauccggaaccacaaccauuuucgccggccaucugaaaugccgccucaagauggauaaacugacgcuuaaggggaugagcuaugugauguguacaggcucuuucaagcuggagaaagaagucgcggagacccagcacggaaccgugcucguucagaucaaguacgagggcacagacgcuccgugcaaaauuccuuuuuccacccaggaugaaaagggggugacacaaaacggaagacugaucacggccaaucccaucgucaccgacaaagagaagccugugaacauugaagccgagccgcccuucggcgagagcuauaucgugauuggggcuggagaaaaggcccugaaacuuucuugguuuaagaaaggcagcuccaucgggaagauguucgaggcuacagcccggggcgcgagacgcauggccauucucggagauaccgcuugggacuuuggcucuaucgggggaguuuucacaagcgucggcaaacuggugcaucagaucuuugggaccgccuacggagugcuguucuccggcgucagcuggacgaugaagauugggaucggcgugcuccugaccuggcuuggacucaauucucgguccacaagccucucuaugaccuguauugcuguuggccuggugacacuguaccuuggggucauggugcaggccgauuccggaugcguuaucaacuggaagggcagagaacucaaaugugggagcggaauuuuugugaccaaugagguccacacauggaccgaacaguauaaguuccaagcggacuccccuaaacgccugucugccgcuaucggcaaggccugggaggagggggugugcggcauucggagcgcuacgagacuggaaaacaucauguggaaacagaucuccaacgagcucaaucauauucugcuugaaaacgacaugaaguuuacaguuguggucggagauguggccggcauccuggcccaggggaaaaagaugauucgcccgcagcccauggaguacaaguauucuuggaaaagcuggggaaaggcuaaaaucauuggcgcggacgugcaaaaugccaccuucaucaucgaugggccuaacacccccgaauguccugacgaucagcgggcuuggaauauuugggaggucgaggacuacggauuuggcaucuucacaaccaacauuuggcucaagcugagagauuccuauacgcagguuugcgaccaccgccugaugagcgccgccaucaaagauucuaaggcugugcacgccgacaugggcuacuggauugaauccgagaagaaugaaacauggaaacuugcgcgggcuagcuucaucgaggugaagaccuguaucuggcccaaaucucauacacucugguccaacgggguccuggaaagcgagaugauuaucccgaagauuuauggaggcccuaucucucagcacaauuacagacccggguacuuuacccaaacagccggaccuuggcaucugggcaaacucgagcuggauuucgaccuuugcgaagggaccacggugguuguggaugagcacugcggaaaccgcggccccagccugcggaccacaaccgucacaggcaagauuauccacgaaugguguugcagauccuguacccucccuccccugcgguuuaagggggaggacggaugcugguauggcauggagauccgcccggugaaagaaaaggaggaaaaucugguuaaaagcauggugucugccggguccggagaggucgacagcuucucccuuggccuccuguguauuucuaucaugauugaagaggugaugagaagccggugguccagaaagaugcugaugacggggauccucgcugucuuuuuccugcuuauuaugggacagcugacauggaacgaucucauccgccugugcauuauggugggcgccaaugcgucugaccggaugggcauggggaccacauaccuggcucuuauggccaccuuuaaaaugagaccuauguucgccgucggacugcucuuucgcagacugaccagccgggaggugcuccugcuuacaaucggccugucccucguggcuucugucgaacugcccaacagccuggaggaacuuggggauggacuggccaugggcaucaugauucucaagcugcucacggacuuccagucccaucaacugugggcuacccuucugagccucacauuuaucaagaccacauucucucugcacuaugccuggaaaaccauggcgaugguucuguccauugugagccuuuuuccccugugucucucuacgacaucccagaagaccaccuggcugccugugcuccuggggagccuuggaugcaaaccgcugacaauguuccugaucgccgagaauaagauuuggggccgcaaaucuuggccccucaacgaaggcaucauggcugucgggaucguguccauucugcuuagcucccugcucaagaacgauguuccucuggccggaccccucaucgcuggcgggaugcugauugccuguuacgugaucagcggaucuagcgccgaccuuucccuggagaaagcugcggaggucucuugggaagaggaagccgagcauagcggcgcuucccacaauauucugguggaaguucaggaugacgggaccaugaagaucaaggaugaggagagagacgauacacucacgauccugcuuaaagccacccugcucgccgugucuggagucuauccucugagcauucccgcuacacucuucgugugguacuuuuggcagaagaaaaagcaacgguccggcguccugugggacaccccuucucccccggaaguggagcgcgccguucuugaugacggcaucuauagaauuaugcagcgggggcugcugggacgcagccaggugggcgucgggguguuccaggaaaacguuuuucauacaauguggcacgugaccagaggagcgguccucauguaccaaggcaaacggcuggagccuuccugggcuagcgugaagaaggaccuuaucucuuacgggggaggcuggcgccugcagggcuccuggaauacgggggaggaagugcagguuauugccgucgagcccggcaaaaauccuaagaaugugcagaccgcccccggcacauucaaaaccagcgaaggggaggugggagcuaucgcccucgauuuuaagccgggcacaucuggguccccuauugucaacagagaaggaaaaaucgugggccuguauggcaaugggguugugaccacaagcggaacguacgucuccgcgaucgcucaagccaaggccucucaggagggcccccucccugagauugaagacgagguguuccggaagagaaaccugaccaucauggaucuucaccccgggagcggaaaaacacgccgguaucugcccgcuauuguuagagaagccaucaagcgcaaacugcggacccucauucuggcuccuaccagaguggucgccuccgagauggcggaagcccuuaagggcaugccgauccgcuaccagacaacggcugugaaaagcgagcauaccgggaaggagaucguugaccugaugugccacgccacauuuaccaugcggcuccugucucccgugagagucccuaauuauaacaugauuaucauggaugaagcucauuucacagaccccuccagcauugccgcccgcggcuacaucucuacccgggugggaaugggcgaggcugcggccauuuuuaugacggcuacaccucccgggagcguggaagccuucccucaauccaaugccgucauccaggaugaggaaagagacaucccggagcggucuuggaacagcggauaugaguggauuaccgauuuucccggcaagaccguuugguucgugccuuccaucaaaucugggaaugacauugcuaacugucugcgcaagaauggaaaaagagugauccagcucagccggaagacauucgauaccgaauaccagaaaacaaagaacaacgacugggacuacgucgugaccacggauauuuccgagaugggcgccaauuuucgcgcggacagaguuaucgauccccggagaugccuuaagccugugauucugaaagacgggcccgaacgcgucauccuggcuggcccgaugccugugacaguugccagcgccgcucaacggagaggacgcaucggccggaaccacaauaaggagggggaucaguauauuuacaugggacagccccucaacaaugacgaggaucaugcccacuggaccgaagcgaaaaugcugcuugacaacaucaauacacccgagggcauuaucccugcccuguucgaacccgagagagaaaagucugcugccauugauggggaguaucgccuccggggagaggcuagaaaaaccuuuguggaacugaugcgcagaggcgaccugccugucuggcucuccuacaagguggccagcgagggguuccaguauuccgaucggcgcuggugcuuugacggcgaaagaaacaaucaaguccuugaggaaaacauggauguggagaucuggacgaaagagggagaacggaagaagcugcgcccgagauggcuggacgcucggaccuacucugacccccucgcccugagagaguucaaagaauuugcggccggccgccggagcguuuccggggaucuuauccuggagauuggaaagcucccucagcaccugacacagagagcucagaaugcccuggacaaccucgugaugcuucauaauucugaacaaggcgggcgcgcuuaucggcacgccauggaggagcugcccgauaccaucgaaacacugaugcuccuggcccuuauugcugugcugaccggaggcgucacacucuucuuucugagcggcagagggcugggaaaaaccuccaucggccuccuuuguguuauggcgagcucugugcugcuguggauggccuccguggagccucauuggauugcugccagcaucauccucgaguucuuucugaugguccuucugauucccgagccggaccggcagcgcacgccucaggauaaccagcucgccuacgugguuaucgggcugcuguucaugauucucacaguggcugccaaugagaugggacuucuggaaaccaccaagaaagaccugggcaucgggcacgucgcgguggagaaccaccaucacgccgcuaugcucgaugucgaccugcaucccgccucugcuuggacacuuuacgccguggcgaccacaauuaucacgccuaugaugagacacaccauugaaaacacaaccgccaauaucucccugacagcuaucgccaaccaagcugccauucucaugggacuggauaagggcuggcccaucagcaagauggacauuggcguuccucugcucgcucuugggugcuauucucaggugaauccccugacccugacggccgcgguccucaugcugguggcccauuacgcuaucauuggaccgggccuucaggccaaagcuacccgggaggcccaaaagcgcacagccgcggggaucaugaaaaacccuaccguugauggaaucguggcuauugaccuggaucccgucguguaugacacaaaguuugaaaaacagcucggccagaucaugcugcugauucucuguaccagccagauccuucugaugagaacgacaugggcccugugcgaguccauuacccucgcuacagggccccugaccacccuuugggagggaucuccuggcaaguucuggaauacaacgaucgccgugagcauggccaacaucuuccggggcuccuaccuggcuggggccggacucgcguuuagccugaugaagucccugggcgggggacgcagaggcaccggggcccaaggagaaacacucggcgagaaauggaagcggcagcuuaaucagcugucuaaaagcgaguucaacaccuauaagcgcuccggcauuauggagguugacagaucugaagcuaaagaggggcugaagcggggagagacaaccaagcacgccgucagcagaggcacggcuaaacuccgcugguuuguggaacggaaucuggugaagccggaggggaaagucaucgaucuuggauguggcagagggggaugguccuacuauugcgccggccugaagaaaguuacagaagugaagggcuacaccaaagggggacccggccacgaggaaccuauucccauggcgaccuacggguggaaccucgugaagcugcauucuggaaaggacgucuucuuuaucccucccgagaaaugugauacacugcucugcgacauuggcgagagcuccccuaauccgaccaucgaagaggggcgcacacuucgggugcugaagaugguugaacccuggcugagaggaaaccaguucuguauuaaaauccucaauccuuauaugcccagcguggucgagacgcuggagcaaaugcagcgcaagcacggcggcaugcuugugcggaacccucugucuagaaauuccacccaugaaauguacuggguuagcugcgggacaggaaacaucgugucugccgucaauaugaccucccgcaugcuccugaaccgguuuacaauggcucacagaaaacccaccuaugagcgcgauguggaccugggcgccgggacgcggcacguggcugucgaaccggagguugccaaccucgauauuaucggacagagaauugaaaauaucaagcaugagcacaagagcaccuggcauuacgacgaggauaacccuuauaaaacaugggcuuaccacggcucuuaugaagugaagcccuccgggagcgccuccagcauggugaauggagucgugaaacugcuuaccaagcccugggacguuauuccuauggugacacagaucgcgaugaccgauacaacccccuucggccaacagcgcgucuuuaaagagaagguggacacgagaacaccuaaggccaaacggggcaccgcucagaucauggaaguuaccgccaaguggcuguggggguuccucucucgcaacaaaaagccgagaauuuguacacgggaggaauuuacgagaaaagugcggagcaaugcugccaucggagccgucuucguggacgagaaccaauggaacuccgcgaaggaggcuguugaagaugagcgcuuuugggaccuggugcauagagaacgggagcuucacaagcagggcaaaugcgcgaccugcgucuacaacaugauggggaagcgcgagaaaaagcugggagaguucggcaaagccaaggggucuagagcuauuugguacauguggcucggcgcccgguuccuggaguuugaagcucugggauucaugaaugaggaucacugguuuagccgcgaaaacucccucucuggcguggagggggagggacugcauaaacuuggcuauauccugagagacauuagcaagauccccgggggaaauauguacgccgaugacacagcgggcugggauacccggaucacagaagacgaucuccagaacgaggccaagauuaccgacaucauggaaccugagcacgcucugcuugccaaauccauuuucaagcugacauaucagaauaaagucgugcgcguucaaagacccgcuaagaacgggaccgugauggaugucaucucucggcgcgaccagagaggcagcggacaggugggcacguacgggcucaauaccuuuacaaacauggaagcccagcugauucggcaaauggaguccgagggaaucuucagcccuucugaacuggagacccccaaccucgcgggccgcgugcuggauuggcuugaaaaacaugggguugagagacugaagcggauggccaucuccggagacgacuguguggucaagccgauugaugacagauuugcuacagcccucaccgcucugaaugauaugggcaaagugcgcaaggacaucccucagugggaacccagcaaaggguggaacgauuggcagcagguuccuuucugcucucaccacuuucaucaacuuauuaugaaggacggccgggagaucgugguccccuguagaaaucaggaugagcuggugggacgcgcccgggucucccagggcgcuggguggagccucagagaaacggccugccugggaaaauccuaugcgcagauguggcaacugauguacuuccaccgccgggaccucagacuggccgcuaacgccauuuguucugccgugccuguugauugggugcccacaagccgcaccacaugguccauccaugcucaccaucaguggaugaccacggaggacaugcuuagcgucuggaaucggguguggauugaagagaacccguggauggaagauaagacccacaucucuuccuggggcgacguuccuuaucuggggaagagagaggaccaguggugcggaagccucaucggccugacagcccgcgcgaccugggcuacaaauauucaaguggccaucaaccagguccggagacuuauugggaaugagaacuaccuggauuacaugaccucuaugaaacgguuuaagaaugaaaucgaccccgagggcgcccucugguga

SEQ ID NO: 19059 - RNA, 9879 nt, Artificial Sequence
  derived and/or modified CDS sequence (opt5) from DENV-1__GQ199817__SS-prME
agcgugaccaugcugcugaugcugaugcccacagcccuugcuuuccaccugacgaccagaggaggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaagcugacgguuguggucggagauguggcuggcauucucgcccaggggaaaaagaugauccggccgcaacccauggaguacaaauauagcuggaaguccuggggaaaggccaaaauuaucggcgcugacgugcagaauacaaccuuuaucauugaugggccuaacacccccgaauguccugacgaucagagagcguggaauaucugggaggucgaggacuacggauucggcauuuuuacaaccaacaucuggcugaagcugcgcgauagcuauacgcagguuugcgaccaccggcuuaugucugccgcuauuaaagauuccaaggccgugcacgccgacaugggcuacuggaucgaaagcgagaaaaaugaaacauggaagcucgcuagagccucuuucaucgaggugaagaccuguauuuggcccaaaucccauacacuguggagcaacgggguccuggaaucugagaugaucauuccgaagaucuauggaggcccuauuagccaacacaauuaccgccccggguacuucacccagacagcgggaccuuggcaucucggcaaacuggagcuugauuuugaccugugcgaagggaccacggugguuguggaugagcacugcggaaaccggggccccucccucagaaccacaaccgucacaggcaagaucauccacgaaugguguugccggagcuguacccugccuccccugcgcuucaaaggggaggacggaugcugguauggcauggagauuagaccggugaaggaaaaggaggaaaaucuuguuaaaucuaugguguccgcugggagcggagaggucgacuccuuuucucucggccugcuguguaucagcauuaugaucgaagaggugaugcgguccagauggucucgcaagaugcucaugacggggacacuggccguuuucuuucuucugauuaugggacagcucaccuggaacgaucugauccggcugugcauuauggugggcgccaaugcuagcgacagaaugggcauggggacaaccuaccuugcccugauggcgaccuucaaaaugcgcccuauguuugcugucggacuccuguucagacggcucacaucccgcgaggugcugcuucugacgaucggccucucucugguggccagcgucgaacugcccaacucccuugaggaacugggggauggacucgccaugggcaucaugauucugaagcuccugaccgacuuucaaagccaucagcuuugggcuacacugcucucucugaccuucaucagaacaaccuuuucccugcacuaugccuggaaaacgauggcuaugguucuuagcauugugucucugaucccccucugucuguccacaaccagccagaagaccacauggcucccugugcugcuugggucucugggaugcaagccgcugaccauguuccucauugccgagaauaaaaucuggggccggaaguccuggccccugaacgaaggcaucauggcggucgggauugugagcauccuucuguccagccuccugaaaaacgauguuccucucgccggaccccugauugcuggcgggaugcuuaucgccuguuacgugauuucuggaagcuccgcugaccugucucuggagaaggccgccgaggucagcugggaagaggaagcugagcauuccggcgcgucucacaauauccucguggaaguucaggaugacgggacaaugaaaaucaaggaugaggagcgcgacgauacgcugaccauucuucugaaagccacacuccuggcugugagcggagucuauccucucuccauccccgccacccuguuuguguggugcuucuggcaaaagaagaaacagagaucuggcguccuuugggacacaccuuccccucccgaaguggagcgggccguucuggaugacggcauuuaccgcaucaugcagagagggcugcucggacggucccaggugggcgucgggguguuccaagaaaacguuuuucauaccauguggcacgugacgcgcggagcuguccugauguaucagggcaagagacuugagcccagcugggccucugugaaaaaggaccugauuuccuacgggggaggcuggcggcuccagggcagcuggaauaccggggaggaagugcagguuaucgcggucgagcccggcaagaauccuaagaaugugcaaacagcucccggcaccuucaagacaucugaaggggaggugggagccauugcccuggauuuuaaaccgggcaccuccgggagcccuaucgucaacagagaaggaaagaucgugggccucuacggcaaugggguugugacaacguccggaaccuaugucucugcuauugcccaggcgaaagcuagccaggagggcccccugccugagaucgaagacgagguguuccgcaagcggaaccuuacaauuauggaucugcaccccggguccggaaaaaccagacgcuaccugcccgccaucguucgggaagccauuaagagacgccuccggacccugauccuugcuccuacaagaguggucgccagcgagauggcugaagcccugaagggcaugccgauccgcuaucaaacgaccgcggugaaaucugagcauacagggaaggagauuguugaccucaugugucacgccaccuuuacaaugcggcugcugucccccgugagagucccuaauuacaacaugaucauuauggaugaagcucauuucaccgaccccagcucuaucgccgcucggggcuauauuagcacgcgcgugggaaugggcgaggccgccgcuaucuuuaugacagcgaccccucccggguccguggaagccuucccucagucuaaugcugucauccaggaugaggaaagagacauuccggagcggagcuggaacuccggauacgaguggaucaccgauuuucccggcaaaacaguuugguucgugccuucuauuaagagcgggaaugacaucgccaacugccuccgcaaaaauggaaagagagugauucagcuuucccggaagaccuuugauacagaauaucagaagaccaagaacaacgacugggacuacgucgugacgacagauaucagcgagaugggcgccaauuucagagcugaccgcguuauugauccccggagaugccugaaaccugugauccugaaggacgggcccgaacgcgucauccucgccggcccgaugccugugaccguugcgucugcugcccagcggagaggacgcauuggccggaaccacaauaaagagggggaucaguacaucuauaugggacagccccugaacaaugacgaggaucaugcccacuggacagaagcuaagaugcuucuggacaacauuaauacccccgagggcaucauuccugcccucuucgaacccgagagagaaaaguccgcggccaucgauggggaguaccgccugagaggagaggcucggaaaacguuuguggaacugaugcgcagaggcgaccucccugucuggcuuagcuauaagguggccuccgagggguuccaauacucugaucggcgcugguguuuugacggcgaaagaaacaaucagguccuggaggaaaacauggauguggagaucuggaccaaagagggagaacggaagaaacugagaccgcgcuggcucgacgcucggacauauagcgacccccuggcccuuagagaguucaaggaauuugcugccggccgccgguccguuucuggggaucugauucucgagaucggaaaacugccucagcaccugacccagagagcgcaaaaugcccucgacaaccuugugaugcugcauaauagcgaacagggcgggcgggcuuaccgccacgccauggaggagcugcccgauacaauugaaacccucaugcugcuugcucugaucgccgugcucacaggaggcgucacccuguuccugcucuccggcagagggcuuggaaagacgagcauuggccugcugugcguuauggccucuuccgugcuccuguggauggcuagcguggagccucauuggaucgcggccucuaucauucuugaauuuuuccugaugguccuccugauccccgagccggaccggcagcgcacaccucaggauaaccaacuggcuuaugugguuauugggcuccuuuuuaugauccugaccguggccgccaaugagaugggacugcucgaaaccacaaagaaagaccugggcauugggcacgucgcuguggagaaccaccaucacgccgcgaugcuugaugucgaccugcaucccgccuccgcuuggacccucuacgccguggcuacaacgaucauuaccccuaugaugagacacacaaucgaaaacaccacagccaauaucagccugaccgcgauugccaaccaggcugccauccugaugggacucgauaagggcuggcccauuucuaaaauggacaucggcguuccucuucuggcucugggguguuacagccaggugaauccccucacgcugaccgccgcuguccuuaugcugguggcccauuaugcgauuaucggaccgggccuccaagccaaggcuacacgggaggcccagaaacgcaccgcugccgggaucaugaagaacccuacaguugauggaauuguggccaucgaccuggaucccgucguguacgacgcgaaguucgaaaaacagcugggccagauuaugcuccuuauccugugcaccucccaaauucugcucaugagaacgacaugggcucugugugagucuaucacccuugccacagggccccugaccacccucugggagggaagcccuggcaaguuuuggaauacaacgaucgcuguguccauggccaacauuuuccggggcagcuaucuggccggggcuggacuggccuuuucccucaugaaaucucuuggcgggggacgcagaggcaccggggcgcagggagaaacacugggcgagaaguggaaacggcagcugaaucagcucagcaaguccgaguucaacaccuacaagagaucuggcaucauggagguugaccgcagcgaagccaaagaggggcugaagcggggagagacaaccaaacacgcugucuccagaggcacggccaaacuucgcugguucguggaacggaaucuggugaaaccggaggggaaggucauugaucucggaugcggcagagggggauggucuuauuacugugcuggccugaagaaaguuacagaagugaagggcuauaccaaagggggacccggccacgaggaaccuauccccauggccaccuacggguggaaccuggugaagcuccauagcggaaaagacgucuuuuucauuccucccgagaagugcgauacacuucugugugacaucggcgaguccagcccuaauccgaccauugaagaggggcgcacacugcgggugcucaaaaugguugaacccuggcugagaggaaaccaauuuugcaucaagauccuuaauccuuacaugcccucuguggucgagacgcuggagcagaugcagcgcaagcacggcggcaugcucgugcggaacccucuguccagaaauagcacccaugaaauguauuggguuucuugugggacaggaaacauuguguccgcggucaauaugaccagccgcaugcugcucaaccgguucacaauggcccacagaaaacccaccuacgagcgcgauguggaccugggcgcugggacgagacacguggccgucgaaccggagguugcuaaccuugauaucauuggacagcggaucgaaaauauuaagcaugagcacaaaucuaccuggcauuaugacgaggauaacccuuacaagacaugggccuaucacggcuccuacgaagugaaacccagcggguccgcuagcucuauggugaauggagucgugaagcugcucaccaagcccugggacguuaucccuauggugacacaaaucgccaugaccgauacaacccccuuuggccagcagcgcgucuucaaagagaagguggacacgagaacaccuaaagcgaagcggggcaccgcccaaauuauggaaguuaccgcuaaauggcuguggggguuucuuagcagaaacaagaagccgcggaucugcacacgcgaggaguucacgagaaaagugcgguccaaugccgcuauuggagccgucuuuguggacgagaaccaguggaacucugccaaggaggcgguugaagaugagcgcuucugggaccuggugcauagagaacgggagcuccacaaacagggcaagugcgcuaccugugucuauaacaugauggggaaacgcgaaaagaagcugggagaguuuggcaaagccaaggggagcagagccaucugguacauguggcugggcgcucgguuccucgaguuugaagcccugggauucaugaaugaggaucacugguucucccgcgaaaacucucuuagcggcguggagggggagggacugcauaaacucggcuacauucugagagacaucuccaagauccccgggggaaauauguaugcugaugacacagccggcugggauacccggauuacagaagacgaucuucagaacgaggcgaaaaucaccgacauuauggaaccugagcacgcccugcucgcuaagucuaucuuuaaacugacauaccaaaauaaggucgugcgcguucagagacccgccaagaacgggaccgugauggaugucauuagccggcgcgaccagagaggcuccggacaggugggcacguaugggcugaauaccuucacaaacauggaagcucaacucauccggcagauggagagcgagggaaucuuuucuccuuccgaacuggagacccccaaccuugccggcagagugcuggauuggcucgaaaaacaugggguugagcgccugaagcggauggcgauuagcggagacgacugcguggucaaaccgaucgaugacagauucgccacagcucuuaccgcccugaaugauaugggcaaggugcgcaaagacauuccucagugggaacccucuaagggguggaacgauuggcagcaaguuccuuuuuguucccaccacuuccaucagcucaucaugaaggacggccgggagauugugguccccugcagaaaucaggaugagcuggugggacgcgcucgggucagccagggcgccggguggucccugagagaaacggcuugucucggaaaaucuuacgcccaaauguggcagcugauguauuuucaccgccgggaccuuagacuggcggccaacgcuaucugcagcgccgugccuguugauugggugcccacaucccgcaccacauggagcauucaugcccaccaucaguggaugaccacggaggacaugcucucugucuggaaucggguguggaucgaagagaacccguggauggaagauaagacccacguuuccagcuggggcgacgugccuuaccuggggaaaagagaggaccaaugguguggaucucuuaucggccugacagcucgggccaccugggcgacaaauauucaggucgcuaucaaccaggugagacgccuccuggggaaugagaacuaucuggauuacaugaccagcaugaagcgguucaaaaaugaauccgaccccgagggcgcccucugguga

SEQ ID NO: 19060 - RNA, 9879 nt, Artificial Sequence
  derived and/or modified CDS sequence (opt5) from DENV-1__FJ882550__SS-prME
agcgugaccaugcugcucaugcugaugcccaccgcccuugcuuuccaccugacgacccggggcggggaaccucauaugaucgugaccaagcaggaacggggaaaaucccuccuguuuaagaccucugccggcguuaacaugugcacccuuauugccauggaccugggggaacucugugaagauaccaugacguacaaaugcccccgcaucaccgaagcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuuguuacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaugaccacaaucuuugcuggccaucucaaaugcagacugaagauggauaaacuuacccugaaggggaugagcuauguuauguguacgggcucuuucaaacucgagaaggaaguggccgagacacagcacggaaccguccuggugcagauuaaguacgagggcaccgacgcgccgugcaaaaucccuuucuccacacaagaugaaaaggggguuacccagaacggacggcugaucacagcuaaucccauugugacggacaaagagaagccugucaacaucgaagccgagccgcccuuuggcgagagcuauauugugaucggggccggagaaaaagcucuuaagcucucuugguucaagaaaggcagcuccauugggaagauguuugaggccaccgcuagaggcgcccgccggauggcgauccugggagauacagccugggacuucggcucugucgggggaguuuuuaccagcgucggcaaacuggugcaucagaucuucgggacagcuuacggagugcucuuuuccggcgucagcuggaccaugaagauugggaucggcgugcugcuuacguggcugggacucaauucuagauccaccagccugucuaugacauguauugccguuggccuggugacccuuuaccucggggucauggugcaggcugauuccggaugcguuaucaacuggaaaggccgcgaacugaagugugggagcggaauuuucgugacaaaugagguccacaccuggacagaacaauauaaguuucaggccgacuccccuaaacggcugucugcggccaucggcaaggcuugggaggagggggugugcggcauuagaagcgccacccgccucgaaaacaucauguggaaacagaucuccaacgagcugaaucauauucuucuggaaaacgacaugaaguucacgguuguggucggagauguggugggcauccucgcucaggggaaaaagaugauucggccgcaacccauggagcacaaauacucuuggaaaagcuggggaaaggccaagaucauuggcgccgacguccagaauacaaccuuuaucaucgaugggccuaacacccccgaauguccugacgaucagagagcuuggaauauuugggagguugaggacuauggauucggcaucuuuacaaccaacauuuggcugaagcugcgcgauuccuacacacaggugugcgaccaccggcuuaugagcgcggccaucaaagauucuaaggcugugcaugccgacaugggcuauuggauugaauccgagaaaaaugaaacauggaagcucgccagagcuagcuucaucgaggucaagaccuguaucuggcccaaaucucacacacugugguccaacggggugcuggaaagcgagaugauuaucccgaagauuuacggaggcccuaucucucaacauaauuaucgccccggguacuucacccagacagccggaccuuggcaccucggcaaacuggagcuugauuuugaccugugcgaagggaccacgguuguggucgaugagcacugcggaaaccggggccccagccucagaaccacaaccgugacaggcaagauuauccaugaaugguguugccgguccuguacccugccuccccugcgcuucaaaggggaggacggaugcugguacggcauggagaucagaccgguuaaggaaaaggaggaaaaucuugugaaaagcauggucucugcgggguccggagagguggacagcuuuucccucggccugcuguguauuucuaucaugauugaagagguuaugcggagcagauggucccgcaagaugcucaugacggggacacuggcuguguuccuucugcucaucaugggacagcugaccuggaacgaucugauucggcuuugcaucauggucggcgccaaugccucugacagaaugggcauggggacaaccuaucuggcucucauggccaccuuuaaaaugcgcccuauguucgcggugggacugcucuuuagacggcugacaagccgcgaggugcuucugcucacgauuggccugucccuggucgcuucuguugaacuucccaacagccuggaggaacucggggauggacuggccaugggcaucaugauccucaagcugcuuaccgacuuccaaucccaccagcugugggccacacuccugagccugaccuuuauuaaaacaacccuuucucugcauuacgcuuggaagacgauggccauggugcucuccaucgugagccuguucccccucugucugucuacaaccucccagaagaccacauggcuuccuguccugcuggggagccucggaugcaaaccgcugaccauguuucuuauuacagagaauaagaucuggggcagaaaaucuuggccccugaacgaaggcauuauggcuguggggguuguguccauccuccugagcucccuccugaagaacgaugucccucuugccggaccccugaucgcgggcgggaugcugauugccuguuaugugaucagcggaucuagcgcugaccucucccuggagaaagccgcugagguuucuugggaagaggaagccgagcacagcggcgccucccauaauauucuuguggaaguccaggaugacgggacgaugaagaucaaagaugaggagcgggacgauacccugacaauucuccugaaggcuacccuccuggcggugucuggagucuacccucuuagcauccccgccacacuguucgugugguauuuuuggcaaaagaaaaagcagcgcuccggcguucugugggacaccccuucucccccggaaguggagagagcuguccucgaugacggcaucuaccggauuaugcagcgcgggcugcuuggaagaagccaggugggcguugggguguuccaagaaaacgucuuccacacgauguggcacgugacccggggagccgugcugauguaucagggcaaacgccucgagccuuccugggccagcguuaagaaagaccugaucucuuacgggggaggcuggagacuccagggcuccuggaauacaggggaggaaguccaggugauugcuguggagcccggaaagaacccuaagaauguccaaaccgcccccggcacauuuaaaaccccggaaggggaggugggagcgaucgcucuggauuucaagccuggcacaagcgggucucccauuguuaaccgggaaggaaaaaucgugggccuuuacggcaauggggucgugacgaccuccggaacauauguuagcgccauugcccaggcuaaggccucccaggagggcccucugcccgagaucgaagacgagguguuuagaaaacgcaaccugaccaucauggaucuccaucccgggucuggaaagacccggagauaccugccugcgauuguccgcgaagcuaucaagcggaaacuuagaacacugauucucgccccgacgcgcgugguugccagcgagauggcugaagcccugaagggcaugcccauccgguaucaaaccacagcugugaaauccgagcacaccgggaaggagauugucgaccugaugugccaugccacauucaccaugagacuccuuagcccugugcgcgugcccaauuacaacaugaucaucauggaugaagcgcacuuuacggacccuucuuccauugccgcucggggcuauaucagcacaagagucggaaugggcgaggccgcugccauuuucaugaccgccacacccccugggucuguugaggcuuuuccgcagagcaaugcggugauccaggaugaggaacgggacauucccgagcgcuccuggaacucuggauacgaguggaucacagauuucccuggcaaaaccgugugguuuguccccagcaucaaguccgggaaugacauugccaacugucugagaaagaauggaaaacgggugauccagcugucucgcaagacauucgauaccgaauaucagaagacgaagaacaacgacugggacuacguugugacaaccgauauuagcgagaugggcgcuaauuuuagagccgaccgggucaucgauccuagacgcugccucaaacccgugauucugaaggacgggccggaacggguuauccuugccggcccuaugcccgugacagucgcuuccgccgcgcagagacgcggacggauuggcagaaaccauaauaaggagggggaucaguacaucuauaugggacagccccugaacaaugacgaggaucacgcucacuggaccgaagccaaaaugcuccuggacaacaucaauacgccugagggcauuauccccgcccuguucgaaccugagcgcgaaaagagcgcugccauugauggggaguaccggcucagaggagaggcgcgcaaaaccuucguggaacuuaugagacggggcgaccugccggucuggcugucuuauaagguggccuccgagggguuucaauacagcgaucgcagauggugcuucgacggcgaacggaacaaucagguucucgaggaaaacauggauguggagaucuggacaaaagagggagaacgcaagaaacugagaccccgguggcuugacgcuagaaccuauuccgacccucuggcccuccgcgaguuuaaggaguucgcugccggccggagaucugugagcggggaucugauucuggagaucggaaagcucccccagcaucuuacacagcgcgcucaaaaugcccuggacaaccuggucaugcuccacaauuccgaacagggcgggcgggcguacagacaugccauggaggagcugccugauaccaucgaaacacuuaugcugcucgcucugauugccguucugaccggaggcgugacgcucuuuuuccuuucuggccgggggcugggaaaaacaagcaucggccugcucugugugauggcuuccagcguccugcuuuggauggccucuguggagccccacuggauugccgcuuccaucauucuggaauuuuuccucaugguucugcugaucccggagccugaccgccagagaacaccccaggauaaccaacucgcguauguggucaucgggcuucuguuuaugauucugaccguggccgcuaaugagaugggacuccuggaaacaaccaagaaagaccuuggcaucgggcacgucgccguggagaaccaucaccaugccacaaugcuggauguugaccuccacccugcuagcgccuggacgcuguacgcgguggccaccacaauuaucacccccaugaugcggcauacaauugaaaacaccacggcuaauaucucucugaccgccauugcuaaccaggccgcgauccucaugggacuugauaagggcuggccuaucuccaaaauggacauuggcgucccccugcuggcccucgggugcuacagccaggugaauccgcugacacuuaccgcugccguucugaugcucguggcucacuaugccaucauuggaccuggccugcaagcuaaggccacacgcgaggcgcagaagagaaccgccgcugggaucaugaaaaaccccacggucgauggaauuguggccaucgaccuggaucccgugguuuacgacgcuaaguucgaaaaacagcucggccagaucaugcuucugauucuguguacaucucaaauccuccugaugcggaccacaugggcccuuugcgagagcauuacccuggccaccgggccucucacaacgcugugggagggauccccgggcaaguuuuggaauaccacaaucgcggucucuauggcuaacauuuuccgcggcagcuaucuggccggggcuggacucgccuuuucccuuaugaaaagccugggcgggggaagacggggcaccggggcccagggagaaacacugggcgagaaguggaagcgccagcucaaucagcuguccaaaucugaguucaacaucuacaagagaagcggcaucauggagguggaccgguccgaagcuaaagaggggcuuaagagaggagagaccacgcgccacgccgugucucggggcacagcgaaacugagaugguucgucgaacgcaaucucguuaagcccgaggggaaggugauugaucugggauguggcagagggggauggagcuauuacugcgccggccugaaaaaggugaccgaagucaaaggcuauaccaaagggggaccuggccaugaggaacccaucccuauggcuacauacggguggaaccucgugaaacuucacuccggaaaggacgucuuuuucacacccccugagaaaugugauacacugcugugcgacauuggcgagucuagcccgaaucccacgaucgaagaggggagaacccuccgcgugcugaagauggucgaaccuuggcuucggggaaaccaauuuuguauuaagauccugaaucccuacaugccuuccgugguugagacacucgagcagaugcagagaaaacauggcggcaugcuggugcgcaacccccugagcagaaauucuacccacgaaauguauugggucuccugcgggacaggaaacauugugagcgccgugaauaugaccucuagaaugcuccugaaccgcuucacgauggcucaccggaagccgaccuacgagagagaugucgaccuuggcgccgggacacgccauguugcgguggaaccugagguggccaaccuggauaucaucggacagagaauugaaaauaucaaacacgagcauaaguccaccuggcacuaugacgaggauaaccccuacaaaacaugggcuuaucauggcagcuacgaagucaagcccucuggguccgccagcuccauggugaauggaguugugaagcuccugaccaaaccuugggacgucauucccauggugacacaaaucgcuaugaccgauacgacaccuuuuggccagcagcggguuuucaaggagaaaguggacacccgcaccccgaaggccaaaagaggcacagcucaaauuauggaagucacggcccgguggcuuuggggguuucugagcagaaacaagaagccccggaucuguacccgcgaggaguucacaagaaaagugcggucuaaugcggccaucggagcuguuuuuguggacgagaaccaguggaauagcgccaaggaggcugucgaagaugagcgcuucugggaccucgugcagaaagaaagagagcugcacaagcagggcaaaugcgcgaccugcgucuauaacaugauggggaagcgggaaaagaaacugggagaguuuggcaaggccaaagggucccgcgcgauuugguacauguggcucggcgcuagauuccuggaguuugaagcccuuggauucaugaaugaggaucacugguucucucgggaaaacagccuguccggcguggagggggagggacuccauaagcugggcuacauccuucgcgacauuucuaaaaucccugggggaaauauguaugccgaugacacagcuggcugggauaccagaauuacagaagacgaucugcaaaacgaggccaagaucaccgacaucauggaacccgagcacgcucuccuggccacgagcauuuuuaaacugaccuaccagaauaagguugugcggguccagcgcccugcgaagaacgggacagugauggaugugaucuccagacgggaccagcgcggcucuggacaaguuggcaccuaugggcucaauacauucaccaacauggaagcccagcugauuagacagauggagagcgagggaaucuuucuucccuccgaacuggagacgccgaaccucgcugaacgggugcuggauuggcuugagaaauacggcgucgaaagacugaagcgcauggccauuagcggggacgacugugugguuaaaccuaucgaugaccgguucgcuacagcccucaccgcgcugaaugauaugggaaaggugagaaaagacaucccccagugggagccuucuaagggcuggaacgauuggcaacagguccccuuuugcucccaucacuuccaccagcugauuaugaaggacgggcgcgagaucguggucccuugucggaaucaggaugaacucgugggcagagcccgcguuagccaaggagcuggcuggucucugcgggagacagccugccuugggaaauccuaugcucagauguggcagcugauguacuuucauagacgcgaccuccggcuggccgcuaacgccauuuguagcgcggugcccgucgauugggugccgaccuccagaacgaccuggucuauccacgcccaucaccaauggaugacaaccgaagacaugcuuagcguuuggaaucgcguguggauugaggaaaacccuuggauggaggauaagacacaugucuccagcuggggagacgugcccuaucugggcaaacgggaggaccaguggugcgggucucucaucggacugaccgcuagagccacaugggccuccaauauucagguggcuaucaaccagguucggagacugaucggcaaugaaaacuaccucgauuacaugaccagcaugaagcgcuucaaaaaugagggggaccccgaaggcgcccugugguga

SEQ ID NO: 19061 - RNA, 9879 nt, Artificial Sequence
  derived and/or modified CDS sequence (opt5) from DENV-1__FJ882551__SS-prME
agcgugaccaugcugcugaugcugaugcccacagcccuugcuuuccaccugacgacccggggaggggagccucauaugaucgucuccaagcaggaacggggaaagucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaggaacaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaagcugacgguuguggucggagauguggcuggcauucucgcccaggggaaaaagaugauccggccgcaacccauggaguacaaauauagcuggaaguccuggggaaaggccaaaauuaucggcgcugacgugcagaauacaaccuuuaucauugaugggccuaacacccccgaauguccugacgaucagagagcguggaauaucugggaggucgaggacuacggauucggcauuuuuacaaccaacaucuggcugaagcugcgcgauagcuauacgcagguuugcgaccaccggcuuaugucugccgcuauuaaagauuccaaggccgugcacgccgacaugggcuacuggaucgaaagcgagaaaaaugaaacauggaagcucgcuagagccucuuucaucgaggugaagaccuguauuuggcccaaaucccauacacuguggagcaacgggguccuggaaucugagaugaucauuccgaagaucuauggaggcccuaccagccaacacaauuaccgccccggguacuucacacagaccgcgggaccuuggcaucucggcaaacuggagcuugauuuugaccugugcgaagggacgaccgugguuguggaugagcacugcggaaaccggggccccucccucagaacaaccacagucaccggcaagauuauccacgaaugguguugccggagcuguacgcugccuccccugcgcuucaaaggggaggacggaugcugguauggcauggagaucagaccggugaaggaaaaggaggaaaaucuuguuaaaucuaugguguccgcugggagcggagaggucgacuccuuuucucucggccugcuguguauuagcaucaugauugaagaggugaugcgguccagauggucucgcaagaugcucaugacagggacccuggccguuuucuuucuucugaucauuggacagcucacauggaacgaucugauccggcugugcauuauggugggcgccaaugcuagcgacagaaugggcauggggaccaccuaccuugcccugauggcgacauucaaaaugcgcccuauguuugcugucggacuccuguucagacggcucacgucccgcgaggugcugcuucugaccaucggccucucucugguggccagcgucgaacugcccaacucccuugaggaacugggggauggacucgccaugggcaucaugauucugaagcuccugacagacuuucaaagccaucagcuuugggcuacccugcucucucugacauucaucagaaccacguuuucccugcacuaugccuggaaaacaauggcuaugguucuuagcauugugucucuguucccccucugucuguccaccaccagccagaagacaaccuggcucccugugcugcuugggucucugggaugcaagccgcugacaauguuucucaucgccgagaauaaaauuuggggccggaaguccuggccccugaacgaaggcaucauggcggucgggaucgugagcauucuucuguccagccuccugaaaaacgauguuccucucgccggaccccugaucgcuggcgggaugcuuauugccuguuacgugaucucuggaagcuccgcugaccugucucuggagaaggccgccgucgugagcugggaggaagaggcugaacauuccggcgcgucucacaauauucucguugaggugcaggaugacgggacgaugaaaaucaaggaugaagaaagagacgauacccugacaauccuucugaaagccacccuccuggcugucagcggaguguauccucucuccauucccgccacacuguucgucugguacuucuggcaaaagaagaaacagagaucuggcgugcuuugggacaccccuuccccucccgagguugaacgggccgugcuggaugacggcaucuaucgcauuaugcagagagggcugcucggacggucccaggucggcguggggguuuuucaagagaacguguuccauacgauguggcacgucacccgcggagcugugcugauguaccagggcaagagacuugaacccagcugggccucugugaaaaaggaccugaucuccuacgggggaggcuggcggcuccagggcagcuggaauacaggggaggagguucaggucauugcgguggaacccggcaagaauccuaagaaugugcaaaccgcucccggcacauuuaagaccucugagggggaagucggagccaucgcccuggauuucaaaccgggcacauccgggagcccuauugugaacagagagggaaagaucguuggccucuauggcaaugggguggucacgaccuccggaacauacgugucugcuaucgcccaggcgaaagcuagccaggaaggcccccugccugagauugaggacgaaguuuuucgcaagcggaaccuuaccaucauggaucugcaccccggguccggaaaaaccagacgcuaucugcccgccauugugcgggaggccaucaagagaaagcuccgcacacugauucuugcuccuacgcgggucguggccagcgaaauggcugaggcccugaaaggcaugccgaucagauaccaaaccacagcgguuaagucugaacauaccgggaaagagaucguggaccucaugugccacgccacauucaccaugcgccugcugucccccguccgggugccuaauuauaacaugauuaucauggaugaggcucauuuuacggaccccagcucuauugccgcuagaggcuacaucagcacacgggugggaaugggcgaagccgccgcuauuuucaugaccgcgaccccucccggguccgucgaggccuuuccucagucuaaugcuguuauccaggaugaggaacgcgacaucccggaaagaagcuggaacuccggauaugaguggauuacagauuuccccggcaagaccgugugguuugugccuucuaucaaaagcgggaaugacauugccaacugucuccggaagaauggaaagcgcgucauccagcuuuccagaaaaacauucgauaccgaguaccaaaagacgaaaaacaacgacugggacuacgugguuacaaccgauauuagcgaaaugggcgccaauuuccgggcugacagagugaucgauccccgccggugccugaagccugucauucugaaagacgggcccgagagagugauccucgccggcccgaugccuguuacaguggcgucugcugcccagcgccggggaagaaucggccgcaaccacaauaaggaaggggaucaguauauuuacaugggacagccccugaacaaugacgaggaucaugcccacuggaccgaggcuaagaugcuucuggacaacaucaauacgcccgaaggcauuaucccugcccucuuugagcccgaacgggagaaauccgcggccauugauggggaauauagacugcgcggagaggcuagaaagaccuucgucgagcugaugcggcgcggcgaccucccuguguggcuuagccacaaagucgccuccgaaggguuucaauacucugauagacgguggugcuucgacggcgagcgcaacaaucaggugcuggaagagaacauggauguugaaaucuggacaaaggagggagagcgcaagaagcugcggccgagauggcucgacgcucgcaccuauagcgacccccuggcccuucgggaauuuaaagaguucgcugccggcagacgcuccgugucuggggaucugauccucgaaauuggaaagcugccucagcaucugacacagcgggcgcaaaaugcccucgacaaccuugugaugcugcacaauagcgagcagggcgggagagcuuaccggcaugccauggaggaacugcccgauaccaucgagacacucaugcugcuugcucugauugccguccucaccggaggcguuacgcuguuuuuccuguccggccgcgggcucggaaagacaagcaucggccuucugugugugauggccucuuccgugcugcucuggauggcuagcgucgaaccucacuggauugcggccucuaucauccuggaguuuuuccuuauggugcugcucauucccgaaccggacagacagcggaccccucaggauaaccaacuggcuuauguugugaucgggcugcucuuuaugauucuuaccgucgccgccaaugagaugggacugcuggagacaaccaaaaaggaccucggcaucgggcacguggcugucgaaaaccaucaccaugccgcgaugcuggauguggaccuucaccccgccuccgcuuggacacuguacgccguugcuacgaccauuaucacaccuaugaugcgccauaccauugagaacacaaccgccaauaucagccucacggcgaucgccaaccaggcugccauucugaugggacuggauaaaggcuggcccaucucuaagauggacauuggcgugccucuccuugcucuggggugcuacagccaggucaauccccugacccucacagccgcugugcugaugcuuguugcccacuaugcgaucauuggaccgggccugcaagccaaagcuaccagagaagcccagaagcggacagcugccgggaucaugaagaacccuaccguggauggaaucgucgccauugaccucgaucccgugguguacgacgcgaaauucgagaagcagcugggccagaucaugcugcucauucuuuguacgucccaaauccugcugaugcgcacaaccugggcucucugcgaaucuauuacacuggccaccgggccccuuaccacacugugggagggaagcccuggcaaauuuuggaauacgaccaucgcuguuuccauggccaacaucuucagaggcagcuaucucgccggggcuggacuggccuucucccugaugaagucucucggcgggggacggcgcggcacaggggcgcagggagagacccuuggcgaaaaauggaagagacagcugaaucagcugagcaaguccgaguuuaacacauacaaacggucuggcauuauggaagucgacagaagcgaggccaaggaagggcucaaacgcggagagaccacgaagcacgcugugucccggggcacagccaaacugagaugguucguggagcgcaaucuugucaagccggaagggaagguuaucgaucugggauguggcagagggggauggucuuauuacugcgcuggccucaaaaaggugaccgaggugaaaggcuauaccaaagggggacccggccaugaggagccuauucccauggccacauacggguggaaccuggucaaacugcacagcggaaaggacguguuuuucaucccucccgaaaaaugugauacccuccuuugcgacauuggcgaguccagcccuaauccgacaaucgaggaagggagaacgcugcgcguucugaagaugguggagcccuggcuccggggaaaccaauuuuguauuaagauccugaauccuuacaugcccucugucguggaaacccuugagcagaugcagagaaaacauggcggcaugcugguucgcaacccucucucccggaauagcacacacgagauguauugggugucuugcgggaccggaaacaucgucuccgcggugaauaugacaagcagaaugcugcugaaccgcuucaccauggcccaccggaagcccacguacgaaagagauguggaccucggcgcugggacccgccaugucgccguugagccggaaguggcuaaccuggauauuaucggacagagaauugagaauaucaaacaagaacacaagucuacauggcauuaugacgaggauaacccuuacaaaaccugggccuaucacggcuccuacgaggugaagcccagcggguccgcuagcucuauggucaauggagugguuaaacuucugacaaaacccugggacgugauuccuauggucacccagaucgccaugacagauaccacgcccuuuggccagcaacggguguucaaggaaaaaguugacacacgcaccccuaaggcgaaaagaggcaccgcccagaucauggaggugacagcuaaguggcucuggggguuucugagccggaacaagaaaccgagaauuuguacgcgggaagaguucacccgcaaggucagauccaaugccgcuaucggagccguguuuguugacgaaaaccaguggaacucugccaaagaggcgguggaggaugaacgguucugggaccuuguccaucgcgagagagaacugcacaagcagggcaaaugcgcuacaugcguguauaacaugauggggaagcgggagaagaaacucggagaauuuggcaaggccaaagggagccgcgccauuugguacauguggcugggcgcuagauuccuggaguucgaggcccucggauuuaugaaugaagaucacugguucucccgggagaacucucugagcggcgucgaaggggagggacuucauaagcugggcuacauccuccgcgacauuuccaaaauccccgggggaaauauguaugcugaugacaccgccggcugggauacaagaaucaccgaggacgaucugcaaaacgaagcgaagauuacagacaucauggagccugaacacgcccuucuggcuaaaucuauuuuuaagcucaccuaccagaauaaggugguucgggugcagcgccccgccaaaaacgggacggucauggaugugaucagcagacgggaccagcgcggcuccggacaagugggcaccuaugggcugaauacauucaccaacauggaggcucagcugauuagacagauggaaagcgagggaaucuuuucuccuuccgagcucgaaacacccaaccuggccggccggguucuugauuggcugaagaaacaugggguggagagacucaagcgcauggcgaucagcggagacgacugugucgugaaaccgauugaugaccgguucgccaccgcucugacggcccuuaaugauaugggcaagguuagaaaggacaucccucagugggaacccucuaaaggguggaacgauuggcaacaggugccuuuuugcucccaccacuuccaucagcugauuaugaaggacggccgcgagcucgucgugcccugucggaaucaggaugaacuggucggcagagcucgcgugagccaaggagccggguggucccugcgggagacagcuugccucggaaaaucuuacgcccagauguggcagcugauguauuuucacagacgcgaccuucggcuggcggccaacgcuaucuguagcgccguuccuguggauuggguccccaccuccagaacaaccuggagcauucaugcccaccaucaauggaugacgaccgaggacaugcucucuguguggaaucgcguuuggaucgaagagaacccguggauggaagauaagacacacauuuccagcuggggcgacgugccuuaccuggggaaacgggaggaccaguggugcggaucucuuaucggccugaccgcuagagccacaugggcgaccaauauccaggucgcuauuaaccaggugcggagacuccuggggaaugaaaacuaucuggauuacaugacaagcaugaagcgcuucaagaaugaguccgaccccgagggcgcccucugguga

SEQ ID NO: 19062 - RNA, 9879 nt, Artificial Sequence
  derived and/or modified CDS sequence (opt5) from DENV-1__FJ882552__SS-prME
agcgugaccaugcugcugaugcugaugcccaccgcccuugcuuuccaccugacgaccagaggcggggaaccucauaugauugucuccaagcaggaacggggaaaaucucuccuguuuaagacaagcgccggcguuaacaugugcacccuuauugcgauggaccugggggaguucugugaagauacaaugaccuacaaaugcccgagaaucacagaagcugaacccgacgauguggacuguuggugcaaugccaccgauacgugggugaccuauggaacauguucccaaaccggcgaacacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucucucacauuuauuaagaccacguccagccugcacuaugccuggaagacaauggcuaugguucugucuaucgugucccuuuucccccugugucucagcaccaccucucagaaaacaaccuggcugccugugcuccuggggucccuuggaugcaagccgcugacaauguuucugauugccgagaauaaaaucuggggcagaaagagcuggccccucaacgaaggcauuauggcggucgggaucguguccauccugcuuagcucucugcucaaaaacgauguuccucuggccggaccccucauugcuggcgggaugcugaucgccuguuacgugauuagcggauccucugcugaccuuagccuggagaaggccgccgaggucuccugggaagaggaagcugagcauucuggcgcgagccacaauauccugguggaaguucaggaugacgggacgaugaaaauuaaggaugaggagcgggacgauacccucacaauccugcuuaaggccacccugcucgcuguguccggagucuauccucugucuauccccgccacacucuucgugugguacuucuggcagaaaaagaaacaacgcagcggcguccugugggacaccccuagcccucccgaaguggagagagccguucuugaugacggcauuuaucggaucaugcagcgcgggcugcugggaagaagccaggugggcgucgggguguuucaggaaaacguuuuccauacgauguggcacgugacccggggagcuguccucauguaccaaggcaagcgccuggagcccucuugggccuccgugaaaaaggaccuuauuagcuacgggggaggcuggagacugcagggcucuuggaauacaggggaggaagugcagguuaucgcggucgagcccggaaagaacccuaaaaaugugcagaccgcucccggcacauuuaagaccuccgaaggggaggugggagccauugcccucgauuucaaaccgggcacaagcggguccccuaucgucaaccgggaaggaaagauugugggccuguauggcaaugggguugugacgaccucuggaacauacgucagcgcuaucgcccaagcgaaggcuucccaggagggcccccucccugagaucgaagacgagguguuuagaaagcgcaaccugaccauuauggaucuucaccccgggagcggaaagacccggagauaucugcccgccaucguucgcgaagccauuaaacggaagcugagaacacucauccuggcuccuacgcgcguggucgccucugagauggcugaagcccuuaaaggcaugccgauucgguaccagaccacagcggugaaguccgagcauaccgggaaagagaucguugaccugaugugccacgccacauucaccaugagacuccugagccccgugcgcgucccuaauuauaacaugaucauuauggaugaagcucauuuuacggaccccucuagcaucgccgcucggggcuacauuuccacaagagugggaaugggcgaggccgccgcuaucuucaugaccgcgaccccucccgggucuguggaagccuuuccucaaagcaaugcugucauucaggaugaggaacgggacaucccggagcgcuccuggaacucuggauaugaguggaucacagauuuccccggcaagaccguuugguuugugccuagcauuaaguccgggaaugacaucgccaacugucugcgcaaaaauggaaagcgggugauucagcucagccgcaaaacauucgauaccgaauaccagaagacgaaaaacaacgacugggacuacgucgugacaaccgauaucucugagaugggcgccaauuucagagcugaccggguuauugaucccagacgcugccuuaagccugugauccugaaggacgggcccgaacgggucauucuggccggcccgaugccugugacaguugcguccgcugcccaaagacgcggacggaucggcagaaaccacaauaaagagggggaucaguauaucuacaugggacagccccucaacaaugacgaggaucaugcccacuggaccgaagcuaagaugcugcuugacaacauuaauacgcccgagggcaucauuccugcccuguuugaacccgagcgcgagaaauccgcggccaucgauggggaguaucggcucagaggagaggcucgcaagaccuucguggaacugaugagacggggcgaccugccugucuggcucuccuacaaaguggccucugagggguuucaguauagcgaucgcagauggugcuucgacggcgaacggaacaaucaaguccuugaggaaaacauggauguggagauuuggacaaaggagggagaacgcaaaaagcugagaccgcgguggcuggacgcuagaaccuacuccgacccccucgcccugcgcgaguuuaaggaguucgcugccggccggagaucuguuagcggggaucuuauccuggagaucggaaaacucccucagcaccugacacagcgcgcgcagaaugcccuggacaaccucgugaugcuucauaauuccgaacaaggcgggcgggcuuauagacacgccauggaggagcugcccgauaccauugaaacacugaugcuccuggcucuuaucgccgugcugaccggaggcgucacgcucuuuuuccugagcggccgggggcugggaaagacaucuauuggccuccuuuguguuauggccuccagcgugcugcuguggauggcuucuguggagccucauuggaucgcggccuccauuauccucgaauuuuuccugaugguccuucugauccccgagccggaccgccagagaaccccucaggauaaccagcucgcuuacgugguuauugggcugcuguuuaugauccucaccguggccgccaaugagaugggacuucuggaaacaaccaaaaaggaccugggcauugggcacgucgcuguggagaaccaccaucacgccgcgaugcucgaugucgaccugcaucccgccagcgcuuggacacuuuacgccguggcuacgaccaucauuacaccuaugaugcggcacaccaucgaaaacacaaccgccaauauuucucugacggcgaucgccaaccaagcugccauccucaugggacuggauaaaggcuggcccauuagcaagauggacaucggcguuccucugcucgcucuugggugcuauucccaggugaauccccugacccugacagccgcuguccucaugcugguggcccauuacgcgauuaucggaccgggccuucaggccaaggcuacccgcgaggcccagaaaagaacagcugccgggauuaugaagaacccuaccguugauggaaucguggccaucgaccuggaucccgucguguaugacgcgaaauucgaaaagcagcucggccagauuaugcugcugauccucuguacgucucagauucuucugaugcggacaaccugggcucugugcgagagcaucacacucgccaccgggccccugaccacacuuugggagggauccccuggcaaauuuuggaauacgaccauugcugugagcauggccaacaucuuccgcggcuccuaccuggccggggcuggacucgccuucucucugaugaagucccugggcgggggaagacggggcacaggggcgcaaggagaaacccucggcgagaaguggaaacgccagcuuaaucagcuguccaagucugaauuuaacacauauaaaagaagcggcaucauggagguugaccgguccgaagccaaggaggggcugaaaagaggagagaccacgaaucacgcugucucucgcggcacagccaagcuccggugguucguggaaagaaaccuggugaagccggaggggaaagucauugaucuuggauguggccgcgggggauggagcuacuauugcgcuggccugaagaaaguuaccgaagugaagggcuacaccaaagggggacccggccacgaggaaccuauccccauggccacauacggguggaaucucgugaagcugcauuccggaaaagacgucuuuuucauuccucccgagaagugugauacccugcucugcgacaucggcgagagcucuccuaacccgacaauugaagaggggcggacgcuuagagugcugaagaugguugaacccuggcugcgcggaaaucaguuuuguaucaaaauucucaacccuuauaugcccuccguggucgagacccuggagcaaaugcagcggaagcacggcggcaugcuugugagaaauccucugagccgcaacucuacacaugaaauguacuggguuuccugcgggaccggaaauaucgugagcgcggucaacaugacaucucggaugcuccugaacagauucaccauggcccaccgcaaacccacguaugagcgggauguggaccugggcgcugggaccagacacguggccgucgaaccggagguugcuaaucucgauaucauuggacagcgcaucgaaaacauuaagcaugagcacaaauccacauggcauuacgacgaggauaauccuuauaagaccugggccuaccacggcagcuaugaagugaagcccuccgggagcgcuucuagcauggugaacggagucgugaaacugcuuacaaagcccugggacguuaucccuauggugacccagauugccaugacagauaccacgcccuuuggccaacagagagucuucaaagagaagguggacacacggaccccuaaagcgaagcgcggcaccgcccagaucauggaaguuacagcuaaguggcuguggggguuucucuccagaaauaaaaagccgcggaucuguacgagagaggaguucacccggaaagugcgcucuaacgccgcuauuggagccgucuuuguggacgagaaucaauggaacagcgccaaggaggcgguugaagaugagagauucugggaccuggugcaucgggaacgcgagcuucacaaacagggcaagugcgcuacaugcgucuacaauaugauggggaagagagagaaaaagcugggagaguuuggcaaagccaaggggucccgggccaucugguacauguggcucggcgcucgcuuccuggaguucgaagcccugggauuuaugaacgaggaucacugguucucuagagaaaauagccucuccggcguggagggggagggacugcauaaacuuggcuauauucugcgggacaucucuaagauucccgggggaaacauguacgcugaugacaccgccggcugggauacacgcaucaccgaagacgaucuccagaaugaggcgaaaaucacagacauuauggaaccugagcacgcccugcuugcuaagagcaucuuuaagcugaccuaucagaacaaagucgugagaguucaacggcccgccaagaaugggacggugauggaugucauuucccgcagagaccagcggggcagcggacaggugggcaccuacgggcucaacacauucaccaacauggaagcucagcugauccgccaaauggagucugagggaaucuuuuccccuagcgaacuggagacacccaaucucgccagacgggugcuggauuggcuugaaaaacauggcguugagagacugaagcgcauggcgaucucuggggacgacuguguggucaaaccgaucgaugaccgguucgccaccgcucucacggcccugaacgauaugggaaaggugagaaaggacauuccucagugggaacccuccaaaggcuggaaugauuggcagcagguuccuuuuugcagccaccacuuccaucaacuuaucaugaaggacgggcgcgagauugugguccccugucggaaccaggaugagcuggugggcagagcucgcgucucccagggagccggcuggucucuccgggaaacagcuugccuggggaaaagcuaugcccagauguggcaacugauguacuuucacagacgcgaccuccggcuggcggccaaugcuaucuguuccgccgugccuguugauugggugcccaccagcagaacaaccuggucuauucaugcccaccaucaguggaugacgaccgaggacaugcuuuccgucuggaaccgcguguggaucgaagagaauccguggauggaagauaagacacacauuagcucuuggggagacguuccuuaucugggcaaacgggaggaccaguggugcgggagccucaucggacugaccgcuagagccacaugggcgaccaacauccaaguggcuauuaaucagguccggagacuuaucggcaacgagaauuaccuggauuacaugacauccaugaagcgcuucaagaacgaaucugaccccgagggggcccucugguga

SEQ ID NO: 19063 - RNA, 9879 nt, Artificial Sequence
  derived and/or modified CDS sequence (opt5) from DENV-1__FJ882553__SS-prME
agcgugaccaugcugcucaugcugaugcccaccgcccuugcuuuccaccugacgaccagaggaggggaaccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucagaaagggcagcuccauugggaaaauguuugaggcuaccgcccgcggcgcucggagaauggccauccugggagauacagcgugggacuucggcucuaucgggggaguuuuuaccagcgucggcaagcuggugcaucagauuuucgggacggccuacggagugcucuuuuccggcgucagcuggaccaugaaaaucgggauuggcgugcugcuuacauggcugggacucaauucucgcuccaccagccugucuaugacauguaucgcuguuggccuggugacccuuuaccucggggucauggugcaggccgauuccggaugcguuauuaacuggaagggccgggaacugaaaugugggagcggaaucuucgugacaaaugagguccacaccuggacggaacaauauaaguuucaggcugacuccccuaagagacugucugccgcgauuggcaaagccugggaggagggggugugcggcauccgcagcgcuacacggcucgaaaacaucauguggaagcagauuuccaacgagcugaaucauauccuucuggaaaacgacaugaaauucaccguuguggucggagauguggccggcauucucgcucaggggaagaaaaugaucagaccgcaacccauggaguacaaguauucuuggaaaagcuggggaaaggccaagauuaucggcgccgacgugcagaauaccacauuuaucauugaugggccuaacacccccgaauguccugacgaucagcgcgcuuggaauaucugggaggucgaggacuacggauucggcauuuuuacgacaaacaucuggcugaaacugcgggauuccuauacccagguuugcgaccacagacuuaugagcgcggccauuaaggauucuaaagcugugcacgccgacaugggcuacuggaucgaauccgagaagaaugaaacauggaaacucgcccgcgcuagcuucaucgaggugaagaccuguauuuggcccaagucucauacacugugguccaacgggguccuggaaagcgagaugaucauuccgaaaaucuauggaggcccuauuucucaacacaauuaccggcccggguacuucacccagacggccggaccuuggcaucucggcaagcuggagcuugauuuugaccugugcgaagggaccacagugguuguggaugagcacugcggaaacagaggccccagccuccggaccacaaccgucacgggcaaaaucauccacgaaugguguugccgcuccuguacacugccuccccugagauucagaggggaagacggaugcugguauggcauggagauucggccggugaaggaaaaagaggaaaaucuuguuaagagcauggugucugcgggguccggagaggucgacagcuuuucccucggccugcuguguaucucuauuaugaucgaagaggugaugcgcagccggugguccagaaagaugcucaugaccgggacacuggcuguuuucuuucuucugauuaugggacagcucaccuggaacgaucugauccgccugugcauuauggugggcgccaaugccucugacagaaugggcauggggaccacauaccuugcucugauggccacguucaaaaugcggccuauguuugcggucggacuccuguuccgcagacucaccagccgggaggugcugcuucugacaaucggccucucccugguggcuucugucgaacugcccaacagccuugaggaacugggggauggacucgccaugggcaucaugauucugaagcuccugaccgacuuucaaucccaucagcuuugggccacacugcucagccugaccuucaucaaaacgacauuuucucugcacuaugcuuggaagaccauggccaugguucuuuccauugugagccuguucccccucugucugucuaccacaucccagaaaaccacauggcucccugugcugcuugggagccugggaugcaagccgcugacgauguuucucaucgcugagaauaagauuuggggccgcagaucuuggccccugaacgaaggcaucauggccgucgggaucguguccauucuucugagcucccuccugaaaaacgauguuccucucgcgggaccccugaucgccggcgggaugcuuauugcuuguuacgugaucagcggaucuagcgccgaccugucccuggagaaggcugccgaggucucuugggaagaggaagccgagcauagcggcgcuucccacaauauucucguggaaguucaggaugacgggaccaugaaaaucaaggaugaggagcgggacgauacacugaccauccuucugaaagcgacacuccuggccgugucuggagucuauccucucagcauucccgcuacccuguucgugugguacuucuggcaaaagaaaaagcagcgcuccggcguccuuugggacacgccuucucccccggaaguggagagagccguucuggaugacggcaucuaucggauuaugcagcgcgggcugcucggaagaagccaggugggcgucgggguguuucaagaaaacguuuuccauaccauguggcacgugacacggggagccguccugauguaccagggcaagagacuugagccuuccugggcuagcgugaaaaaggaccugaucucuuacgggggaggcuggcgccuccagggcuccuggaauaccggggaggaagugcagguuauugccgucgagcccggcaagaacccuaagaaugugcaaacagcgcccggcaccuuuaaaacaccggaaggggaggugggagcuaucgcccuggauuucaagccuggcacgagcgggucucccauugucaaccgggaaggaaagaucgugggccucuauggcaaugggguugugaccacauccggaaccuacgucagcgccaucgcucaggccaaagcgucccaggagggcccucugcccgagauugaagacgagguguuuagaaagcgcaaccuuaccaucauggaucugcaccccgggucuggaaaaacacggagauaucugccugcuauuguucgcgaagccaucaagcggaaacucagaacgcugauucuugccccgacccgcguggucgcuagcgagauggccgaagcucugaagggcaugcccauccgguaccaaacaaccgccgugaaguccgagcauacagggaaagagaucguugaccucaugugccacgcgaccuucacgaugagacugcugagcccugugcggguccccaauuauaacaugauuaucauggaugaagcccauuuuacagacccuucuuccauugcugcccgcggcuacaucagcaccagagugggaaugggcgaggcugccgccauuuucaugaccgcuacacccccugggucuguggaagcguuuccgcagagcaaugccgucauccaggaugaggaacgggacauccccgagcgcuccuggaacucuggauaugaguggauuaccgauuucccuggcaagacaguuugguuugugcccagcaucaaauccgggaaugacauugcuaacugucucagaaagaauggaaaacgggugauccagcuuucuagaaagaccuucgauacggaauaccaaaagaccaagaacaacgacugggacuacgucgugaccacagauauuagcgagaugggcgccaauuuccgcgccgaccggguuaucgauccuagacgcugccugaagcccgugauucugaaagacgggccggaacgggucauccucgcuggcccuaugcccgugaccguugccuccgcggcucagagacgcggacggaucggcagaaaccacaauaaggagggggaucaguauauuuacaugggacagccccugaacaaugacgaggaucaugcccacuggacggaagccaaaaugcuucuggacaacaucaauaccccugagggcauuauccccgcucucuuugaaccugagcgcgaaaagagcgccgcgauugauggggaguauagacugcggggagaggcccgcaagacauucguggaacugaugagacggggcgaccucccggucuggcuuucuuacaaaguggcuuccgagggguuucaauauagcgaucgcagauggugcuucgacggcgaacggaacaaucagguccuggaggaaaacauggauguggagaucuggaccaaggagggagaacgcaaaaagcugcgcccccgguggcucgacgccagaacauacuccgacccucuggcucuuagagaguuuaaagaguucgccgcuggccggagaucuguuagcggggaucugauccucgagauuggaaagcugccccagcaccugacccagcgggcccaaaaugcgcucgacaaccuugugaugcugcauaauuccgaacagggcgggcgcgccuauagacacgcuauggaggagcugccugauacaaucgaaacccucaugcugcuugcccugauugcugugcucacgggaggcgucacacuguuuuuccugucuggccgggggcucggaaaaaccagcaucggccuucuguguguuauggccuccagcgugcugcucuggauggccucuguggagccccauuggauugcugcguccaucauccuggaauuuuuccuuaugguccugcucauuccggagccugaccgccagagaacaccccaggauaaccaacuggccuacgugguuaucgggcugcucuuuaugauucuuacaguggcugccaaugagaugggacugcuggaaaccacaaagaaggaccucggcaucgggcacgucgccguggagaaccaccaucacgcugccaugcuggaugucgaccuucauccugcgagcgccuggacgcuguacgcuguggccaccacaauuaucacccccaugaugcggcacacaauugaaaacaccacggcuaauaucucucucaccgccaucgcgaaccaggccgcuauucugaugggacuggauaaaggcuggccuaucuccaagauggacauuggcguuccccuccuugcccuggggugcuauagccaggugaauccgcugacacucaccgcugccguccugaugcuuguggcucauuacgccaucauuggaccuggccugcaagcgaaagccacacgcgaggcucagaagagaaccgccgcugggaucaugaaaaaccccacgguugauggaaucguggccauugaccucgaucccgucguguaugacgccaaguucgaaaagcagcugggccagaucaugcugcucauucuuuguacaucucaaauccugcugaugcggaccacaugggcgcucugcgagagcauuacccuggcuaccgggccucuuacaacgcugugggagggauccccgggcaaauuuuggaauaccacaaucgccgugucuauggcuaacaucuuccgcggcagcuaccucgccggggccggacuggcuuucucccugaugaaaagccucggcgggggaagacggggcaccggggcccagggagaaacacuuggcgagaaauggaagagacagcugaaucagcuguccaaaucugaauuuaacaccuauaagcgcagcggcauuauggagguugaccgguccgaagcgaaggaggggcucaaaagaggagagacgacaaagcacgccgucucucgcggcaccgcuaaacugcggugguucguggaaagaaaucuugugaagcccgaggggaaagucaucgaucugggauguggccgcgggggauggagcuacuauugcgccggccucaagaagguuaccgaagugaaaggcuacacaaaaggcgggccugggcacgaggaacccauuccuauggcuaccuacggguggaaccuggugaaacugcauuccggaaaggacgucuuuuucauucccccugagaaaugugauacacuccuuugcgacauuggcgagucuagcccgaaucccacgaucgaagaggggcggacccugagagugcugaagaugguugaaccuuggcuccgcggaaaccaauuuuguauuaaaauccugaaucccuauaugccuuccguggucgagacacuugagcagaugcagcggaagcacggcggcaugcuggugagaaacccccucagccgcaauucuacccaugaaauguacuggguuuccugcgggacaggaaacaucgugagcgccgucaauaugaccucucggaugcugcugaacagauucacgauggcgcaccgcaagccgaccuaugagagagauguggaccucggcgccgggacacggcacguggcugucgaaccugagguugccaaccuggauauuaucggacagcgcauugaaaauaucaaacaugagcacaaguccaccuggcauuacgacgaggauaaccccuauaaaacaugggcuuaccacggcagcuaugaagugaagcccucuggguccgccagcuccauggugaauggagucgugaaacuucugaccaagccuugggacguuauucccauggugacacaaaucgcuaugaccgauacgacaccuuuuggccagcagagagucuucaaggagaaaguggacacccggaccccgaaggccaaaagaggcacagcgcaaaucauggaaguuacggccaaguggcucuggggguuucugagccggaacaaaaagccccgcauuuguaccagagaggaguucacacggaaggugcgcucuaaugcugccaucggagcugucuuuguggacgagaaccaguggaauagcgccaaagaggccguugaagaugagagauucugggaccuugugcaucgggaacgcgagcugcacaagcagggcaaaugcgcgaccugcgucuacaacaugauggggaagagagagaaaaagcucggagaguuuggcaaggcuaaagggucccgggccauuugguacauguggcugggcgcccgcuuccuggaguucgaagcucucggauuuaugaaugaggaucacugguucucuagagaaaacagccuguccggcguggagggggagggacuucauaagcugggcuauauccuccgggacauuucuaaaaucccugggggaaauauguacgccgaugacacagcuggcugggauacccgcaucacagaagacgaucugcagaacgaggccagaauuaccgacaucauggaacccgagcacgcgcuucuggccaagagcauuuuuaaacucacguaucaaaauaaggucgugcggguucagcgcccugcuaaaaacgggaccgugauggaugucaucuccagacgggaccagagaggcucuggacaggugggcacauacgggcugaauaccuucacaaacauggaagcccaacugauucgccagauggagagcgagggaaucuuuucccccagcgaacucgagaccccgaaccuggcugaacgggugcuugauuggcuggagaaguauggcguugaaagacucaagcgcauggccaucucuggggacgacuguguggucaaaccuauugaugaccgguucgcgacggcccugacagcucuuaaugauaugggaaaggugagaaaagacaucccccagugggagccuuccaagggcuggaacgauuggcagcaaguucccuuuugcagccaucacuuccaccagcugauuaugaaagacgggcgcgagaucguggucccuugucggaaucaggaugaacucgugggcagagcccgcgucucucagggagcuggcuggucccugcgggagaccgccugccugggaaagagcuacgcucaaauguggcagcucauguauuuucauagacgcgaccugcggcuugccgcgaacgccauuuguuccgcugugcccguugauuggaucccgacaucuagaaccacguggagcauucacgcccaucaccaguggaugaccacagaagacaugcuguccguguggaaucgggucuggaucgaggaaaacccuuggauggaggauaagacccauaucagcucuuggggagacgugcccuaccucggcaaaagagaggaccaauggugcgggucccugauuggacuuacagcccgcgcuaccugggccacaaauauccagguugcgauuaaccaggugcggagacugaucggcaaugaaaacuaccucgauuauaugaccagcaugaagcgcuucaaaaaugagucugaacccgagggggcucugugguga

SEQ ID NO: 19064 - RNA, 9879 nt, Artificial Sequence
  derived and/or modified CDS sequence (opt5) from DENV-1__FJ882554__SS-prME
agcgugaccaugcugcucaugcugaugcccaccgcccuugcuuuccaccugacgaccagaggaggggaaccucauaugaucgucuccaagcaggaacggggaaaaucucuccuguuuaagaccagcgccggcguuaacaugugcacccuuauugcgauggaccugggggagcucugugaagauaccaugaccuacaaaugcccgagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuuccugacacaagaugaaaagggggugacgcagaacggacggcuuaucaccgcgaaucccauugucacagacaaagagaagccugugaacaucgaagcugagccgcccuuuggcgaguccuauauugugaucggggccggagaaaaagcccucaagcugagcugguucaagaaaggcucuagcauugggaagauguuugaggcuaccgccagaggcgcucgccggauggccauccugggagauacagcgugggacuucggcuccaucgggggaguuuuuaccucugucggcaaacucgugcaucagauuuucgggacggccuacggagugcuguuuagcggcgucuccuggaccaugaagaucgggauuggcgugcuucugacauggcucggacugaauagcagaucuaccucccugagcaugacauguaucgcuguuggccuugugacccucuaccugggggucauggugcaggccgauucuggaugcguuauuaacuggaaaggccgcgaacugaaguguggguccggaaucuucgugacaaaugagguccacaccuggacggaacaauauaaguuucaggcugacagcccuaaacggcucuccgccgcgauuggcaaggccugggaggagggggugugcggcaucagaucugcuacacgccuggaaaacaucauguggaaacagauuagcaacgagcuuaaucauauccugcucgaaaacgacaugaaguucaccguuguggucggagauguggccggcauucuggcucaggggaaaaagaugauccggccgcaacccauggaguacaaauauuccuggaagucuuggggaaaggccaaaauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaaacuucgcgauagcuauacccagguuugcgaccaccggcucauguccgcggccauuaaagauagcaaggcugugcacgccgacaugggcuacuggaucgaaucugagaaaaaugaaacauggaagcuggccagagcuuccuucaucgaggugaagaccuguauuuggcccaaaagccauacacuguggucuaacgggguccucgaauccgagaugaucauuccgaagaucuauggaggcccuauuagccaacacaauuaccgccccggguacuucacccaggccgcgggaccuuggcaucugggcaaacuugagcuggauuuugaccucugcgaagggacgaccgugguuguggaugagcacugcggaaaccggggccccucucugagaacaaccacagucaccggcaagaucauccacgaaugguguugccggagcuguacgcugccuccccuucgcuucagaggggaggacggaugcugguauggcauggagauucggccggugaaagaaaaggaggaaaaucucguuaaguccauggugagcgcugggucuggagaggucgacuccuuuagccugggccugcucuguaucuccauuaugaucgaagaggugaugagaucucgcuggagccggagaaugcugaugacagggacccuugccguuuucuuucugcucauuaugggacagcugacauggaacgaucugauccgccuuugcauuauggugggcgccaaugcuuccgacagaaugggcauggggaccaccuaccuggcccucauggcgacauucaaaaugcggccuauguuugcugucggacuccuguuccgcagacugacgucucgggaggugcuucugcucaccaucggccugagccugguggccuccgucgaacuucccaacucucuggaggaacucggggauggacuggccaugggcaucaugauucucaagcugcuuacagacuuucaaagccaucagcugugggcuacccuccugucccugacauucaucaaaaccacguuuagccuucacuaugccuggaagacaauggcuaugguucugucuauugugucccucuucccccugugucucagcaccaccucucagaaaacaaccuggcugccugugcuucuggggucccugggaugcaagccgcucacaauguuucugaucgccgagaauaagauuuggggccgcagaagcuggccccuuaacgaaggcaucauggcggucgggaucgugucuauucugcucuccagccugcucaaaaacgauguuccucuggccggaccccuuaucgcuggcgggaugcugauugccuguuacgugaucuccggaagcucugcugaccugagccucgagaaggccgccgaggucuccugggaagaggaagcugagcauucuggcgcgagccacaauauucugguggaaguucaggaugacgggacgaugaaaaucaaggaugaggagcgggacgauacccuuacaauccugcucaaagccacccugcucgcuguguccggagucuauccucugucuauucccgccacacuuuucgugugguacuucuggcaaaagaaaaagcagcgcagcggcguccugugggacaccccuagcccucccgaaguggagagagccguucuggaugacggcaucuaucggauuaugcagcgcgggcuccugggaagaucucaggugggcgucgggguguuucaagaaaacguuuuccauacgauguggcacgugacccggggagcuguccuuauguaccagggcaagagacuggagcccagcugggccuccgugaaaaaggaccucaucagcuacgggggaggcuggcgccugcagggcucuuggaauacaggggaggaagugcagguuauugcggucgagcccggcaagaacccuaagaaugugcaaaccgcucccggcacauuuaaaaccccggaaggggaggugggagccaucgcccucgauuucaagccuggcacauccgggagccccauugucaaccgggaaggaaagaucgugggccuguauggcaaugggguugugacgaccucuggaacauacgucuccgcuaucgcccaggcgaaagcuagccaggagggcccucuucccgagauugaagacgagguguuuagaaagcgcaaccugaccaucauggaucugcaccccggguccggaaaaacccggagauaucucccugccauuguucgcgaagccaucaagcggaaacugagaacacuuauucuggcuccgacgcgcguggucgccucugagauggcugaagcccucaagggcaugcccauccgguaccaaaccacagcggugaaguccgagcauaccgggaaagagaucguugaccugaugugccacgccacauucaccaugagacugcucuccccugugcggguccccaauuauaacaugauuaucauggaugaagcucauuuuacggacccuuacagcauugccgcucgcggcuauaucucuacaagagugggaaugggcgaggccgccgcuauuuucaugaccgcgacacccccuggguccguggaagccuuuccgcagagcaaugcugucaucaaggaugaggaacgggacauccccgagcgcucuuggaacagcggauacgaguggauuacagauuucccuggcaaaaccguuugguuugugcccuccaucaagucugggaaugacauugccaacugucuucgcaagaauggaaagcgggugauccagcugagcagaaagacauucgauaccgaauaccagaaaacgaagaacaacgacugggacuaugucgugacaaccgauauuuccgagaugggcgccaauuuccgcgcugaccggguuaucgauccuagacgcugccugaaacccgugauucucaaggacgggccggaacgggucauccuggccggcccuaugcccgugacaguugcgucugcugcccaaagacgcggacggaucggcagaaaccacaauaaagagggggaucaguacauuuauaugggacagccccuuaacaaugacgaggaucaugcccacuggaccgaagcuaagaugcugcucgacaacaucaauacgccugagggcauuauccccgcccuguuugaaccugagcgcgaaaagagcgcggccauugauggggaguacagacugcggggagaggcucgcaaaaccuucguggaacucaugagacggggcgaccuuccggucuggcuguccuauaagguggccagcgagggguuucaguacucugaucgcagauggugcuucgacggcgaacggaacaaucaaguccuggaggaaaacauggauguggagaucuggacaaaagagggagaaagaaagaaacuccgcccccgguggcuggacgcuagaaccuauuccgacccucuugcccugcgcgaguuuaaggaguucgcugccggccggagaagcguuuccggggaucucauccuggagauuggaaaacugccccagcaccucacacagcgggcgcagaaugcccuugacaaccuggugaugcugcauaauucugaacaaggcgggcgcgcuuacagacacgccauggaggagcucccugauaccaucgaaacacugaugcuucuggcucucauugccgugcugaccggaggcgucacgcuguuuuuccucagcggccgggggcuuggaaagacauccaucggccugcuguguguuauggccucuagcgugcuccuguggauggcuuccguggagccccauuggauugcggccagcaucauccuugaauuuuuccugaugguccuccugauuccggagccugaccgccagagaacaccccaggauaaccagcuggcuuacgugguuaucgggcuccuuuuuaugauucugaccguggccgccaaugagaugggacugcucgaaacaaccaagaaagaccugggcaucgggcacgucgcuguggagaaccaccaucacgccgcgaugcuugaugucgaccugcauccugccucugcuuggacacucuaugccguggcuacgaccauuaucacacccaugaugcggcacaccauugaaaacacaaccgccaauaucucccugacggcgaucgccaaccaagcugccauucugaugggacucgauaagggcuggccuaucagcaaaauggacauuggcguuccccuucuggcucuggggugcuacucucaggugaauccgcucacccugacagccgcuguccuuaugcugguggcccauuaugcgaucauuggaccuggccuccaggccaaggcuacccgcgaggcccagaaaagaacagcugccgggaucaugaagaaccccaccguugauggaaucguggccauugaccuggaucccgucguguacgacgcgaaguucgaaaaacagcugggccagaucaugcuccuuauucuguguacgucccagauccugcucaugcggacaaccugggcucugugcgagagcauuacacuugccaccgggccucugaccacacucugggagggaucuccgggcaaguuuuggaauacgaccaucgcugugagcauggccaacaucuuccgcggcuccuaucuggccggggcuggacuggccuucucucucaugaaaagccuuggcgggggaagacggggcacaggggcgcaaggagaaacccugggcgagaaguggaaaagacagcugaaucagcucuccaagagcgaauuuaacacauacaagcgcuccggcauuauggagguugaccggucugaagccaaagaggggcugaagagaggagagaccacgaaacacgcugucagccgcggcacagccaaacuucggugguucguggaaagaaaucuggugaaacccgaggggaaggucaucgaucucggauguggccgcgggggaugguccuauuacugcgcuggccugaagaaaguuaccgaagugaagggcuacaccaaagggggaccuggccacgaggaacccauuccuauggccacauauggguggaaccuggugaagcuccauucuggaaaagacgucuuuuucauucccccugagaagugugauacccuucugugcgacaucggcgagagcuccccgaaucccacaaucgaagaggggcggacgcugagagugcucaaaaugguugaaccuuggcugcgcggaaaccaguuuuguauuaagauccuuaaucccuacaugccuucuguggucgagacccuggagcaaaugcagcggaagcacggcggcaugcucgugagaaacccccugagccgcaauuccacacaugaaauguauuggguuagcugcgggaccggaaacaucgugucugcggucaauaugacaucccggaugcugcucaacagauucaccauggcccaccgcaaaccgacguacgagagagauguggaccugggcgcugggacccggcacguggccgucgaaccugagguugcuaaccuugauauuaucggacagcgcauugaaaauaucaagcaugagcacaaaagcacauggcauuaugacgaggauaaccccuacaagaccugggccuaucacggcucuuacgaagugaaacccuccgggagcgcuucuuccauggugaauggagucgugaagcugcucacaaagccuugggacguuauucccauggugacccagaucgccaugacagauaccacgccuuuuggccaacagagagucuucaaagagaagguggacacacggaccccgaaagcgaagagaggcaccgcccagaucauggaaguuacagcuaaauggcuguggggguuucuuagccggaacaagaagccccgcauuuguacgagagaggaguucacccggaaagugcgcuccaaugccgcuaucggagccgucuuuguggacgagaaccaauggaauagcgccaaggaggcgguugaagaugagagauucugggaccuggugcaucgggaacgcgagcuccacaaacagggcaagugcgcuacaugcgucuacaacaugauggggaaaagagaaaagaagcugggagaguuuggcaaagccaaggggucucgggccauuugguauauguggcugggcgcucgcuuccucgaguucgaagcccugggauuuaugaaugaggaucacugguucagcagagaaaacucccuuucuggcguggagggggagggacugcauaaacucggcuacauccugcgggacauuagcaagaucccugggggaaauauguaugcugaugacaccgccggcugggauacacgcaucaccgaagacgaucuucagaacgaggcgagaauuacagacaucauggaacccgagcacgcccugcucgcuaaauccauuuuuaagcugaccuaccagaauaaagucgugcggguucaacgcccugccaagaacgggacggugauggaugucaucucuagacgggaccagagaggcagcggacaggugggcaccuaugggcugaauacauucaccaacauggaagcucagcucauucgccaaauggaguccgagggaaucuuuucucccagcgaacuggagacaccgaaccuugccgaacgggugcuggauuggcucgagaaguacggcguugaaagacugaaacgcauggcgaucuccggggacgacuguguggucaagccuauugaugaccgguucgccaccgcucuuacggcccugaaugauaugggaaaagugagaaaggacaucccccagugggagccuagcaaaggcuggaacgauuggcagcagguucccuuuugcucucaucacuuccaccaacucauuaugaaggacgggcgcgagaucguggucccuugucggaaucaggaugaacuggugggcagagcucgcgucucccagggagccggcuggagccugcgggagacagcuugccucgggaagucuuaugcccagauguggcaacugauguacuuucauagacgcgaccuucggcuggcggccaacgcuauuuguuccgccgugcccguugauuggaucccgaccagcagaacaaccugguccauucacgcccaucaccaguggaugacgaccgaagacaugcucucuguguggaaucgggucuggaucgaggaaaacccuuggauggaggauaaaacacauaucagcuccuggggagacgugcccuaccugggcaagagagaggaccaguggugcgggagccuuauuggacugaccgcucgcgccacaugggcgaccaauauccaaguugcuauuaaccaggugcggagacucaucggcaaugaaaacuaucuggauuacaugacaucuaugaaacgcuucaagaaugaguccgaccccgaaggggcccugugguga

SEQ ID NO: 19065 - RNA, 9879 nt, Artificial Sequence
  derived and/or modified CDS sequence (opt5) from DENV-1__GQ868610__SS-prME
agcgugaccaugcugcucaugcugaugcccaccgcccuugcuuuccaccugacgacccggggcggggaaccucauaugaucgucaccaagcaggaacggggaaaaucccuccuguuuaagaccucugccggcguuaacaugugcacccuuauugcgauggaccugggggaacucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugauuacacuuuaccucgggguuauggugcaggcugauuccggaugcgucaucaacuggaaaggccgcgaacugaagugugggagcggaauuuucgugaccaaugagguucacacauggaccgaacaauauaaguuucaggccgacuccccuaaacggcugucugcggccaucggcaaggcuugggaggagggggugugcggcaucagaagcgccacgcgccucgaaaacauuauguggaaacagaucuccaacgagcugaaucauauucuucuggaaaacgacaugaaguucacagucgugguuggagauguggucggcauccucgcucaggggaaaaagaugauucggccgcaacccauggagcacaaauacucuuggaaaagcuggggaaaggccaagaucaucggcgccgacgugcagaauaccaccuuuauuaucgaugggccuaacacacccgaauguccugacgaucagagagcuuggaauauuugggagguggaggacuauggauucggcaucuuuaccacgaacauuuggcugaagcugcgcgauuccuacacacaggucugcgaccaccggcuuaugagcgcggccaucaaagauucuaaggcuguucaugccgacaugggcuauuggaucgaauccgagaaaaaugaaaccuggaagcucgccagagcuagcuucauugaggugaagacauguaucuggcccaaaucucacacccugugguccaacggggugcuggaaagcgagaugauuaucccgaagauuuacggaggcccuaucucucaacauaauuaucgccccggguacuucacacagaccgccggaccuuggcaccucggcaaacuggagcuugauuuugaccugugcgaagggacgaccgucgugguugaugagcacugcggaaaccggggccccagccucagaacaaccacagugaccggcaagaucauucaugaaugguguugccgguccuguacgcugccuccccugcgcuucaaaggggaggacggaugcugguacggcauggagaucagaccggucaaggaaaaggaggaaaaucuugugaaaagcaugguuucugcgggguccggagagguggacagcuuuucccucggccugcuguguauuucuaucaugauugaagaggucaugcggagcagauggucccgcaagaugcucaugacagggacccuggcuguguuccuucugcucaucaugggacagcugacauggaacgaucugauucggcuuugcaucaugguuggcgccaaugccucugacagaaugggcauggggaccaccuaucuggcucucaucgccacauuuaaaaugcgcccuauguucgcggugggacugcucuuuagacggcugacgagccgcgagguccuucugcucaccauuggccugucccugguggcuucuguggaacuucccaacagccuggaggaacucggggauggacuggccaugggcaucaugauucucaagcugcuuacagacuuccaaucccaccagcugugggccacccuccugagcuuuacauucaucaaaaccacgcugucucuucauuacgcuuggaagacaauggccaugguccuguccauuguuagccucuuuccccugugucucucuaccaccucccagaagacaaccuggcugccugugcuucuggggagccugggaugcaaaccgcucacaauguuccugaucgcugagaauaagaucuggggcagaaaaucuuggccccuuaacgaaggcauuauggccgugggggucguguccauccugcucagcucccugcucaagaacgauguuccucuggcgggaccccuuauugccggcgggaugcugaucgcuuguuaugugauuagcggaucuagcgccgaccugucccucgagaaagcugccgaggucucuugggaagaggaagccgagcacagcggcgcuucccauaauauccugguggaaguucaggaugacgggacgaugaagaucaaagaugaggagcgggacgauacccuuacaauucugcucaaggcgacccugcucgccgugucuggagucuacccucugagcauccccgcuacacuuuuugugugguauuucuggcaaaagaaaaagcagcgcuccggcguccugugggacaccccuucucccccggaaguggagagagccguucuggaugacggcauuuaccggaucaugcagcgcgggcuccugggaagaagccaggugggcgucgggguguuccaagaaaacguuuuucacacgauguggcacgugacccggggagccguccuuauguaucagggcaaacgccuggagccuuccugggcuagcgugaagaaagaccucauuucuuacgggggaggcuggagacugcagggcuccuggaauacaggggaggaagugcagguuaucgccgucgagcccggaaagaacccuaagaaugugcaaaccgcgcccggcacauucaaaaccccggaaggggaggugggagcuauugcccucgauuuuaagccuggcacaagcgggucucccaucgucaaccgggaaggaaaaaucgugggccuguacggcaaugggguugugacgaccuccggaacauaugucagcgccauugcucaggccaaggcgucccaggagggcccucuucccgagaucgaagacgagguguucagaaaacgcaaccugaccauuauggaucugcaucccgggucuggaaagacccggagauaccucccugcuaucguucgcgaagccauuaagcggaaacugagaacacuuauccuggccccgacgcgcguggucgcuagcgagauggccgaagcucucaagggcaugcccauccgguaucaaaccacagccgugaaauccgagcacaccgggaaggagauuguugaccugaugugccaugcgacauuuaccaugagacugcucagcccugugcgcguccccaauuacaacaugaucauuauggaugaagcccacuucacggacccuucuuccaucgcugcccggggcuauauuagcacaagagugggaaugggcgaggcugccgccaucuuuaugaccgcuacacccccugggucuguggaagcguucccgcagagcaaugccgucauccaggaugaggaacgggacauucccgagcgcuccuggaacucuggauacgaguggaucacagauuuuccuggcaaaaccguuugguucgugcccagcauuaaguccgggaaugacaucgcuaacugucuuagaaagaauggaaaacgggugauucagcugucucgcaagacauuugauaccgaauaucagaagacgaagaacaacgacugggacuacgucgugacaaccgauaucagcgagaugggcgccaauuucagagccgaccggguuauugauccuagacgcugccugaaacccgugauccucaaggacgggccggaacgggucauccuggcuggcccuaugcccgugacaguugccuccgcggcucagagacgcggacggauuggcagaaaccauaauaaggagggggaucaguacaucuauaugggacagccccuuaacaaugacgaggaucacgcccacuggaccgaagccaaaaugcugcucgacaacauuaauacgccugagggcaucauucccgcucuguucgaaccugagcgcgaaaagagcgccgcgaucgauggggaguaccggcugagaggagaggcccgcaaaaccuuuguggaacucaugagacggggcgaccuuccggucuggcugucuuauaagguggcuuccgagggguuccaauacagcgaucgcagauggugcuuugacggcgaacggaacaaucagguccuggaggaaaacauggauguggagaucuggacaaaagagggagaacgcaagaaacucagaccccgguggcuggacgccagaaccuauuccgacccucuugcucugcgcgaguucaaggaauuugccgcuggccggagaucuguuagcggggaucucauucuggagaucggaaagcugccccagcaucucacacagcgcgcccaaaaugcgcuugacaaccuggugaugcugcacaauuccgaacagggcgggcgggccuacagacaugcuauggaggagcucccugauaccauugaaacacugaugcuucuggcccucaucgcugugcugaccggaggcgucacgcuguucuuucucucuggccgggggcuuggaaaaacaagcauuggccugcuguguguuauggccuccagcgugcuccuguggauggccucuguggagccccacuggaucgcugcguccaucauucuugaguucuuucugaugguccuccugaucccggagccugaccgccagagaacaccccaggauaaccaacuggccuaugugguuauugggcuccuuuucaugauccugaccguggcugccaaugagaugggacugcucgaaacaaccaagaaagaccugggcauugggcacgucgccguggagaaccaucaccaugcuacaaugcuugaugucgaccugcacccugccagcgcguggacgcucuacgccguggcuaccacaaucauuacccccaugaugcggcauacaaucgaaaacaccacggccaauaucucucugaccgcuauugccaaccaggcggccauccugaugggacucgauaagggcuggccuauuuccaaaauggacaucggcguuccccuucuggcucuggggugcuacagccaggugaauccgcucacacugaccgccgcuguccuuaugcugguggcccacuaugcuauuaucggaccuggccuccaagccaaggcgacacgcgaggcccagaagagaaccgcugccgggaucaugaaaaaccccacgguugauggaauuguggcuaucgaccuggaucccgucguguacgacgccaaguuugaaaaacagcugggccagauuaugcuccuuauccuguguacaucucaaauucugcucaugcggaccacaugggcccugugcgagagcaucacccuugcgaccgggccucugacaacgcucugggagggauccccgggcaaguucuggaauaccacaaucgcugugucuauggccaacauuuuucgcggcagcuaucuggcuggggccggacuggccuucucccucaugaaaagccuuggcgggggaagacggggcaccggggcucagggagaaacacugggcgagaaguggaagcgccagcugaaucagcucuccaaaucugaguucaacaccuacaagagaagcggcaucauggagguugaccgguccgaagccaaagaggggcugaagagaggagagacgacacgccacgcggucucucggggcaccgccaaacuuagaugguuuguggaacgcaaucuggugaagcccgaggggaaggucauugaucucggauguggcagagggggauggagcuauuacugcgcuggccugaaaaagguuaccgaagugaaaggcuauacaaaagggggaccuggccaugaggaacccaucccuauggccaccuacggguggaaccuggugaaacuccacuccggaaaggacgucuucuuuacacccccugagaaaugugauacgcuucugugcgacauuggcgagucuagcccgaaucccaccaucgaagaggggagaacacugcgcgugcucaagaugguugaaccuuggcugcggggaaaccaauucuguauuaagauccuuaaucccuacaugccuuccguggucgagacccuggagcagaugcagagaaaacauggcggcaugcucgugcgcaacccccugagcagaaauucuacacacgaaauguauuggguuuccugcgggaccggaaacaucgugagcgcugucaauaugacgucuagaaugcugcucaaccgcuuuaccauggcccaccggaagccgacauacgagagagauguggaccugggcgcggggacccgccauguggccgucgaaccugagguugcuaaccuugauauuaucggacagagaauugaaaauaucaaacacgagcauaaguccacauggcacuaugacgaggauaaccccuacaaaaccugggccuaucauggcagcuacgaagugaagcccucuggguccgcuagcuccauggugaauggagucgugaagcugcucacaaaaccuugggacguuauucccauggugacccaaaucgccaugacggauacaaccccuuucggccagcagcgggucuuuaaggagaaaguggacacccgcacaccgaaggcuaaaagaggcacggcccaaaucauggaaguuaccgcgaaguggcuguggggguuccuuagccggaacaagaaacccagaauuuguacacgggaggaauuuacccgcaaggugagaucuaaugccgcuaucggagccgucuucguggacgagaaccaguggaauagcgcuaaagaggccguugaagaugagcgguuuugggaccuggugcagaaggaacgcgagcuccacaaacagggcaagugcgccacaugcgucuauaacaugauggggaagagagagaaaaagcugggagaguucggcaaagcgaaggggucccgggcuauuugguacauguggcugggcgcccgcuuucucgaguucgaagcccugggauucaugaaugaggaucacugguuuucuagagaaaacagccuuuccggcguggagggggagggacugcauaaacucggcuacauccugcgggacauuucuaagaucccugggggaaauauguaugcugaugacaccgccggcugggauacacgcaucaccgaagacgaucuucaaaacgaggcuaaaauuacggacaucauggaacccgagcacgcccugcucgcgaccagcauuuucaagcugacauaccagaauaaggucgugagaguucagcggccugccaaaaacgggaccgugauggaugucaucucccgcagagaccagcggggcucuggacaagugggcacauaugggcugaauaccuuuacgaacauggaagcucagcucauucgccagauggagagcgagggaaucuuccugcccuccgaacuugagacaccgaaccuggccgaaagagugcucgauuggcuggagaaguacggcguugaacggcuuaaaagaauggcuaucagcggggacgacuguguggucaagccuauugaugaccgcuuugccaccgcgcugacagcccucaaugauaugggaaaagugcggaaggacaucccccagugggagccuucuaagggcuggaacgauuggcaacagguucccuucugcucccaucacuuucaccagcugauuaugaaagacgggagagagaucguggucccuugucgcaaucaggaugaacuggugggccgggcuagagucagccaaggagccggcuggucucuccgcgagaccgcuugccuggggaaguccuaugcccagauguggcagcuuauguacuuccaucggagagaccugcgccucgcugccaacgcgauuuguagcgccgugcccguugauugggugccgacgucccggaccacauggucuauccacgcucaucaccaauggaugaccacagaagacaugcugagcgucuggaauagaguguggauugaggaaaacccuuggauggaggauaaaacccauguuuccagcuggggagacgugcccuaucuuggcaagcgcgaggaccaguggugcgggucucugaucggacucacagcccgggccaccugggcuuccaauauccaggucgccauuaaccaggugagacggcugaucggcaaugaaaacuaccuggauuacaugacgagcaugaaaagauuuaagaaugagggggaccccgaaggcgcgcucugguga

SEQ ID NO: 19066 - RNA, 9879 nt, Artificial Sequence
  derived and/or modified CDS sequence (opt5) from DENV-1__GQ868611__SS-prME
agcgugaccauguuccugaugcucaugcccaccgcccuggcuuuucaccuuacgaccagaggcggggaaccucauaugaucguguccaagcaggaacggggaaaaucucuccuguucaagacaagcgccggcguuaacaugugcacccugaucgcgauggaccuuggggaacugugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccucgccccucauguggggcugggacuggagaccagaacggaaacauggaugagcuccgagggcgcuuggaaacagauucagcggguugaaaccugggcccuccgccaccccggcuuuacagugaucgcucuguuccuugcccaugcgauugggaccucuaucacccagaagggaaucauuuuuauccugcucaugcuggugacaccuagcauggccaugagaugcgugggcauugggucccgggauuucguugagggacuuagcggcgcuacguggguggacguggugcuggagcacgggucuugugugaccacaauggccaaggauaaacccacccucgacaucgaacugcugaagacagaggucaccaacccugcuguucuccgcaaacugugcauugaagccaagaucuccaauacgacaaccgauagcagauguccgacccaaggagaggcgacacuuguggaagaacaggacgccaacuuugugugccggcgcaccuucgucgauagaggcuggggcaauggguguggacuguuuggcaaagggucucucauuacaugcgcuaaguucaagugcgugacgaaacuggagggaaagaucguucaguacgaaaaccuuaaauauuccgugaucgucaccgugcacacaggcgaccagcaucaaguugggaaugagagcaccgaacacggaacaaccgccacgauuacaccccaagcuccuacaaccgagauccagcugacagacuacggcgcccucacccuggauuguucuccccggacgggccuggacuuuaacgaaauggugcuccugacaaugaaggagaaauccuggcuuguccauaagcagugguuccuggaucucccucugcccuggaccagcggggccuccacaucucaagagaccuggaaucgccaggaccuucuggugaccuuuaaaacagcucacgcgaagaagcaggaagucgugguucucggaagccaagagggcgccaugcacacggcucugaccggggccacagaaauucagaccuccggaacaaccacgaucuucgccggccaucugaaaugcagacucaagauggauaaacugacacuuaaggggaugagcuaugugauguguaccggcucuuucaaacuggagaaggaacucgcugagacccagcacggaacaguccuggugcagauuaaguacgagggcaccgacgccccgugcaaaaucccuuuuuccacacaagaugaaaaggggguuacgcagaacggacggcugaucaccgcgaaucccauugugacagacaaagagaagccugucaacaucgaagcugagccgcccuucggcgagagcuauauugugaucggggccggagaaaaagcccuuaagcucucuugguuuaagaaaggcagcuccauugggaagauguucgaggcuaccgccagaggcgcucgccggauggccauccugggagauacagcgugggacuuuggcucuaucgggggaguguucaccagcguuggcaaacugguccaucagauuuuugggacggccuacggaguccuguucuccggcgugagcuggaccaugaagaucgggauuggcguccugcuuacauggcugggacucaauucuagauccaccagccugucuaugacauguaucgcugugggccugguuacccuuuaccucggggugaugguccaggccgauuccggaugcgugauuaacuggaaaggccgcgaacugaagugugggagcggaaucuuuguuacaaaugaggugcacaccuggacggaacaauauaaguuccaggcugacuccccuaaacggcugucugccgcgauuggcaaggccugggaggagggggucugcggcaucagaagcgcuacacgccucgaaaacaucauguggaaacagauuuccaacgagcugaaucauauccuucuggaaaacgacaugaaguuuaccgugguugugggagaugucgccggcauucucgcucaggggaaaaagaugauccggccgcaacccauggaguacaaauauucuuggaaaagcuggggaaaggccaagauuaucggcgccgacgugcagaauaccacauucaucauugaugggccuaacacccccgaauguccugacgaucagagagcuuggaauaucugggagguggaggacuacggauuuggcauuuucacgacaaacaucuggcugaagcugcgcgauuccuauacccaggucugcgaccaccggcuuaugagcgcggccauuaaagauucuaaggcuguucacgccgacaugggcuacuggaucgaauccgagaaaaaugaaacauggaagcucgccagagcuagcuucaucgaggugaagaccuguauuuggcccaaaucucauacacugugguccaacggggugcuggaaagcgagaugaucauuccgaagaucuauggaggcccuauuucucaacacaauuaccgccccggguacuuuacccagacggccggaccuuggcaucucggcaaacuggagcuugauuucgaccugugcgaagggaccacagucgugguugaugagcacugcggaaaccggggccccagccucagaaccacaaccgugacgggcaagaucauccacgaaugguguugccgguccuguacacugccuccccugcgcuuuagaggggaggacggaugcugguauggcauggagauucggccggucaaagaaaaggaggaaaaucuugucaagagcaugguuucugcgggguccggagagguggacagcuucucccucggccugcuguguaucucuauuaugaucgaagaggucaugagaagccgcuggucccggaaaaugcucaugaccgggacacuggcuguguuuuuccuucugauuaugggacagcucaccuggaacgaucugaucagacugugcauuaugguuggcgccaaugccucugaccgcaugggcauggggaccacauaccuugcucugauggccacguuuaagaugagaccuauguucgcggugggacuccuguuucggcgccucaccagcagagagguccugcuucugacaaucggccucucccugguggcuucuguggaacugcccaacagccuugaggaacugggggauggacucgccaugggcaucaugauucugaaacuccugaccgacuuccaaucccaucagcuuugggccacacugcucagccugaccuuuaucaagacgacauucucucugcacuaugcuuggaaaaccauggccaugguccuuuccauuguuagccuguuuccccucugucugucuaccacaucccagaagaccacauggcucccugugcugcuugggagccugggaugcaagccgcugacgauguuccucaucgcugagaauaaaauuuggggccggcgcucuuggccccugaacgaaggcaucauggccguggggaucgucuccauucuucugagcucccuccugaagaacgaugugccucucgcgggaccccugaucgccggcgggaugcuuauugcuuguuacguuaucagcggaucuagcgccgaccugucccuggagaaagcugccgaggugucuugggaagaggaagccgagcauagcggcgcuucccacaauauucucgucgaagugcaggaugacgggaccaugaagaucaaagaugaggagagagacgauacacugaccauccuucugaaggcgacacuccuggccguuucuggaguguauccucucagcauucccgcuacccuguucgucugguacuuuuggcagaagaagaagcagcgguccggcgugcuuugggacacgccuucucccccggaagucgagcgcgccgugcuggaugacggcaucuauagaauuaugcagcgggggcugcucggacgcagccagguuggcgugggggucuuccaagaaaacguguuucauaccauguggcacguuacaagaggagccgugcugauguaccagggcaaacggcuugagccuuccugggcuagcgucaagaaagaccugaucucuuacgggggaggcuggagacuccagggcuccuggaauaccggggaggaaguccaggugauugccguugagcccggaaagaacccuaaaaauguccaaacagcgcccggcaccuucaagacaccggaaggggaggugggagcuaucgcccuggauuuuaagccuggcacgagcgggucucccauugugaaccgcgaaggaaaaaucgucggccucuauggcaauggggugguuaccacauccggaaccuacgugagcgccaucgcucaggcccgggcgucccaggagggcccucugcccgagauugaagacgaggucuucagaaagcgcaaccuuaccaucauggaucugcaccccgggucuggaaaaacacggagauaucugccugcuauugugcgcgaagccaucaagcggaaacucagaacgcugauucuugccccgacccgcguuguggcuagcgagauggccgaagcucugaagggcaugcccauccgguaccaaacaaccgccgucaaguccgagcauacagggaaagagaucguggaccucaugugccacgcgaccuuuacgaugagacugcugagcccuguucgggugcccaauuauaacaugauuaucauggaugaagcccauuucacagacccuucuuccauugcugcccgcggcuacaucagcaccagagucggaaugggcgaggcugccgccauuuuuaugaccgcuacacccccugggucuguggaagcguucccgcagagcaaugccgugauccaggaugaggaacgggacauccccgagcgcuccuggaacucuggauaugaguggauuaccgauuuuccuggcaagacagucugguucguucccagcaucaaauccgggaaugacauugcuaacugucucagaaagaauggaaaacgggugauccagcuuucuagaaagaccuucgauacggaauaccaaaagaccaagaacaacgacugggacuacguggucaccacagauauuagcgagaugggcgccaauuuucgcgccgaccgggugaucgauccuagacgcugccugaagcccguuauucugaaagacgggccggaacgggugauccucgcuggcccuaugcccgucaccguggccuccgcggcucagagacgcggacggaucggcagaaaccacaauaaggagggggaucaguauauuuacaugggacagccccugaacaaugacgaggaucaugcccacuggacggaagccaaaaugcuucuggacaacaucaauaccccugagggcauuauccccgcucucuucgaaccugagcgcgaaaagagcgccgcgauugauggggaguauagacugcggggagaggcccgcaagacauuuguugaacugaugagacggggcgaccucccgguguggcuuucuuacaaagucgcuuccgagggguuccaauauagcgaucgcagauggugcuuugacggcgaacggaacaaucaggugcuggaggaaaacauggaugucgagaucuggaccaaggagggagaacgcaaaaagcugcgcccccgguggcucgacgccagaacauacuccgacccucuggcucuuagagaguucaaagaauuugccgcuggccggagaucugugagcggggaucugauccucgagauuggaaagcugccccagcaccugacccagcgggcccaaaaugcgcucgacaaccuuguuaugcugcauaauuccgaacagggcgggcgcgccuauagacacgcuauggaggagcugccugauacaaucgaaacccucaugcugcuugcccugauugcugugcucacgggaggcgugacacuguucuuucugucuggccgggggcucggaaaaaccagcaucggccuucugugugucauggccuccagcguucugcucuggauggccucuguggagccccauuggauugcugcguccaucauccuggaguucuuucuuauggugcugcucauuccggagccugaccgccagagaacaccccaggauaaccaacuggccuacgucgugaucgggcuccucuucaugauucuuacaguugcugccaaugagaugggacugcuggaaaccacaaagaaggaccucggcaucgggcacguggccgucgagaaccaccaucacgcugccaugcuggauguggaccuucauccugcgagcgccuggacgcuguacgcugucgccaccacaauuaucacccccaugaugcggcacacaauugaaaacaccacggcuaauaucucucucaccgccaucgcgaaccaggccgcuauucugaugggacuggauaaaggcuggccuaucuccaagauggacauuggcgugccccuccuugcccuggggugcuauagccagguuaauccgcugacacucaccgcugccgugcugaugcuugucgcucauuacgccaucauuggaccuggccugcaagcgaaagccacacgcgaggcucagaagagaaccgccgcugggaucaugaaaaaccccacgguggauggaaucguugccauugaccucgaucccguggucuaugacgccaaguuugaaaagcagcugggccagaucaugcugcucauucuuuguacaucucaaauccugcugaugcggaccacaugggcgcucugcgagagcauuacccuggcuaccgggccucuuacaacgcugugggagggauccccgggcaaauucuggaauaccacaaucgccgugucuauggcuaacaucuuccgcggcagcuaccucgccggggccggacuggcuuuuucccugaugaaaagccucggcgggggaagacggggcaccggggcccagggagaaacacuuggcgagaaauggaagagacagcugaaucagcuguccaaaucugaguucaacaccuauaagcgcagcggcauuauggagguggaccgguccgaagcgaaggaggggcucaaaagaggagagacgacaaagcacgccguuucucgcggcaccgcuaaacugcggugguuugucgaaagaaaucuugugaagcccgaggggaaagugaucgaucugggauguggccgcgggggauggagcuacuauugcgccggccucaagaaggucaccgaaguuaaaggcuacacaaaaggcgggccugggcacgaggaacccauuccuauggcuaccuacggguggaaccuggugaaacugcauuccggaaaggacguguucuuuauucccccugagaaaugugauacacuccuuugcgacauuggcgagucuagcccgaaucccacgaucgaagaggggcggacccugagaguccugaagaugguggaaccuuggcuccgcggaaaccaauucuguauuaaaauccugaaucccuauaugccuuccguuguggagacacuugagcagaugcagcggaagcacggcggcaugcuggucagaaacccccucagccgcaauucuacccaugaaauguacuggguguccugcgggacaggaaacaucguuagcgccgugaauaugaccucucggaugcugcugaacagauuuacgauggcgcaccgcaagccgaccuaugagagagaugucgaccucggcgccgggacacggcacguggcuguggaaccugaggucgccaaccuggauauuaucggacagcgcauugaaaauaucaaacaugagcacaaguccaccuggcauuacgacgaggauaaccccuauaaaacaugggcuuaccacggcagcuaugaaguuaagcccucuggguccgccagcuccauggugaauggaguggucaaacuucugaccaagccuugggacgugauucccaugguuacacaaaucgcuaugaccgauacgacaccuuucggccagcagagaguguuuaaggagaaagucgacacccggaccccgaaggccaaaagaggcacagcgcaaaucauggaagugacggccaaguggcucuggggguuccugagccggaacaaaaagccccgcauuuguaccagagaggaauuuacacggaagguucgcucuaaugcugccaucggagcuguguucgucgacgagaaccaguggaauagcgccaaagaggccguggaagaugagagauuuugggaccuuguucaucgggaacgcgagcugcacaagcagggcaaaugcgcgaccugcguguacaacaugauggggaagagagagaaaaagcucggagaguucggcaaggcuaaagggucccgggccauuugguacauguggcugggcgcccgcuuccuggaguuugaagcucucggauucaugaaugaggaucacugguuuucuagagaaaacagccuguccggcgucgagggggagggacuucauaagcugggcuauauccuccgggacauuucuaaaaucccugggggaaauauguacgccgaugacacagcuggcugggauacccgcaucacagaagacgaucugcagaacgaggccagaauuaccgacaucauggaacccgagcacgcgcuucuggccaagagcauuuucaaacucacguaucaaaauaaggugguccgggugcagcgcccugcuaaaaacgggaccguuauggaugugaucuccagacgggaccagagaggcucuggacaggucggcacauacgggcugaauaccuuuacaaacauggaagcccaacugauucgccagauggagagcgagggaaucuucucccccagcgaacucgagaccccgaaccuggcugaacgggugcuugauuggcuggagaaguauggcguggaaagacucaagcgcauggccaucucuggggacgacuguguugugaaaccuauugaugaccgguuugcgacggcccugacagcucuuaaugauaugggaaaggucagaaaagacaucccccagugggagccuuccaagggcuggaacgauuggcagcaagugcccuucugcagccaucacuuucaccagcugauuaugaaagacgggcgcgagaucguugugccuugucggaaucaggaugaacucgucggcagagcccgcgugucucagggagcuggcuggucccugcgggagaccgccugccugggaaagagcuacgcucaaauguggcagcucauguauuuccauagacgcgaccugcggcuugccgcgaacgccauuuguuccgcuguccccguggauuggaucccgacaucuagaaccacguggagcauucacgcccaucaccaguggaugaccacagaagacaugcuguccguuuggaaucggguguggaucgaggaaaacccuuggauggaggauaagacccauaucagcucuuggggagacguccccuaccucggcaaaagagaggaccaauggugcgggucccugauuggacuuacagcccgcgcuaccugggccacaaauauccagguggcgauuaaccagguucggagacugaucggcaaugaaaacuaccucgauuauaugaccagcaugaagcgcuuuaaaaaugagucugaccccgaaggggcucugugguga

SEQ ID NO: 19067 - RNA, 9879 nt, Artificial Sequence
  derived and/or modified CDS sequence (opt5) from DENV-1__FJ882555__SS-prME
uccgugacaaugcugcugaugcugaugcccacagcccuugcuuuccaccugacgacccggggaggggagccucauaugauugucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaggaacaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucugcgagccaagagacauggaaucgccaggaccuucuggugaccuuuaaaacagcccacgcuaagaagcaggaagucgugguucucggaucccaagagggcgccaugcacaccgcccugaccggggcuacagaaauucagacgagcggaaccacaaccaucuucgccggccaucugaaaugcagacucaagauggauaaacugacacuuaaggggaugucuuaugugauguguaccggcuccuucaaacuggagaaggaagucgcggagacgcagcacggaacagugcucguucagauuaaguacgagggcaccgacgcuccgugcaaaaucccuuuuagcacccaagaugaaaagggggugacacagaacggacggcugaucaccgccaaucccauugucacagacaaagagaagccugugaacaucgaagccgagccgcccuucggcgagucuuauauugugaucggggcuggagaaaaagcccugaaacuuagcugguuuaagaaaggcuccucuauugggaagauguucgaggcuacggccagaggcgcgcgccggauggccauccucggagauaccgcuugggacuuuggcagcaucgggggaguuuucacauccgucggcaaacuggugcaucagauuuuugggaccgccuacggagugcuguucagcggcgucucuuggacaaugaagaucgggauuggcgugcuccugaccuggcuuggacucaauuccagaagcacgucucucuccaugaccuguaucgcuguuggccuggugacacuguaccuuggggucauggugcaggccgauagcggaugcguuauuaacuggaaaggccgcgaacucaaguguggguccggaaucuuugugaccaaugagguccacacauggaccgaacaauauaaguuccaggcggacucuccuaaacggcugagcgccgcuauuggcaaggccugggaggagggggugugcggcaucagauccgcuacacgccuggaaaacaucauguggaaacagauuucuaacgagcucaaucauauccugcuugaaaacgacaugaagcugaccguuguggucggagauguggccggcauucucgcccaggggaaaaagaugauccggccgcaacccauggaguacaaauauagcuggaaguccuggggaaaggcuaaaauuaucggcgcggacgugcagaauacgacauuuaucauugaugggcagaacaccccugaaugucccgacgaucagagagccuggaauaucugggaggucgaggacuacggauucggcauuuuuaccacaaacaucuggcugaagcugcgcgauagcuauacccaaguuugcgaccaccggcuuaugucugcugccauuaaagauuccaaggccgugcacgcugacaugggcuacuggaucgaaagcgagaaaaaugaaacguggaagcucgccagagcgucuuucaucgaggugaagacauguauuuggccuaaaucccauacccuguggagcaacgggguccuggaaucugagaugaucauucccaagaucuauggaggcccgauuagccagcacaauuaccgcccuggguacuucacacagaccgcuggacccuggcaucucggcaaacuggagcuugauuuugaccugugcgaagggacaaccgugguuguggaugagcacugcggaaaccggggcccuucccucagaacgaccacagucaccggcaagaucauccacgaaugguguugccggagcuguacacugcccccucugcgcuucaaaggggaggacggaugcugguauggcauggagauuagacccgugaaggaaaaggaggaaaaucuuguuaaaucuaugguguccgccgggagcggagaggucgacuccuuuucucucggccugcuguguaucagcauuaugaucgaagaggugaugcgguccagauggucucgcaagaugcucaugaccgggacgcuggccguuuucuuucuucugauuaugggacaacucacauggaacgaucugauccggcugugcauuauggugggcgcuaaugccagcgacagaaugggcauggggaccacauaccuugcgcugauggcuaccuucaaaaugcgcccgauguuugccgucggacuccuguucagacggcucaccucccgcgaggugcugcuucugacaaucggccucucucugguggccagcgucgaacugccuaacucccuugaggaacugggggauggacucgcuaugggcaucaugauucugaagcuccugacggacuuucagagccaucagcuuugggccacccugcucucuaugacauucaucagaaccacauuuucccugcacuaugcuuggaaaaccauggccaugguucugagcauugugucucuuuucccccugugucucuccacgacaagccagaagaccaccuggcugcccgugcuccuggggucucuuggaugcaagccucugacaauguuucugaucgcggagaauaaaauuuggggccggaaguccuggccgcucaacgaaggcaucauggccgucgggaucgugagcauucugcuuuccagccugcucaaaaacgauguuccccuggcuggaccucucaucgccggcgggaugcugauugcuuguuacgugaucucuggaagcuccgccgaccuuucucuggagaaggccgcugucgugagcugggaggaagaggcggaacauuccggcgccucucacaauauucugguugaggugcaagaugacgggaccaugaaaaucaaggaugaagaaagagacgauacacucacgauccugcuuaaagcuacccugcucgccgucagcggaguguauccccuguccauuccugccacacucuucgucugguacuucuggcagaagaagaaacagagaucuggcgugcugugggacacccccagcccucccgagguugaacgggcugugcuugaugacggcaucuaucgcauuaugcagagagggcugcugggacggucccaagucggcguggggguuuuucaggagaacguguuccauacaauguggcacgucacccgcggagccgugcucauguaccagggcaagagacuggaaccgagcugggcgucugugaaaaaggaccuuaucuccuacgggggaggcuggcggcugcagggcagcuggaauacgggggaggagguucaagucauugcuguggaaccuggcaagaaucccaagaaugugcagaccgccccuggcacauuuaagaccucugagggggaagucggagccaucgcucucgauuucaaacccggcacauccgggagcccgauugugaacagagagggaaagguugugggccuguauggcaauggggucgugaccacauccggaacguacguuucugccaucgcgcaggcuaaagccagccaagaaggcccucuccccgagaucgaggacgaaguguuucgcaagcggaaccugaccauuauggaucuucacccuggguccggaaaaacaagacgcuaucugcccgccaucguccgggaggcuauuaagagaaagcugcgcacccucauccuggcccccacccgggugguugcuagcgaaauggccgaggcgcuuaaaggcaugccuauuagauaccagacaacggccgugaagucugaacauaccgggaaagagaucgucgaccugaugugccacgcuacauucaccaugcgccuccuguccccggugcgggugcccaauuauaacaugaucauuauggaugaggcccauuuuacagacccuagcucuaucgcugccagaggcuacauuagcacccgggucggaaugggcgaagccgcugcgaucuucaugacggccacacccccuggguccguugaggcuuuuccccagucuaaugccgugauucaggaugaggaacgcgacaucccugaaagaagcuggaacuccggauaugaguggaucaccgauuucccgggcaagaccgugugguuuguccccucuauuaaaagcgggaaugacaucgccaacugucugcggaagaauggaaagcgcgugauucaacucuccagaaaaacauucgauaccgaguaccagaagaccaagaacaacgacugggacuacguugugaccacggauaucagcgaaaugggcgcuaauuuccgggccgacagagucauugauccucgccggugccuuaagcccgugauccugaaagacgggccugagagaguuauucuggcgggccccaugccggugacagucgcuucugccgcccagcgccggggaagaaucggccgcaaccacaauaaggaaggggaucaguauaucuacaugggacaaccucucaacaaugacgaggaucaugcucacuggaccgaggccaagaugcugcuugacaacauuaauacacccgaaggcaucauucccgcgcuguuugagccugaacgggagaaauccgccgcuaucgauggggaauauagacuccgcggagaggccagaaagaccuucguggagcugaugcggcgcggcgaccugcccgucuggcucagcuacaaaguggcuuccgaaggguuucaguauucugauagacgguggugcuucgacggcgagcgcaacaaucagguucuugaagagaacauggauguggaaauuuggacgaaggagggagagcgcaagaagcugcggccuagauggcuggacgcccgcaccuacagcgacccgcucgcucugcgggaauuuaaagaguucgccgcgggcagacgcuccgugucuggggaucuuauccuggaaaucggaaagcucccccagcaccugacacaacgggcccagaaugcucuggacaaccucgucaugcuucauaauagcgagcagggcgggagagccuaucggcacgcuauggaggaacugccugauaccauugagacacugaugcuccuggcccuuaucgccguucugaccggaggcgugacacucuuuuuccuguccggccgcgggcugggaaagaccagcauuggccuccuuugugugauggcuucuuccguccugcuguggauggcgagcguggaaccccauuggaucgccgcuucuauuauccucgaguuuuuccugaugguucuucugaucccugaacccgacagacagcggacgccgcaagauaaccagcucgccuacguggucauugggcugcuguuuaugauccucacaguggccgcuaaugagaugggacuucuggagaccaccaaaaaggaccugggcauugggcacgucgccguggaaaaccaccaucacgcggccaugcucgauguugaccugcauccugcuuccgccuggacacuuuacgcuguggccaccacaaucauuacgcccaugaugcgccacaccaucgagaacacaaccgcgaauauuagccugacagccaucgcuaaccaggccgcuauccucaugggacuggauaaaggcuggccuauuucuaagauggacaucggcgucccccugcucgcccuugggugcuauagccaagugaauccucugacccugacggcugccguucucaugcugguggcgcauuacgccauuaucggacccggccuucaggcuaaagccaccagagaagcucagaagcggacagccgccgggauuaugaagaacccgaccgucgauggaaucguggcgaucgaccuggauccugugguuuaugacgcuaaauucgagaagcagcucggccaaauuaugcugcugauccucuguacaucccagauucuucugaugcgcaccacgugggcccugugcgaaucuaucacacucgcuaccgggccccugacaacccuuugggagggaagccccggcaaauuuuggaauaccacaauugccgucuccauggccaacaucuucagaggcagcuaccuggcuggggccggacucgcguucucccugaugaagucucugggcgggggacggcgcggcacgggggcccagggagagacccucggcgaaaaauggaagagacagcuuaaucaacugagcaaguccgaguuuaacacauauaaacggucuggcaucauggaaguggacagaagcgaggcuaaggaagggcugaaacgcggagagaccacaaagcacgccgugucccggggcaccgcuaaacucagaugguucgucgagcgcaaucugguuaagccugaagggaaggugauugaucuuggauguggcagagggggauggucuuacuauugcgccggccugaaaaaggugacggaggucaaaggcuacacaaaagggggaccgggccacgaggagcccaucccuauggcgaccuacggguggaaccucgugaaacugcauagcggaaaggacgucuuuuucauucccccugaaaaaugugauacccugcucugcgacaucggcgaguccagccccaauccuacaauugaggaagggagaacccuucgcgugcugaagauggucgagccguggcugcggggaaaccaguuuuguaucaagauucucaaucccuauaugccuucugugguugaaacacuggagcagaugcagagaaaacacggcggcaugcuugugcgcaacccccugucccggaauagcacgcaugagauguacugggucucuugcgggaccggaaacaucguguccgccgugaauaugacaagcagaaugcuccugaaccgcuucaccauggcucaccggaagccuacauaugaaagagaugucgaccugggcgccgggacccgccacguugcuguggagcccgaaguggccaaccucgauaucauuggacaaagaaucgagaauauuaaacaugaacacaagucuacguggcauuacgacgaggauaacccguauaaaaccugggcuuaccacggcuccuaugaggucaagccuagcggguccgccagcucuauggugaauggaguugugaagcugcuuacaaaacccugggacgucauccccauggugacccagauugcgaugacagauaccacaccuuuuggccagcaacggguuuucaaggaaaaaguggacacccgcacgcccaaggccaaaagaggcacagcucagaucauggaggucaccgccaaguggcuguggggguuucucagccggaacaagaaaccuagaaucuguacccgggaagaguucacacgcaaggugagauccaaugcugccauuggagccguuuuuguggacgaaaaccaguggaacucugcgaaagaggcugucgaggaugaacgguucugggaccuggugcaucgcgagagagaacuucacaagcagggcaaaugcgccacgugcgucuacaacaugauggggaagcgggagaagaaacugggagaauuuggcaaggccaaagggagccgcgcuaucugguacauguggcucggcgccagauuccuggaguucgaggcucugggauuuaugaaugaagaucacugguucucccgggagaacucucucagcggcguggaaggggagggacugcauaaacuuggcuauauucugcgcgacaucuccaaaauucccgggggaaauauguacgccgaugacaccgcgggcugggauacaagaaucaccgaggacgaucuccaaaacgaagccaagaucacagacauuauggagcccgaacacgcucugcuugccaaaucuaucuuuaagcugaccuaucagaauaagguugugcggguccagcgcccugcuaaaaacgggacagugauggaugugauuagcagacgggaccagcgcggcuccggacaaguuggcaccuacgggcucaauacguucaccaacauggaggcccagcugaucagacagauggaaagcgagggaaucuuuucucccuccgagcuggaaacaccuaaccucgcgggccgggcccuggauuggcuugagaagcaugggguggaaagacugaaacgcauggcuaucagcggagacgacugugucgugaagcccaucgaugaccgguucgccaccgcucucacagcccugaaugauaugggcaaaguuagaaaggacauuccgcagugggagccuucuaagggguggaacgauuggcaacaggugcccuuuugcucccaccacuuccaucagcuuaucaugaaagacggccgcgaaauugucgugccuugucggaaucaggaugagcuggucggcagagcucgcgugagccaaggagccggguggucccuccgggagaccgcgugccugggaaagucuuaugcccagauguggcagcugauguacuuucacagacgcgaccuccggcuggcugccaacgccaucuguagcgcuguucccguggauugggucccuacguccagaacaaccuggagcauucaugcccaccaucaauggaugacaaccgaagacaugcuuucuguguggaaucgcguuuggaucgaggaaaaccccuggauggaggauaaaacgcacauuuccagcuggggcgacgugccguaucuggggaagcgggaagaccaguggugcggaucucucaucggccugaccgcgagagcuacaugggccaccaauauccaggucgccauuaaccaggugcggagacuucuggggaaugagaacuaccucgauuacaugacaagcaugaaacgcuucaagaaugaguccgacccugaaggcgcucugugguga

SEQ ID NO: 19068 - RNA, 9879 nt, Artificial Sequence
  derived and/or modified CDS sequence (opt5) from DENV-1__GQ199821__SS-prME
agcgugaccaugcugcucaugcugaugcccaccgcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaagugcccgagaaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauuguugugggccuggucacacuguaccuuggggugaugguucaggccgauagcggaugcgugaucaacuggaagggccgcgaacucaaguguggguccggaauuuuugucaccaaugaggugcacacauggaccgaacaguauaaauuccaagcugacucuccuaagcggcugagcgccgcgaucggcaaagccugggaggaggggguuugcggcauuagauccgcuacgcgccuggaaaacaucauguggaagcagaucucuaacgagcucaaucauauucugcuugaaaacgacaugaaauuuacaguggucgugggagauguggccggcauccuggcucaggggaagaaaaugauucggccgcagcccauggaguacaaguauagcuggaaguccuggggaaaagccaagaucauuggcgccgacguccaaaauaccaccuucaucaucgaugggccuaacacacccgaauguccugacgaucagagagcuuggaauauuugggagguugaggacuacggauuuggcaucuucaccacgaacauuuggcucaaacugcgcgauagcuauacacaggugugcgaccaccggcugaugucugcggccaucaaggauuccaaagcugugcacgccgacaugggcuacuggauugaaagcgagaagaaugaaaccuggaaacuugccagagcuucuuucaucgaggucaaaacauguaucuggcccaagucccauacccucuggagcaacggggugcuggaaucugagaugauuaucccgaaaauuuauggaggcccuaucagccagcacaauuaccgccccggguacuuuacacaaaccgccggaccuuggcaucugggcaagcucgagcuggauuucgaccuuugcgaagggacgaccguuguggucgaugagcacugcggaaaccggggccccucccugagaacaaccacagugaccggcaaaauuauccacgaaugguguugccggagcuguacgcucccuccccugcgcuuuaagggggaggacggaugcugguauggcauggagaucagaccgguuaaggaaaaagaggaaaaucuggugaagucuauggucuccgcggggagcggagagguggacuccuucucucuuggccuccuguguauuagcaucaugauugaagagguuaugcgguccagauggucucgcaaaaugcugaugacagggacccucgcuguguuuuuccugcuuaucaugggacagcugacauggaacgaucucauucggcugugcaucauggucggcgccaaugccagcgacagaaugggcauggggaccaccuaccuggcucuuauggccacauuuaagaugcgcccuauguucgcggugggacugcucuuuagacggcugacgucccgcgaggugcuccugcuuaccauuggccugucucucgucgcuagcguugaacugcccaacucccuggaggaacuuggggauggacuggccaugggcaucaugauccucaaacugcucacagacuuccagagccaucaacugugggccacccuucugucucucacauuuauuaagaccacguucucccugcacuaugcuuggaagacaauggccauggugcugagcaucgugucucuuuuuccccugugucucuccaccaccagccagaaaacaaccuggcugccuguccuccuggggucucuuggaugcaagccgcugacaauguuccugauugcugagaauaaaaucuggggcagaaaguccuggccccucaacgaaggcauuauggccguggggaucguuagcauccugcuuuccagccugcucaaaaacgaugugccucuggcgggaccccucauugccggcgggaugcugaucgcuuguuacgucauuucuggaagcuccgccgaccuuucucuggagaaggcugccgaggugagcugggaagaggaagccgagcauuccggcgcuucucacaauauccugguugaagugcaggaugacgggacgaugaaaauuaaggaugaggagcgggacgauacccucacaauccugcuuaaggcgacccugcucgccgucagcggaguguauccucuguccauccccgcuacacucuucgucugguacuuuuggcagaaaaagaaacaacgcucuggcgugcugugggacaccccuuccccucccgaaguugagagagccgugcuugaugacggcauuuaucggaucaugcagcgcgggcugcugggaagaucccaggucggcguggggguuuuccaggaaaacguguuucauacgauguggcacgucacccggggagccgugcucauguaccaaggcaagcgccuggagcccagcugggcuucugugaaaaaggaccuuauuuccuacgggggaggcuggagacugcagggcagcuggaauacaggggaggaaguucaggucaucgccguggagcccggaaagaacccuaaaaaugugcagaccgcgcccggcacauucaagaccucugaaggggaggucggagcuauugcccucgauuuuaaaccgggcacauccgggagcccuaucgugaaccgggaaggaaagauuguuggccuguauggcaaugggguggucacgaccuccggaacauacgugucugccaucgcucaagccaaagcgagccaggagggcccccucccugagaucgaagacgagguuuucagaaagcgcaaccugaccauuauggaucuucaccccggguccggaaagacccggagauaucugcccgcuaucgugcgcgaagccauuaaacggaagcugagaacacucauccuggccccuacgcgcgucguggcuagcgagauggccgaagcucuuaaaggcaugccgauucgguaccagaccacagccguuaagucugagcauaccgggaaagagaucguggaccugaugugccacgcgacauuuaccaugagacuccugucccccguccgcgugccuaauuauaacaugaucauuauggaugaagcccauuucacggaccccagcucuaucgcugcccggggcuacauuagcacaagagugggaaugggcgaggcugccgccaucuuuaugaccgcuaccccucccggguccgucgaagcguucccucaaucuaaugccguuauucaggaugaggaacgggacaucccggagcgcagcuggaacuccggauaugaguggaucacagauuuucccggcaagaccgugugguucgugccuucuauuaagagcgggaaugacaucgcuaacugucugcgcaagaauggaaagcgggucauucagcucucccgcaaaacauucgauaccgaauaccagaagacgaaaaacaacgacugggacuacgugguuacaaccgauaucagcgagaugggcgccaauuuuagagccgaccgggugauugaucccagacgcugccuuaagccugucauccugaaggacgggcccgaacgggugauucuggcuggcccgaugccuguuacaguggccucugcggcucaaagacgcggacggaucggcagaaaccacaauaaagagggggaucaguauaucuacaugggacagccccucaacaaugacgaggaucaugcccacuggaccgaagccaagaugcugcuugacaacauuaauacgcccgagggcaucauuccugcucuguucgaacccgagcgcgaaaaauccgccgcgaucgauggggaguaucggcucagaggagaggcccgcaagaccuuugucgaacugaugagacggggcgaccugccuguguggcucagcuacaaagucgcuuccgagggguuccaguauucugaucgcagauggugcuuugacggcgaacggaacaaucaagugcuugaggaaaacauggauguugagauuuggacaaaggagggagaacgcaaaaagcugagaccgcgguggcuggacgccagaaccuacagcgacccccucgcucugcgcgaguucaaggaauuugccgcuggccggagauccgugucuggggaucuuauccuggagaucggaaaacucccucagcaccugacacagcgcgcccagaaugcgcuggacaaccucgugaugcuucauaauagcgaacaaggcgggcgggccuauagacacgcuauggaggagcugcccgauaccauugaaacacugaugcuccuggcccuuaucgcuguccugaccggaggcguuacgcuguucuuucuguccggccgggggcugggaaagacaagcauuggccuccuuugugugauggccucuuccgcccugcuguggaucgcuagcguggagccucauuggauugcggccucuaucauccucgaguucuuucugaugguccuucugauucccgagccggaccgccagagaaccccucaggauaaccagcucgcuuacgugguuaucgggcugcuguucaugauucucaccguggccgccaaugagaugggacuucuggaaacaaccaaaaaggaccugggcaucgggcacgucgcuguggagaaccaccaucacgccgcgaugcucgaugucgaccugcaucccgccuccgcuuggacacuuuacgccguggcuacgaccauuaucacaccuaugaugcggcacaccauugaaaacacaaccgccaauaucagccugacggcgaucgccaaccaagcugccauucucaugggacuggauaaaggcuggcccaucucuaagauggacauuggcguuccucugcucgcucuugggugcuauagccaggugaauccccugacccugacagccgcuguccucaugcugguggcccauuacgcgaucauuggaccgggccuucaggccaaggcuacccgcgaggcccagaagagaacagcugccgggaucaugaagaacccuaccguugauggaaucguggccauugaccuggaucccgucguguaugacgcgaaauuugaaaagcagcucggccagaucaugcugcugauucucuguacgucccagauccuucugaugcggacaaccugggcucugugcgagucuauuacacucgccaccgggccccugaccacacuuugggagggaagcccuggcaaauucuggaauacgaccaucgcuguguccauggccaacaucuuccgcggcagcuaccuggccggggcuggacucgccuuuucccugaugaagucucugggcgggggaagacggggcacaggggcgcaaggagaaacccucggcgagaaguggaaacgccagcuuaaucagcugagcaaguccgaguucaacacauauaaaagaucuggcauuauggagguugaccggagcgaagccaaggaggggcugaaaagaggagagaccacgaagcacgcugucucccgcggcacagccaagcuccggugguuuguggaaagaaaucuggugaaaccggaggggaaggucaucgaucuuggauguggccgcgggggauggucuuacuauugcgcuggccugaaaaagguuaccgaagugaaaggcuacaccaaagggggacccggccacgaggaaccuauucccauggccacauacggguggaaccucgugaaacugcauagcggaaaggacgucuucuuuaucccucccgagaagugugauacccugcucugcgacauuggcgaguccagcccuaauccgacaaucgaagaggggcggacgcuuagagugcugaaaaugguugaacccuggcugcgcggaaaccaguucuguauuaagauccucaauccuuauaugcccucuguggucgagacccuggagcaaaugcagcggaaacacggcggcaugcuugugagaaacccucugucccgcaauagcacacaugaaauguacuggguuucuugcgggaccggaaacaucguguccgcggucaauaugacaagccggaugcuccugaacagauuuaccauggcccaccgcaagcccacguaugagcgggauguggaccugggcgcugggaccagacacguggccgucgaaccggagguugcuaaccucgauauuaucggacagcgcauugaaaauaucaaacaugagcacaagucuacauggcauuacgacgaggauaacccuuauaagaccugggccuaccacggcuccuaugaagugaaacccagcggguccgcuagcucuauggugaauggagucgugaagcugcuuacaaaacccugggacguuauuccuauggugacccagaucgccaugacagauaccacgcccuucggccaacagagagucuuuaaggagaaaguggacacacggaccccuaaggcgaagcgcggcaccgcccagaucauggaaguuacagcuaaauggcuguggggguuccucagcagaaacaagaaaccgcggauuuguacgagagaggaauuuacccggaaggugcgcuccaaugccgcuaucggagccgucuucguggacgagaaccaauggaacucugccaaagaggcgguugaagaugagagauuuugggaccuggugcaucgggaacgcgagcuucacaagcagggcaagugcgcuacaugcgucuacaacaugauggggaaaagagaaaagaaacugggagaguucggcaaggccaaagggagccgggccauuugguacauguggcucggcgcucgcuuccuggaguuugaagcccugggauucaugaaugaggaucacugguuuuccagagaaaacucucucagcggcguggagggggagggacugcauaaacuuggcuauauccugcgggacauuuccaaaauccccgggggaaauauguacgcugaugacaccgccggcugggauacacgcaucaccgaagacgaucuccagaacgaggcgaagauuacagacaucauggaaccugagcacgcccugcuugcuaagucuauuuucaaacugaccuaucagaauaaggucgugagaguucaacggcccgccaaaaacgggacggugauggaugucaucagccgcagagaccagcggggcuccggacaggugggcaccuacgggcucaauacauuuaccaacauggaagcucagcugauucgccaaauggagagcgagggaaucuucucuccuuccgaacuggagacacccaaccucgccggcagagugcuggauuggcuugaaaagcaugggguugagcggcugaaaagaauggcgaucagcggagacgacuguguggucaagccgauugaugaccgcuuugccaccgcucucacggcccugaaugauaugggcaaggugcggaaagacaucccucagugggaacccucuaagggguggaacgauuggcagcagguuccuuucugcucccaccacuuucaucaacuuauuaugaaagacggcagagagaucgugguccccugucgcaaucaggaugagcuggugggacgggcuagagucagccagggcgccggguggucccuccgcgaaacagcuugccugggaaagucuuaugcccagauguggcaacugauguacuuccaccggagagaccuccgccuggcggccaacgcuauuuguagcgccgugccuguugauugggugcccaccucccggacaaccuggagcauccaugcccaccaucaguggaugacgaccgaggacaugcuuucugucuggaauagaguguggauugaagagaacccguggauggaagauaaaacacacaucuccagcuggggcgacguuccuuaucuggggaagcgcgaggaccaguggugcggaucucucaucggccugaccgcucgggccacaugggcgaccaauauucaaguggcuaucaaccaggucagacggcuuauugggaaugagaacuaccuggauuacaugacaagcaugaagagauuuaaaaaugaauccgaccccgagggcgcccucugguga

SEQ ID NO: 19069 - RNA, 9879 nt, Artificial Sequence
  derived and/or modified CDS sequence (opt5) from DENV-1__FJ882556__SS-prME
agcgugaccaugcugcucaugcugaugcccaccgcccuugcuuuccaccugacgaccagaggaggggaaccucauaugaucgucuccaagcaggaacggggaaaaucucuccuguuuaagacaagcgccggcguuaacaugugcacccuuaucgcgauggaccugggggaacucugugaagauaccaugaccuacaaaugcccgagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucagcgacaaagagaagccugugaacaucgaagcugagccgcccuuuggcgagucuuauauugugaucggggccggagaaaaagcccuuaagcucagcugguucaagaaaggcuccucuauugggaagauguuugaggcuacagccagaggcgcucgccggauggccauccugggagauaccgcgugggacuucggcagcaucgggggaguuuuuacauccgucggcaaacuggugcaucagauuuucgggaccgccuacggagugcucuuuagcggcgucucuuggacgaugaagaucgggauuggcgugcugcuuaccuggcugggacucaauuccagaagcacaucucuguccaugaccuguaucgcuguuggccuggugacacuuuaccucggggucauggugcaggccgauagcggaugcguuauuaacuggaaaggccgcgaacugaaguguggguccggaaucuucgugaccaaugagguccacacauggaccgaacaauauaaguuucaggcugacucuccuaaacggcugagcgccgcgauuggcaaggccugggaggagggggugugcggcaucagauccgcuacgcgccucgaaaacaucauguggaaacagauuucuaacgagcugaaucauauccuucuggaaaacgacaugaaguucacaguuguggucggagauguggccggcauucucgcucaggggaaaaagaugauccggccgcaacccauggaguacaaauauagcuggaaguccuggggaaaggccaaaauuaucggcgccgacgugcagaauaccaccuuuaucauugaugggccuaacacacccgaauguccugacgaucagagagcuuggaauaucugggaggucgaggacuacggauucggcauuuuuaccacgaacaucuggcugaagcugcgcgauagcuauacacagguuugcgaccaccggcuuaugucugcggccauuaaagauuccaaggcugugcacgccgacaugggcuacuggaucgaaagcgagaaaaaugaaaccuggaagcucgccagagcuucuuucaucgaggugaagacauguauuuggcccaaaucccauacccuguggagcaacgggguccuggaaucugagaugaucauuccgaagaucuauggaggcccuauuagccaacacaauuaccgccccggguacuucacacaggccgcgggaccuuggcaucucggcaaacuggagcuugauuuugaccugugcgaagggaccacggugguuguggaugagcacugcggaaaccggggccccucccucagaaccacaaccgucacaggcaagaucauccacgaaugguguugccggagcuguacccugccuccccugcgcuucagaggggaggacggaugcugguauggcauggagauucggccggugaaagaaaaggaggaaaaucuuguuaagucuaugguguccgcugggagcggagaggucgacuccuuuucucucggccugcuguguaucagcauuaugaucgaagaggugaugagaucccgcuggucucggagaaugcucaugacggggacacuggccguuuucuuucuucugauuaugggacagcucaccuggaacgaucugauccgccugugcauuauggugggcgccaaugcuagcgacagaaugggcauggggacaaccuaccuugcccugauggcgaccuucaaaaugcggccuauguuugcugucggacuccuguuccgcagacucacaucccgggaggugcugcuucugacgaucggccucucucugguggccagcgucgaacugcccaacucccuugaggaacugggggauggacucgccaugggcaucaugauucugaagcuccugaccgacuuucaaagccaucagcuuugggcuacacugcucucucugaccuucaucaaaacaaccuuuucccugcacuaugccuggaagacgauggcuaugguucuuagcauugugucucuguucccccucugucuguccacaaccagccagaaaaccacauggcucccugugcugcuugggucucugggaugcaagccgcugaccauguuucucaucgccgagaauaagauuuggggccgcagauccuggccccugaacgaaggcaucauggcggucgggaucgugagcauucuucuguccagccuccugaaaaacgauguuccucucgccggaccccugaucgcuggcgggaugcuuauugccuguuacgugaucucuggaagcuccgcugaccugucucuggagaaggccgccgaggucagcugggaagaggaagcugagcauuccggcgcgucucacaauauucucguggaaguucaggaugacgggacaaugaaaaucaaggaugaggagcgggacgauacgcugaccauccuucugaaagccacacuccuggcugugagcggagucuauccucucuccauucccgccacccuguucgugugguacuucuggcaaaagaaaaagcagcgcucuggcguccuuugggacacaccuagcccucccgaaguggagagagccguucuggaugacggcaucuaucggauuaugcagcgcgggcugcucggaagaucccaggugggcgucgggguguuucaagaaaacguuuuccauaccauguggcacgugacgcggggagcuguccugauguaccagggcaagagacuugagcccagcugggccucugugaaaaaggaccugaucuccuacgggggaggcuggcgccuccagggcagcuggaauaccggggaggaagugcagguuauugcggucgagcccggcaagaauccuaagaaugugcaaacagcucccggcaccuuuaaaacaccggaaggggaggugggagccaucgcccuggauuucaagccuggcaccucugggucccccauugucaaccgggaaggaaagaucgugggccucuauggcaaugggguugugacaacgagcggaaccuacgucuccgcuaucgcccaggcgaaggcuucucaggagggcccucugcccgagauugaagacgagguguuuagaaagcgcaaccuuacaaucauggaucugcaccccgggagcggaaaaacccggagauaucugccugccauuguucgcgaagccaucaagcggaaacucagaacccugauucuugcuccgacacgcguggucgccuccgagauggcugaagcccugaagggcaugcccauccgguaccaaacgaccgcggugaaaagcgagcauacagggaaagagaucguugaccucaugugccacgccaccuucacaaugagacugcugucuccugugcggguccccaauuauaacaugauuaucauggaugaagcucauuuuaccgacccuuccagcauugccgcucgcggcuacaucucuacgagagugggaaugggcgaggccgccgcuauuuucaugacagcgacacccccugggagcguggaagccuuuccgcaguccaaugcugucauccaggaugaggaacgggacauccccgagcgcucuuggaacagcggauaugaguggauuaccgauuucccuggcaagacaguuugguuugugcccuccaucaaaucugggaaugacauugccaacugucucagaaagaauggaaaacgggugauccagcuuagcagaaagaccuucgauacagaauaccaaaagaccaaaaacaacgacugggacuacgucgugacgacagauauuuccgagaugggcgccaauuuccgcgcugaccggguuaucgauccuagacgcugccugaagcccgugauucugaaagacgggccggaacgggucauccucgccggcccuaugcccgugaccguugcgagcgcugcccagagacgcggacggaucggcagaaaccacaauaaggagggggaucaguauauuuacaugggacagccccugaacaaugacgaggaucaugcccacuggacagaagcuaaaaugcuucuggacaacaucaauaccccugagggcauuauccccgcccucuuugaaccugagcgcgaaaagucugcggccauugauggggaguauagacugcggggagaggcucgcaagacguucguggaacugaugagacggggcgaccucccggucuggcuuuccuacaaaguggccagcgagggguuucaauauuccgaucgcagauggugcuucgacggcgaacggaacaaucagguccuggaggaaaacauggauguggagaucuggaccaaggagggagaacgcaaaaagcugcgcccccgguggcucgacgcuagaacauacucugacccucuggcccuucgcgaguuuaaagaguucgcugccggccggagaagcguuuccggggaucugauccucgagauuggaaagcugccccagcaccugacccagcgggcgcaaaaugcccucgacaaccuugugaugcugcauaauucugaacagggcgggcgcgcuuauagacacgccauggaggagcugccugauacaaucgaaacccucaugcugcuugcucugauugccgugcucacaggaggcgucacccuguuuuuccugagcggccgggggcucggaaaaacguccaucggccuucuguguguuauggccagcucugugcugcucuggauggcuuccguggagccccauuggauugcggccagcaucauccuggaauuuuuccuuaugguccugcucauuccggagccugaccgccagagaacaccccaggauaaccaacuggcuuacgugguuaucgggcugcucuuuaugauucuuaccguggccgccaaugagaugggacugcuggaaaccacaaagaaggaccucggcaucgggcacgucgcuguggagaaccaccaucacgccgcgaugcuggaugucgaccuucauccugccucugcuuggacccuguacgccguggcuacaacgauuaucacccccaugaugcggcacacaauugaaaacaccacagccaauaucucccucaccgcgaucgccaaccaggcugccauucugaugggacuggauaaaggcuggccuaucagcaagauggacauuggcguuccccuccuugcucuggggugcuauucucaggugaauccgcugacgcucaccgccgcuguccugaugcuuguggcccauuacgcgaucauuggaccuggccugcaagccaaagcuacacgcgaggcccagaagagaaccgcugccgggaucaugaaaaaccccacaguugauggaaucguggccauugaccucgaucccgucguguaugacgcgaaguucgaaaagcagcugggccagaucaugcugcucauucuuuguaccagccaaauccugcugaugcggacgacaugggcucucugcgaguccauuacccuggccacagggccucuuaccacccugugggagggaucuccgggcaaauuuuggaauacaacgaucgcugugagcauggccaacaucuuccgcggcuccuaccucgccggggcuggacuggccuucagccugaugaagucccucggcgggggaagacggggcaccggggcgcagggagaaacacuuggcgagaaauggaagagacagcugaaucagcugucuaaaagcgaauuuaacaccuauaagcgcuccggcauuauggagguugaccggucugaagccaaggaggggcucaaaagaggagagacaaccaagcacgcugucagccgcggcacggccaaacugcggugguucguggaaagaaaucuugugaagcccgaggggaaagucaucgaucugggauguggccgcgggggaugguccuacuauugcgcuggccucaagaagguuacagaagugaaaggcuacaccaaagggggaccuggccacgaggaacccauuccuauggccaccuacggguggaaccuggugaaacugcauucuggaaaggacgucuuuuucauucccccugagaaaugugauacacuccuuugcgacauuggcgagagcuccccgaaucccaccaucgaagaggggcggacacugagagugcugaagaugguugaaccuuggcuccgcggaaaccaauuuuguauuaaaauccugaaucccuauaugccuagcguggucgagacgcuugagcagaugcagcggaagcacggcggcaugcuggugagaaacccccucucucgcaauuccacccaugaaauguacuggguuagcugcgggacaggaaacaucgugucugcggucaauaugaccucccggaugcugcugaacagauucacaauggcccaccgcaagccgaccuaugagagagauguggaccucggcgcugggacgcggcacguggccgucgaaccugagguugcuaaccuggauauuaucggacagcgcauugaaaauaucaaacaugagcacaagagcaccuggcauuacgacgaggauaaccccuauaaaacaugggccuaccacggcucuuaugaagugaagcccuccgggagcgcuuccagcauggugaauggagucgugaaacuucugaccaagccuugggacguuauucccauggugacacaaaucgccaugaccgauacaaccccuuuuggccagcagagagucuucaaggagaaaguggacacgcggacaccgaaggcgaaaagaggcaccgcccaaaucauggaaguuaccgcuaaguggcucuggggguuucugucucggaacaaaaagccccgcauuuguacaagagaggaguucacgcggaaggugcgcagcaaugccgcuaucggagccgucuuuguggacgagaaccaguggaacuccgccaaagaggcgguugaagaugagagauucugggaccuugugcaucgggaacgcgagcugcacaagcagggcaaaugcgcuaccugcgucuacaacaugauggggaagagagagaaaaagcucggagaguuuggcaaggccaaagggucucgggccauuugguacauguggcugggcgcucgcuuccuggaguucgaagcccucggauuuaugaaugaggaucacugguucagcagagaaaacucccugucuggcguggagggggagggacuucauaagcugggcuauauccuccgggacauuagcaaaaucccugggggaaauauguacgcugaugacacagccggcugggauacccgcaucacagaagacgaucugcagaacgaggcgagaauuaccgacaucauggaacccgagcacgcccuucuggcuaaguccauuuuuaaacucacauaucaaaauaaggucgugcggguucagcgcccugccaaaaacgggaccgugauggaugucaucucuagacgggaccagagaggcagcggacaggugggcacguacgggcugaauaccuucacaaacauggaagcucaacugauucgccagauggaguccgagggaaucuuuagccccucugaacucgagaccccgaaccuggccgaacgggugcuugauuggcuggagaaguauggcguugaaagacucaagcgcauggcgaucuccggggacgacuguguggucaaaccuauugaugaccgguucgccacagcucugaccgcccuuaaugauaugggaaaggugagaaaagacaucccccagugggagccuagcaagggcuggaacgauuggcagcaaguucccuuuugcucucaucacuuccaccagcugauuaugaaagacgggcgcgagaucguggucccuugucggaaucaggaugaacucgugggcagagcucgcgucucccagggagccggcuggagccugcgggagacggcuugccuggggaaguccuacgcccaaauguggcagcucauguauuuucauagacgcgaccugcggcuugcggccaacgcuauuuguucugccgugcccguugauuggaucccgacaagcagaaccacaugguccauucacgcccaucaccaguggaugaccacggaagacaugcugagcguguggaaucgggucuggaucgaggaaaacccuuggauggaggauaagacccauaucucuuccuggggagacgugcccuaccucggcaaaagagaggaccaauggugcgggagccugauuggacuuacagcucgcgccaccugggcgacaaauauccagguugcuauuaaccaggugcggagacugaucggcaaugaaaacuaccucgauuauaugaccucuaugaagcgcuucaaaaaugagagcgaccccgaaggggcccugugguga

SEQ ID NO: 19070 - RNA, 9879 nt, Artificial Sequence
  derived and/or modified CDS sequence (opt5) from DENV-1__GQ199822__SS-prME
agcgugaccaugcugcucaugcugaugcccacagcccuugcuuuccaccugacgaccagaggaggggaaccucauaugaucgugacaaagcaggaacggggaaaaucccuucuguuuaagaccucugccggcguuaacaugugcacacuuauugcgauggaccugggggaacucugugaagauaccaugacauacaaaugccccagaaucaccgaagcugaacccgacgauguggacuguuggugcaaugccacggauaccugggugacauauggaaccuguagccaaacaggcgaacacagacgggacaagcgcuccguggcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuuguuacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaggacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggcagagccaagaucauuggagccgacguccagaauaccaccuuuaucaucgaugggccuaacacacccgaauguccugacgaucagcgcgcuuggaauauuugggagguugaggacuauggauucggcaucuuuaccacgaacauuuggcugaaacugcgggauuccuacacacaggugugcgaccacagacuuaugagcgcggccaucaaggauucuaaagcugugcaugccgacaugggcuauuggauugaauccgagaagaaugaaaccuggaaacucgcccgcgcuagcuucaucgaggucaagacauguaucuggcccaagucucacacccugugguccaacggggugcuggaaagcgagaugauuaucccgaaaauuuacggaggcccuaucucucaacauaauuaucggcccggguacuucacacagaccgccggaccuuggcaccucggcaagcuggagcuugauuuugaccugugcgaagggacgaccguuguggucgaugagcacugcggaaacagaggccccagccuccggacaaccacagugaccggcaaaauuauccaugaaugguguugccgcuccuguacgcugccuccccugagauucaagggggaggacggaugcugguacggcauggagauccggccgguuaaagaaaaggaggaaaaucuugucaagagcauggucucugcgggguccggagagguggacagcuuuucccucggccugcuguguauuucuaucaugauugaagagguuaugagaagccgcuggucccggaaaaugcucaugacagggacccuggcuguguuccuucugcucaucaugggacagcugacauggaacgaucugauuagacuuugcaucauggucggcgccaaugccucugaccgcaugggcauggggaccaccuaucuggcucucauggccacauuuaagaugagaccuauguucgcggugggacugcucuuucggcgccugacgagcagagaggugcuucugcucaccauuggccugucccuggucgcuucuguugaacuucccaacagccuggaggaacucggggauggacuggccaugggcaucaugauccucaaacugcuuacagacuuccaaucccaccagcugugggccacccuccugagccugacauuuauuaagaccacgcuuucucugcauuacgcuuggaaaacaauggccauggugcucuccaucgugagccuguucccccucugucugucuaccaccucccagaagacaaccuggcuuccuguccugcuggggagccucggaugcaagccgcugacaauguuucuuauuacggagaauaaaaucuggggccggaagucuuggccccugaacgaaggcauuauggcuguggggguuguguccauccuccugagcucccuccugaaaaacgaugucccucuugccggaccccugaucgcgggcgggaugcugauugccuguuaugugaucagcggaucuagcgcugaccucucccuggagaaggccgcugagguuucuugggaagaggaagccgagcacagcggcgccucccauaauauucuuguggaaguccaggaugacgggaccaugaaaaucaaggaugaggagcgcgacgauacacugaccauucuccugaaagcuacacuccuggcggugucuggagucuacccucuuagcauccccgccacccuguucgugugguauuuuuggcaaaagaagaaacagagauccggcguucugugggacacgccuucucccccggaaguggagcgggcuguccucgaugacggcaucuaccgcauuaugcagagagggcugcuuggacggagccaggugggcguugggguguuccaagaaaacgucuuccacaccauguggcacgugacacgcggagccgugcugauguaucagggcaagagacucgagccuuccugggccagcguuaaaaaggaccugaucucuuacgggggaggcuggcggcuccagggcuccuggaauaccggggaggaaguccaggugauugcuguggagcccggcaagaacccuaagaauguccaaacagcccccggcaccuuuaagacaccggaaggggaggugggagcgaucgcucuggauuucaaaccuggcacgagcgggucucccauuguuaacagagaaggaaagaucgugggccuuuacggcaauggggucgugaccacauccggaaccuauguuagcgccauugcccaggcuaaagccucccaggagggcccucugcccgagaucgaagacgagguguuucgcaagcggaaccugaccaucauggaucuccaucccgggucuggaaaaacaagacgcuaccugccugcgcuuguccgggaagcuauuaagagaaagcugcgcacgcucauccuggccccgacccgggugguugccagcgagauggcugaagcccugaaaggcaugcccauuagauaucaaacaaccgcugugaaguccgagcacacagggaaagagaucgucgaccucaugugccaugccaccuucacgaugcgccuucugagcccugugcgggugcccaauuacaacaugauuaucauggaugaagcgcacuuuacagacccuucuuccaucgccgcuagaggcuauauuagcacccgggucggaaugggcgaggccgcugccaucuucaugaccgccacacccccugggucuguugaggcuuuuccgcagagcaaugcggugauucaggaugaggaacgcgacauccccgagagauccuggaacucuggauacgaguggauuaccgauuucccuggcaagacagugugguuuguccccagcaucaaauccgggaaugacaucgccaacugucugcggaagaauggaaagcgcgugauucagcucucuagaaaaaccuucgauacggaauaucaaaagaccaagaacaacgacugggacuacguugugaccacagauaucagcgagaugggcgcuaauuuucgggccgacagagucauugauccucgccggugccugaagcccgugauccuuaaagacgggccggaaagaguuauucuggccggcccuaugcccgugaccgucgcuuccgccgcgcagcgccggggaagaaucggccgcaaccauaauaaggagggggaucaguacauuuauaugggacagccccucaacaaugacgaggaucacgcucacuggacggaagccaagaugcugcuggacaacaucaauaccccugagggcaucauucccgcccucuucgaaccugagcgggagaaaagcgcugccaucgauggggaguacagacuucgcggagaggcgagaaagacauucguggaacugaugcggcgcggcgaccugccggucuggcucucuuauaaaguggccuccgagggguuucaauacagcgauagacgguggugcuucgacggcgaacgcaacaaucagguucuggaggaaaacauggauguggagauuuggaccaaggagggagaacgcaagaaacuucggcccagauggcuggacgcucgcacauauuccgacccucucgcccugcgggaguuuaaagaguucgcugccggcagacgcucugugagcggggaucugauccucgagauuggaaaacuuccccagcaucugacccagcgggcucaaaaugcccuggacaaccucgucaugcugcacaauuccgaacagggcgggagagcguaccggcaugccauggaggagcuuccugauacaaucgaaacccugaugcuccuggcucugaucgccguucucacgggaggcgugacacucuuuuuccugucuggccgcgggcugggaaagaccagcauuggccuccugugugugauggcuuccagcguccuucuguggauggccucuguggagccccacuggaucgccgcuuccauuauccucgaauuuuuccugaugguucugcucauuccggagccugacagacagcggacaccccaggauaaccaacuugcguauguggucaucgggcugcuguuuaugauccucacaguggccgcuaaugagaugggacugcuugaaaccaccaaaaaggaccugggcauugggcacgucgccguggagaaccaucaccaugccacgaugcucgauguugaccugcacccugcuagcgccuggacccuguacgcgguggccacaaccaucauuacacccaugaugcgccauaccaucgaaaacacgaccgcuaauauuucucucacagccaucgcuaaccaggccgcgauucuuaugggacuggauaaaggcuggccuaucuccaagauggacaucggcgucccccugcucgcccuggggugcuacagccaggugaauccgcuuacccugacagcugccguucucaugcugguggcucacuaugccauuaucggaccuggccugcaagcuaaagccaccagagaggcgcagaagcggacggccgcugggauuaugaagaaccccacagucgauggaaucguggccauugaccucgaucccgugguuuacgacgcuaaauucgaaaagcagcuuggccagaucaugcugcugauccucuguaccucucaaauucugcuuaugcgcacaaccugggcccugugcgagagcaucacccucgccacagggccucugacgacccugugggagggauccccgggcaaauuuuggaauacaaccauugcggucucuauggcuaacaucuucagaggcagcuaucucgccggggcuggacuugccuuuucccugaugaaaagccugggcgggggacggcgcggcacaggggcccagggagaaacccucggcgagaaguggaagagacagcugaaucagcuuuccaagucugaguucaacauuuacaaacggagcggcaucauggagguggacagauccgaagcuaaggaggggcugaaacgcggagagacgacacggcacgccgugucuagaggcaccgcgaagcuccgcugguucgucgaacggaaucugguuaaacccgaggggaaggugaucgaucugggauguggcagagggggauggagcuauuacugcgccggccucaagaaagugaccgaagucaagggcuauacaaaagggggaccuggccaugaggaacccauuccuauggcuaccuacggguggaaccuugugaagcugcacuccggaaaagacgucuuuuucacacccccugagaagugugauacgcugcucugcgacaucggcgagucuagcccgaaucccaccauugaagaggggcgcacacugcgggugcuuaaaauggucgaaccuuggcugagaggaaaccaauuuuguaucaagauucucaaucccuacaugccuuccgugguugagacccuggagcagaugcagcgcaagcauggcggcaugcuggugcggaacccccucagcagaaauucuacacacgaaauguauugggucuccugcgggaccggaaacaucgugagcgccgugaauaugacgucucgcaugcugcuuaaccgguucaccauggcucacagaaaaccgacauacgagcgcgaugucgaccugggcgccgggaccagacauguugcgguggaaccugagguggccaaccucgauauuaucggacagcggaucgaaaauauuaagcacgagcauaaauccacauggcacuaugacgaggauaaccccuacaagaccugggcuuaucauggcagcuacgaagucaaacccucuggguccgccagcuccauggugaauggaguugugaagcugcuuacaaagccuugggacgucauccccauggugacccaaauugcuaugacggauacaaccccuuuuggccagcagcgcguuuucaaagagaagguggacaccagaacaccgaaagccaagcggggcacggcucaaaucauggaagucaccgccagauggcuguggggguuucucagccggaacaaaaagccccgcauuuguacaagagaggaguucacccggaaggugcgcucuaaugcggccaucggagcuguuuuuguggacgagaaccaguggaauagcgccaaagaggcugucgaagaugagagauucugggaccuggugcagaaggaacgggagcugcacaaacagggcaagugcgccacaugcgucuauaacaugauggggaaacgcgaaaagaagcucggagaguuuggcaaagccaagggguccagagcgaucugguacauguggcugggcgcucgguuccuugaguuugaagcccugggauucaugaaugaggaucacugguucucucgcgaaaacagccucuccggcguggagggggagggacugcauaaacuuggcuacauucugagagacaucucuaagauuccugggggaaauauguaugccgaugacaccgcuggcugggauacacggaucaccgaagacgaucuccaaaacgaggccaaaauuacggacaucauggaacccgagcacgcucugcuggccaccagcaucuuuaagcucacauaccagaauaaaguugugcgcguccagagaccugcgaagaacgggaccgugauggaugugauuucccggcgcgaccagagaggcucuggacaaguuggcacauaugggcugaauaccuucacgaacauggaagcccagcuuauccggcagauggagagcgagggaauuuuucugcccuccgaacucgagacaccgaaccuggcugaaagagugcuugauuggcuggagaaguacggcgucgaacgccucaaacggauggccaucagcggggacgacugugugguuaagccuauugaugacagauucgcuaccgcccugacagcgcugaaugauaugggaaaagugcgcaaggacaucccccagugggagccuucuaaaggcuggaacgauuggcaacagguccccuuuugcucccaucacuuccaccagcucaucaugaaggacgggcgggagauuguggucccuuguagaaaucaggaugaacuggugggccgcgcccggguuagccaaggagcuggcuggucucuuagagagaccgccugccuggggaaguccuaugcucagauguggcagcucauguacuuucaucgccgggaccugagacuugccgcuaacgccaucuguagcgcggugcccgucgauugggugccgacgucccgcaccacauggucuauucacgcccaucaccaauggaugaccacagaagacaugcugagcguuuggaaucggguguggaucgaggaaaacccuuggauggaggauaaaacccaugucuccagcuggggagacgugcccuaucucggcaagagagaggaccaguggugcgggucucugauuggacugacagcucgggccaccugggccuccaauauccagguggcuauuaaccagguuagacgccucaucggcaaugaaaacuaccuggauuacaugacgagcaugaaacgguucaagaaugagggggaccccgaaggcgcccuuugguga

SEQ ID NO: 19071 - RNA, 9879 nt, Artificial Sequence
  derived and/or modified CDS sequence (opt5) from DENV-1__FJ882557__SS-prME
agcgugaccaugcugcucaugcugaugcccaccgcccuugcuuuccaccugacgaccagaggaggggaaccucauaugaucguguccaagcaggaacggggaaagucucuccuguuuaagaccagcgccggcguuaauaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacugauucaucagaucuucgggaccgcuuacggagugcucuuuuccggcgugagcuggacgaugaagauugggaucggcguccugcuuaccuggcugggacucaauucuagauccacaagccugucuaugaccuguauugccgugggccugguuacacuuuaccucggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcugucugcggccaucggcaaggcuugggaggagggggucugcggcaucagaagcgccacgcgccucgaaaacauuauguggaaacagaucuccaacgagcugaaucauauucuucuggaaaacgacaugaagcucacagugguugugggagaugucgcuggcauccuggggcagggcaagaagaugauucggccgcaacccauggaguacaaauauucuuggaaaagcuggggcaaggccaagaucaucggggccgacgcucagaauaccaccuucauuaucgauggaccuaacacacccgaauguccugacgaucagagagcguggaauauuugggagguggaggacuacggcuuuggcaucuucaccacgaacauuuggcugaaacuucgcgauuccuauacacaggugugcgaccaccggcucaugagcgccgcuaucaaagauucuaaggccguccacgccgacaugggguacuggaucgaauccgagaaaaaugaaaccuggaagcuggcuagagccagcuuuauugagguuaagacauguaucuggcccaaaucucauacccugugguccaacggagugcucgaaagcgagaugauuaucccgaagauuuauggcgggccuaucucucaacacaauuaccgccccggauacuucacacagaccgcgggcccuuggcaucuggggaaacuugagcuggauuucgaccucugcgaaggaacgaccguggucguggaugagcacugcggcaaccggggccccagccugagaacaaccacaguuaccgggaagaucauucacgaaugguguugccgguccuguacgcugccuccccuucgcuuuagaggagaggacggcugcugguaugggauggagauccggccggugaaagaaaaggaggaaaaucucgucaagagcauggugucugcuggauccggcgagguugacagcuucucccuggggcugcucuguauuucuaucaugauugaagaggugaugagaagccgcuggucccggaaaaugcugaugacaggaacccuugccgucuuuuuccugcucaucaugggccagcugacauggaacgaucugauuagacuuugcaucauggugggcgccaaugcuuuugaccgcauggggaugggaaccaccuaccuggcccucauggcgacauucaagaugagaccuauguuugcuguuggccuccuguuccggcgccugacgucuagagaggugcuucugcucaccaucgggcugagccuggucgccuccguggaacuucccaacucucuggaggaacucggagauggccuggccauggggauuaugauccucaaacugcuuacagacuuucaaagccaucagcugugggcuacccuccugucccugacauucauuaagaccacguuuagccuucacuaugccuggaaaacaauggcuauggugcugucuaucgucucccucuucccccugugucucagcaccaccucucagaagacaaccuggcugccuguucuucugggaucccugggcugcaagccgcucacaauguuucugauugccgagaauaaaaucuggggccggaaguccuggccccuuaacgaagggaucauggcggugggaauugugucuauccugcucuccagccugcucaaaaacgaugucccucuggccggcccccuuauugcugggggaaugcugaucgccuguuacgugauuuccggcagcucugcugaccugagccucgagaaggccgccgagguuuccugggaagaggaagcugagcauucuggggcgagccacaauauccugguggaaguccaggaugacggaacgaugaaaaucaaggaugaggagcgcgacgauacccuuacaauucugcucaaagccacccugcucgcuguguccggcguuuauccucugucuauccccgccacacuuuucgugugguacuucuggcaaaagaagaaacagagaagcggcguccugugggacaccccuagcccucccgaaguggagcgggccguccuggaugacgggauuuaucgcaucaugcagagaggacuccugggccggucucagguggggguuggaguguuucaagaaaacgucuuccauacgauguggcacgugacccgcggcgcuguucuuauguaccaggggaagagacuggagcccagcugggccuccgugaaaaaggaccucauuagcuacggaggcggcuggcggcugagagggucuuggaauacaggagaggaaguccaggugaucgcgguggagcccggcaaaaacccuaagaauguucagaccgcucccgggacauuuaagaccccggaaggagaggucggcgccauugcccucgauuucaaaccugggacauccggaagccccaucgugaaccgcgaaggcaagaucgugggccuguaugggaauggagucgugacgaccucuggcacauacguuuccgcuauugcccaagcgaaagcuagccaggaggggccucuucccgagaucgaagacgagguguuucggaagagaaaccugaccauuauggaucugcaccccggauccggcaaaacccgccgguaucucccugccaucgucagagaagccauuaagcgcaagcugcggacacuuauccuggcuccgacgagagugguugccucugagauggcugaagcccucaaagggaugcccauccgcuaccagaccacagcggucaagagcgagcauaccggcaaagagauugucgaccugaugugccacgccacauucaccaugcggcugcucuccccugugagaguucccaauuauaacaugaucauuauggaugaagcucauuuuacggacccuagcucuaucgccgcucggggauacauuuccacacgcgugggcaugggggaggccgccgcuaucuucaugaccgcgacacccccuggaagcgucgaagccuuuccgcaaucuaaugcugugauccaggaugaggaaagagacauucccgagcggagcuggaacuccggccacgaguggaucacagauuucccugggaagaccgugugguuuguccccucuauuaaaagcggaaaugacaucgccaacugucuucgcaagaauggcaagagaguuauucagcugucccggaaaacauucgauaccgaauaucagaagacgaaaaacaacgacugggacuacguggugacaaccgauaucucugagaugggggccaauuucagagcugaccgcgucauugauccucggagaugccugaagcccgugauccucaaagacggcccggaacgcguuauccuggccggaccuaugcccgugacagucgcgagcgcugcccaacggagaggccgcauugggcggaaccauaauaaggagggagaucaguacaucuauaugggccagccccuuaacaaugacgaggaucacgcccacuggaccgaagcuaagaugcugcucgacaacauuaauacgccugaggggaucauucccgcccuguuugaaccugagagagaaaaauccgcggccguggauggagaguaccgccugagaggcgaggcucggaagaccuucguugaacucaugcgcagaggggaccuuccgguguggcugagcuauaaagucgccucugagggcuuucaguacuccgaucggcgcuggugcuucgacggagaaagaaacaaucaagugcuggaggaaaacauggaugucgagaucuggacaaaggagggcgaacggaaaaagcucagaccccgcuggcuggacgcucggaccuauagcgacccucuugcccugagagaguuuaaagaguucgcugccgggcgccgguccgugucuggagaucucauccuggagauuggcaagcugccccagcaucucacacagagagcgcagaaugcccuugacaaccugguuaugcugcacaauagcgaacaagggggacgggcuuaccgccaugccauggaggagcucccugauaccaucgaaacacugaugcuucuggcucucauugccgugcugaccggcggcgugacgcuguuuuuccucuccgggagaggacuuggcaagacaucuaucgggcugcugugugucauggccagcuccguucuccuguggauggcuagcguggagccccacuggauugcggccucuaucauccuugaauuuuuccugauggugcuccugauuccggagccugaccggcagcgcacaccccaggauaaccagcuggcuuaugucgugaucggacuccuuuuuaugauucugaccguugccgccaaugagaugggccugcucgaaacaaccaaaaaggaccuggggaucggacacguggcugucgagaaccaucaccaugccgcgaugcuugauguggaccugcacccugccuccgcuuggacacucuacgccgucgcuacgaccauuaucacacccaugaugagacauaccauugaaaacacaaccgccaauaucagccugacggcgaucgccaaccaagcugccauucugaugggccucgauaaaggcuggccuaucucuaagauggacauuggggugccccuucuggcucugggaugcuacucccagguuaauccgcucaccaugacagccgcugugcugaugcuugucgcccacuaugcgaucauuggcccugggcugcaggccaaagcuacccgggaggcccaaaagcgcacagcugccggaaucaugaagaaccccaccguggauggcaucguugccauugaccucgaucccguggucuacgacgcgaaauucgaaaagcagcuggggcagaucaugcugcucauucuuuguacgagccagauccugcugaugagaacaaccugggcucucugcgagucuauuacacuggccaccggaccucuuaccacacugugggagggcagcccgggcaaauuuuggaauacgaccaucgcuguguccauggccaacaucuuccgggggucuuaucucgccggagcuggccuggccuucagccugaugaagucccucgggggaggccgcagagggacaggagcgcaaggcgaaacccuuggcgagaaauggaagcggcagcugaaucagcugagcaaguccgaauuuaacacauacaaaagaucugggauuauggagguggaccgcagcgaagccaaggagggacucaaacggggcgagaccacgaagcacgcuguuuccagagggacagccaaacugcgcugguucgucgaacggaaucuugugaagcccgagggaaaggugaucgaucugggcugugggagaggaggcuggucuuauuacugcgcuggccucaaaaaggucaccgaaguuaaaggguauaccaagggaggcccugggcaugaggaacccauuccuauggccacauacggauggaaccuggugaaacugcacagcggcaaggacguguuuuucauucccccugagaaaugugauacccuccuuugcgacaucggggaguccucuccgaaucccacaaucgaagagggacgcacgcugcggguccugaagaugguggaaccuuggcucagaggcaaccaguuuuguauuaagauccugaaucccuacaugccuagcguuguggagacccuugagcaaaugcagcgcaaacauggcgggaugcugguccggaacccccucuccagaaauagcacacacgaaauguauugggugucuugcggaaccggcaacaucguuuccgcggugaauaugacaagccgcaugcugcugaaccgguucaccauggcccacagaaagccgacguacgagcgcgaugucgaccucgggaccggaacaagacauguggcuguggaaccugaggucgccaaccuggauauuaucggccagcggauugaaaauaucaaacacgagcauaagucuaccuggcacuaugacgaggauaaccccuacaaaacaugggcuuaucauggguccuacgaaguuaagcccagcggaucugccuccagcauggugaauggcguggucaaacuucugaccaaaccuugggacgugauucccaugguuacacagaucgcuaugaccgauacgacaccuuuuggccaacagcgcguguucaaggagaaagucgacaccagaaccccgaaggccaaacgggggacagcgcagaucauggaagugacggccagauggcucuggggauuucugucccggaacaagaagccccgcauuuguaccagagaggaguucacacggaaaguucgcagcaaugcugccaucggcgcuguguuugucgacgagaaccaauggaacucugccaaggaggccguggaagaugagagauucugggaccuuguucaccgggaacgcgagcugcacaaacaggggaagugcgcgaccugcguguauaacaugaugggaaaaagagaaaagaagcucggcgaguuugggaaagcuaagggcagccgggccauuugguacauguggcugggagcccgcuuccuggaguucgaagcucucggcuuuaugaaugaggaucauugguucuccagagaaaacucucugagcggggucgagggagagggccuucacaaacugggguacauccuccgggacauuuccaagaucccuggaggcaauauguaugccgaugacacagcugggugggauacccgcaucacagaagacgaucugcagaacgaggccaaaauuaccgacaucauggaacccgagcaugcgcuucuggccaaggcuauuuuuaaacucacguaccagaauaagguggucagagugcaacggccugccaagaacggcaccguuauggaugugaucucucgcagagaccagcggggaagcggccaggucgggacauauggacugaauaccuucacaaacauggaagcucagcugauuagacaaauggaguccgagggcaucuuuucucccagcgaacucgagaccccgaaccuggccgaacgcgcgcuugauuggcuggagaaauacgggguggaacggcucaagagaauggccaucuccggagacgacugugugguuaaaccuauugaugaccgcuucgcuacggcccugacagcucuuaaugauaugggcaaggugcggaaagacaucccccagugggagccuagcaagggguggaacgauuggcagcagguccccuuuugcucucaccacuuccaucaacugauuaugaaggacggcagagagaucgugguuccuugucgcaaucaggaugaacucgugggacgggccagagucucccagggcgcuggguggagccugcgcgagaccgccugccugggaaaaucuuaugcgcagauguggcaacucauguacuuucaccggagagaccugcgccuugccgcuaacgccauuuguuccgccgugcccgucgauugggugccgacaagccggaccacgugguccauccaugcucaccaucaguggaugaccacagaagacaugcugucuguuuggaauagaguguggauugaggaaaacccuuggauggaggauaagacccacaucagcuccugggaggacguccccuaucucggcaaacgggaagaccaguggugcgggagccugaucggacuuacagccagagcgaccugggcuacaaauauucaaguggccaucaaccagguucgccggcugauuggcaaugagaacuaccucgauuacaugaccucuaugaagagauucaaaaaugaauccgaccccgagggggcccugugguga

SEQ ID NO: 19072 - RNA, 9879 nt, Artificial Sequence
  derived and/or modified CDS sequence (opt5) from DENV-1__FJ882558__SS-prME
agcgugaccaugcugcugaugcugaugcccaccgcccuugcuuuccaccugacgaccagaggaggggagccucauaugaucgucuccaagcaggaacggggaaagucucuccuguuuaagacaagcgccggcguuaacaugugcacccuuauugcgauggaccugggggaguucugugaagauacaaugaccuacaagugcccgcgcaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucucucacauuuauuaagaccacguucucccugcacuaugccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuacgugauuucuggaagcuccgcugaccuuucucuggagaaggccgccgaggucagcugggaagaggaagcugagcauuccggcgcgucucacaauauccugguggaaguucaggaugacgggacgaugaaaauuaaggaugaggagcgggacgauacccucacaauccugcuuaaggccacccugcucacagugagcggagucuauccucuguccauccccgcuacccucuucgugugguacuuuuggcagaaaaagaaacaacgcucuggcguccugugggacacgccuuccccucccaagguggaaagagccguucuugaugacggcauuuaucggaucaugcagcgcgggcugcugggaagaucccaggugggcgucgggguguuccaggagaacguuuuucauaccauguggcacgugacacggggagccguccucauguaccaaggcaaacgccuggaacccagcugggcuucugugaagaaggaccuuauuuccuacgggggaggcuggagacugcagggcagcuggaauaccggggaggaggugcagguuaucgccgucgaacccggcaagaauccuaagaaugugcagacagcgcccggcaccuucaaaacaucugagggggaagugggagcuauugcccucgauuuuaagccgggcacguccgggagcccuaucgucaaccgggagggaaaaauugugggccuguauggcaaugggguugugaccacauccggaaccuacgucucugccaucgcucaagccaaggcgagccaggaaggcccccucccugagaucgaggacgaaguguucagaaagcgcaaccugaccauuauggaucuucaccccggguccggaaaaacacggagauaucugcccgcuaucguucgcgaggccauuaagcggaaacugagaacgcucauccuggccccuacccgcguggucgcuagcgaaauggccgaggcucuuaagggcaugccgauucgguaccagacaaccgccgugaaaucugaacauacagggaaggagaucguugaccugaugugccacgcgaccuuuacgaugagacuccugucccccgugcgcgucccuaauuauaacaugaucauuauggaugaggcccauuucacagaccccagcucuaucgcugcccggggcuacauuagcaccagagugggaaugggcgaagcugccgccaucuuuaugaccgcuacaccucccggguccguggaggcguucccucaaucuaaugccgucauucaggaugaagaacgggacaucccggaacgcagcuggaacuccggauaugaguggaucaccgauuuucccggcaagacaguuugguucgugccuucuauuaaaagcgggaaugacaucgcuaacugucugagaaagaauggaaaacgggugauucagcucucccgcaagaccuucgauacggaguaccagaaaacaaagaacaacgacugggacuacgucgugaccacagauaucagcgaaaugggcgccaauuuuagagccgaccggguuauugaucccagacgcugccuuaagccugugauccugaaagacgggcccgagcgggucauucuggcuggcccgaugccugugaccguugccucugcggcucaaagacgcggacggaucggcagaaaccacaauaaggaaggggaucaguauaucuacaugggacagccccucaacaaugacgaggaucaugcccacuggacggaggccaaaaugcugcuugacaacauuaauacccccgaaggcaucauuccugcucuguucgagcccgaacgcgagaaguccgccgcgaucgauggggaauaucggcucagaggagaggcccgcaaaacauuuguggagcugaugagacggggcgaccugccugucuggcucagcuacaagguggcuuccgaaggguuccaguauucugaucgcagauggugcuuugacggcgagcggaacaaucaaguccuugaagagaacauggauguggaaauuuggaccaaagagggagagcgcaagaagcugagaccgcgguggcuggacgccagaacauacagcgacccccucgcucugcgcgaguucaaagaguuugccgcuggccggagauccguuucuggggaucuuauccuggaaaucggaaagcucccucagcaccugacccagcgcgcccagaaugcgcuggacaaccucgugaugcuucauaauagcgagcaaggcgggcgggccuauagacacgcuauggaggaacugcccgauacaauugagaccaugaugcugcucgcccugaucgcugugcuuacgggaggcgucacacuguucuuucucuccggccgggggcugggaaaaaccagcauuggccugcucuguguuauggccucuuccgugcuucuguggauggccagcguggaaccucauuggaucgcugcgucuauuauccuggaguucuuucucaugguccugcuuauccccgaaccggaccgccagagaaccccucaggauaaccagcuggccuacgugguuauugggcuccuguucaugauccugacaguggcugccaaugagaugggacuccuugagaccacaaagaaagaccugggcauugggcacgucgccguggaaaaccaccaucacgcugccaugcuggaugucgaccuccaucccgcguccgccuggacgcuguacgcuguggccaccacaaucauuaccccuaugaugcggcacacaaucgagaacaccacggcuaauauuagccuuaccgccaucgcgaaccaagccgcuauccugaugggacucgauaagggcuggcccauuucuaagauggacaucggcguuccucugcuggcccucgggugcuauagccaggugaauccccuuacacugaccgcugccguccugaugcucguggcucauuacgccauuaucggaccgggccugcaggcgaaagccacacgcgaagcucaaaagagaaccgccgcugggauuaugaaaaacccuacgguugauggaaucguggccaucgaccuugaucccgucguguaugacgccaaguuugagaaacagcugggccagauuaugcuccugauccuguguacaucccagauucuccuuaugcggaccacaugggcgcugugcgaaucuaucacccuggcuaccgggccccucacaacgcugugggagggaagcccuggcaaguucuggaauaccacaauugccguguccauggcuaacaucuuccgcggcagcuaccuugccggggccggacuggcuuuuucccucaugaagucucugggcgggggaagacggggcaccggggcccaaggagagacacugggcgaaaaauggaagcgccagcucaaucagcuuagcaaauccgaguucaacaccuauaagagaucuggcaucauggaaguugaccggagcgaggcgaaagaagggcugaagagaggagagacgacaaagcacgccgucucccgcggcaccgcuaaacugcggugguuuguggagagaaaucucgugaagccggaagggaaagucauugaucugggauguggccgcgggggauggucuuacuauugcgccggccuuaagaaaguuaccgaggugaagggcuacacaaaagggggacccggccacgaggaaccuauccccauggcuaccuacggguggaaccuggugaagcuccauagcggaaaggacgucuucuuuauuccucccgaaaaaugugauacacugcugugcgacaucggcgaguccagcccuaauccgacgauugaggaagggcggacccucagagugcuuaagaugguugagcccuggcugcgcggaaaccaguucuguaucaaaauucugaauccuuauaugcccucuguggucgaaacacucgagcaaaugcagcggaagcacggcggcaugcuggugagaaacccucuuucccgcaauagcacccaugagauguacuggguuucuugcgggacaggaaacaucguguccgccgucaauaugaccagccggaugcugcucaacagauuuacgauggcgcaccgcaaacccaccuaugaacgggauguggaccugggcgccgggacaagacacguggcugucgagccggaaguugccaaccuggauaucauuggacagcgcaucgagaauauuaagcaugaacacaagucuaccuggcauuacgacgaggauaacccuuauaaaacaugggcuuaccacggcuccuaugaggugaagcccagcggguccgccagcucuauggugaauggagucgugaaacuccugaccaagcccugggacguuaucccuauggugacacagauugcuaugaccgauacgacacccuucggccaacagagagucuuuaaagaaaagguggacacccggaccccuaaggccaaacgcggcacagcgcagaucauggagguuacggccaaguggcuuuggggguuccugagcagaaacaaaaagccgcggaucuguaccagagaagaguuuacacggaaagugcgcuccaaugcugccauuggagcugucuucguggacgaaaaccaauggaacucugccaaggaggccguugaggaugaaagauuuugggaccucgugcaucgggagcgcgaacugcacaagcagggcaaaugcgcgaccugcgucuacaacaugauggggaagagagagaagaaacuuggagaguucggcaaagcuaaagggagccgggccaucugguacauguggcugggcgcccgcuuccucgaguuugaggcucugggauucaugaaugaagaucacugguuuuccagagagaacucucugagcggcguggaaggggagggacuccauaaacugggcuauauucuucgggacaucuccaagauucccgggggaaauauguacgccgaugacacagcuggcugggauacccgcaucacagaggacgaucugcagaacgaagccaagaucaccgacauuauggagccugaacacgcgcuccuggccaaaucuaucuucaaacuuacguaucagaauaaagucgugagaguucaacggcccgcuaagaacgggaccgugauggaugucauuagccgcagagaccagcggggcuccggacaggugggcacauacgggcugaauaccuuuacaaacauggaggcccagcucauccgccaaauggaaagcgagggaauuuucucuccuuccgagcuggaaacccccaaccuggcuagacgggugcucgauuggcuggagaaacauggcguugaaagacuuaagcgcauggccaucagcggggacgacuguguggucaagccgaucgaugaccgguuugcgacggcccugacagcucucaaugauaugggaaaagugagaaaggacauuccucagugggagcccucuaaaggcuggaacgauuggcagcagguuccuuucugcucccaccacuuucaucaacugaucaugaaggacgggcgcgaaauugugguccccugucggaaucaggaugagcuugugggcagagcccgcgucagccagggagcuggcuggucccugcgggagaccgccugccucgggaaaucuuaugcucagauguggcaacugauguacuuccacagacgcgaccugcggcucgccgcgaacgccaucuguagcgcugugccuguugauugggugcccacauccagaaccacguggagcauucaugcccaccaucaguggaugaccacagaagacaugcugucugucuggaaucgcguguggaucgaggaaaacccguggauggaggauaagacccacauuuccagcuggggagacguuccuuaucuuggcaagcgggaagaccaguggugcgggucucugaucggacucacagccagagcuaccugggccacaaauauccaaguggcgauuaaccagguccggagacugaucggcaaugagaacuaccuugauuacaugaccagcaugaaacgcuuuaagaaugaguccgaccccgaaggggcucugugguga

SEQ ID NO: 19073 - RNA, 9879 nt, Artificial Sequence
  derived and/or modified CDS sequence (opt5) from DENV-1__GQ199824__SS-prME
agcgugaccaugcugcucaugcugaugcccaccgcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagauccucaacgagcugaaucauauucuucuggaaaacgacaugaaauuuacaguuguggucggagauguggcuggcauccucgcccaggggaagaaaaugauucggccgcagcccauggaguacaaguauucuuggaaaagcuggggaaaggccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcugaaacugcgcgauuccuauacacagguuugcgaccaccggcuuaugagcgccgcuaucaaggauucuaaagccgugcacgccgacaugggcuacuggauugaauccgagaagaaugaaaccuggaagcucgcuagagccagcuucaucgaggugaaaacauguaucuggcccaagucucauacccugugguccaacgggguccuggaaagcgagaugauuaucccgaaaauuuauggaggcccuaucucucagcacaauuaccgccccggguacuuuacacaaaccgcgggaccuuggcaucucggcaagcuggagcuugauuucgaccugugcgaagggacgaccgugguuguggaugagcacugcggaaaccggggccccagccucagaacaaccacagucaccggcaaaauuauccacgaaugguguugccgguccuguacgcugccuccccugcgcuuuaagggggaggacggaugcugguauggcauggagaucagaccggugaaggaaaaagaggaaaaucuuguuaagagcauggugucugcuggguccggagaggucgacagcuucucccucggccugcuguguauuucuaucaugauugaagaggugaugcggagcagauggucccgcaaaaugcucaugacagggacccuggccgucuuuuuccuucugaucaugggacagcucacauggaacgaucugauucggcugugcaucauggugggcgccaaugcuucugacagaaugggcauggggaccaccuaccuugcccugauggcgacauuuaagaugcgcccuauguucgcugucggacuccuguuuagacggcucacgagccgcgaggugcugcuucugaccauuggccucucccugguggccucugucgaacugcccaacagccuugaggaacugggggauggacucgccaugggcaucaugauccugaaacuccugacagacuuccagucccaucaacuuugggcuacccugcucagccugacauuuauuaagaccacguucucucugcacuaugccuggaagacaauggcuaugguucuuuccaucgugagccuguuuccccucugucugucuaccaccucccagaaaacaaccuggcucccugugcugcuugggagccugggaugcaagccgcugacaauguuccucauugccgagaauaaaaucuggggcagaaagucuuggccccugaacgaaggcauuauggcggucgggaucguguccauccuucugagcucccuccugaaaaacgauguuccucucgccggaccccugauugcuggcgggaugcuuaucgccuguuacgugauuagcggaucuagcgcugaccugucccuggagaaggccgccgaggucucuugggaagaggaagcugagcauagcggcgcgucccacaauauccucguggaaguucaggaugacgggacgaugaaaauuaaggaugaggagcgggacgauacccugacaauccuucugaaggccacccuccuggcugugucuggagucuauccucucagcauccccgccacacuguucgugugguacuuuuggcagaaaaagaaacaacgcuccggcguccuuugggacaccccuucucccccggaaguggagagagccguucuggaugacggcauuuaucggaucaugcagcgcgggcugcucggaagaagccaggugggcgucgggguguuccaggaaaacguuuuucauacgauguggcacgugacccggggagcuguccugauguaccaaggcaagcgccuugagccuuccugggccagcgugaaaaaggaccugauuucuuacgggggaggcuggagacuccagggcuccuggaauacaggggaggaagugcagguuaucgcggucgagcccggaaagaacccuaaaaaugugcagaccgcucccggcacauucaagaccagcgaaggggaggugggagccauugcccuggauuuuaaaccgggcacaucuggguccccuaucgucaaccgggaaggaaagauugugggccucuauggcaaugggguugugacgaccagcggaacauacgucuccgcuaucgcccaagcgaaggcuucucaggagggcccccugccugagaucgaagacgagguguucagaaagcgcaaccuuaccauuauggaucugcaccccgggagcggaaagacccggagauaucugcccgccaucguucgcgaagccauuaaacggaagcucagaacacugauccuugcuccuacgcgcguggucgccuccgagauggcugaagcccugaaaggcaugccgauucgguaccagaccacagcggugaaguccgagcauaccgggaaagagaucguugaccucaugugccacgccacauuuaccaugagacugcugucucccgugcgcgucccuaauuauaacaugaucauuauggaugaagcucauuucacggaccccuccagcaucgccgcucggggcuacauuucuacaagagugggaaugggcgaggccgccgcuaucuuuaugaccgcgaccccucccgggagcguggaagccuucccucaauccaaugcugucauucaggaugaggaacgggacaucccggagcgcucuuggaacagcggauaugaguggaucacagauuuucccggcaagaccguuugguucgugccuuccauuaagucugggaaugacaucgccaacugucuccgcaagaauggaaagcgggugauucagcuuagccgcaaaacauucgauaccgaauaccagaagacgaaaaacaacgacugggacuacgucgugacaaccgauaucuccgagaugggcgccaauuuuagagcugaccggguuauugaucccagacgcugccugaagccugugauccugaaggacgggcccgaacgggucauucucgccggcccgaugccugugacaguugcgagcgcugcccaaagacgcggacggaucggcagaaaccacaauaaagagggggaucaguauaucuacaugggacagccccugaacaaugacgaggaucaugcccacuggaccgaagcuaagaugcuucuggacaacauuaauacgcccgagggcaucauuccugcccucuucgaacccgagcgcgaaaaaucugcggccaucgauggggaguaucggcugagaggagaggcucgcaagaccuuuguggaacugaugagacggggcgaccucccugucuggcuuuccuacaaaguggccagcgagggguuccaguauuccgaucgcagauggugcuuugacggcgaacggaacaaucaaguccuggaggaaaacauggauguggagauuuggacaaaggagggagaacgcaaaaagcugagaccgcgguggcucgacgcuagaaccuacucugacccccuggcccuucgcgaguucaaggaauuugcugccggccggagaagcguuuccggggaucugauccucgagaucggaaaacugccucagcaccugacacagcgcgcgcagaaugcccucgacaaccuugugaugcugcauaauucugaacaaggcgggcgggcuuauagacacgccauggaggagcugcccgauaccauugaaacacucaugcugcuugcucugaucgccgugcucaccggaggcgucacgcuguucuuucugagcggccgggggcucggaaagacauccauuggccuucuguguguuauggccagcucugugcugcucuggauggcuuccguggagccucauuggaucgcggccagcauuauccuggaguucuuucuuaugguccugcucauccccgagccggaccgccagagaaccccucaggauaaccagcuggcuuacgugguuauugggcugcuguucaugauccuuaccguggccgccaaugagaugggacugcuggaaacaaccaaaaaggaccucggcauugggcacgucgcuguggagaaccaccaucacgccgcgaugcuggaugucgaccuucaucccgccucugcuuggacacuguacgccguggcuacgaccaucauuacaccuaugaugcggcacaccaucgaaaacacaaccgccaauauuucccucacggcgaucgccaaccaagcugccauccugaugggacuggauaaaggcuggcccauuagcaagauggacaucggcguuccucuccuugcucuggggugcuauucucaggugaauccccugacccucacagccgcuguccugaugcuuguggcccauuacgcgauuaucggaccgggccugcaggccaaggcuacccgcgaggcccagaaaagaacagcugccgggauuaugaagaacccuaccguugauggaaucguggccaucgaccucgaucccgucguguaugacgcgaaauuugaaaagcagcugggccagauuaugcugcucauccuuuguacgagccagauucugcugaugcggacaaccugggcucucugcgaguccaucacacuggccaccgggccccuuaccacacugugggagggaucuccuggcaaauucuggaauacgaccauugcugugagcauggccaacaucuuccgcggcuccuaccucgccggggcuggacuggccuuuagccugaugaagucccucggcgggggaagacggggcacaggggcgcaaggagaaacccuuggcgagaaguggaaacgccagcugaaucagcugucuaagagcgaguucaacacauauaaaagauccggcaucauggagguugaccggucugaagccaaggaggggcucaaaagaggagagaccacgaagcacgcugucagccgcggcacagccaagcugcggugguuuguggaaagaaaucuugugaaaccggaggggaaggucauugaucugggauguggccgcgggggaugguccuacuauugcgcuggccucaaaaagguuaccgaagugaaaggcuacaccaaagggggacccggccacgaggaaccuauccccauggccacauacggguggaaccuggugaaacugcauucuggaaaggacgucuucuuuauuccucccgagaagugugauacccuccuuugcgacaucggcgagagcuccccuaauccgacaauugaagaggggcggacgcugagagugcugaaaaugguugaacccuggcuccgcggaaaccaguucuguaucaagauucugaauccuuauaugcccagcguggucgagacccuugagcaaaugcagcggaaacacggcggcaugcuggugagaaacccucucucucgcaauuccacacaugaaauguacuggguuagcugcgggaccggaaacaucgugucugcggucaauaugacaucccggaugcugcugaacagauuuaccauggcccaccgcaagcccacguaugagcgggauguggaccucggcgcugggaccagacacguggccgucgaaccggagguugcuaaccuggauaucauuggacagcgcaucgaaaauauuaaacaugagcacaagagcacauggcauuacgacgaggauaacccuuauaagaccugggccuaccacggcucuuaugaagugaaacccuccgggagcgcuuccagcauggugaauggagucgugaaacuucugacaaaacccugggacguuaucccuauggugacccagauugccaugacagauaccacgcccuucggccaacagagagucuuuaaggagaaaguggacacacggaccccuaaggcgaagcgcggcaccgcccagaucauggaaguuacagcuaaauggcucuggggguuccugucuagaaacaagaaaccgcggaucuguacgagagaggaauuuacccggaaggugcgcagcaaugccgcuauuggagccgucuucguggacgagaaccaauggaacuccgccaaagaggcgguugaagaugagagauuuugggaccuugugcaucgggaacgcgagcugcacaagcagggcaagugcgcuacaugcgucuacaacaugauggggaaaagagaaaagaaacucggagaguucggcaaggccaaagggucucgggccaucugguacauguggcugggcgcucgcuuccuggaguuugaagcccucggauucaugaaugaggaucacugguuuagcagagaaaacucccugucuggcguggagggggagggacuucauaagcugggcuauauucuccgggacaucagcaaaauucccgggggaaauauguacgcugaugacaccgccggcugggauacacgcaucaccgaagacgaucugcagaacgaggcgaagaucacagacauuauggaaccugagcacgcccuucuggcuaaguccaucuucaaacucaccuaucagaauaaggucgugagaguucaacggcccgccaaaaacgggacggugauggaugucauuucucgcagagaccagcggggcagcggacaggugggcaccuacgggcugaauacauuuaccaacauggaagcucagcugauccgccaaauggaguccgagggaauuuucagcccuucugaacucgagacacccaaccuggccggcagagugcuugauuggcuggaaaagcaugggguugagcggcucaaaagaauggcgaucuccggagacgacuguguggucaagccgaucgaugaccgcuuugccaccgcucugacggcccuuaaugauaugggcaaggugcggaaagacauuccucagugggaacccagcaagggguggaacgauuggcagcagguuccuuucugcucucaccacuuucaucaacugaucaugaaagacggcagagagauugugguccccugucgcaaucaggaugagcucgugggacgggcuagagucucccagggcgccggguggagccugcgcgaaacagcuugccugggaaaguccuaugcccagauguggcaacucauguacuuccaccggagagaccugcgccuugcggccaacgcuaucuguucugccgugccuguugauugggugcccaccagccggacaaccugguccauucaugcccaccaucaguggaugacgaccgaggacaugcugagcgucuggaauagaguguggaucgaagagaacccguggauggaagauaaaacacacauuucuuccuggggcgacguuccuuaucucgggaagcgcgaggaccaguggugcggaagccugaucggccuuaccgcucgggccacaugggcgaccaauauccaaguggcuauuaaccaggucagacggcugaucgggaaugagaacuaccucgauuacaugacaucuaugaagagauuuaaaaaugaaagcgaccccgagggcgcccugugguga

SEQ ID NO: 19074 - RNA, 9879 nt, Artificial Sequence
  derived and/or modified CDS sequence (opt5) from DENV-1__FJ882559__SS-prME
agcgugaccaugcugcugaugcugaugcccacagcccuugcuuuccaccugacgaccagaggcggggaaccucauaugaucgucuccaagcaagaacggggaaaaucucuccuguuuaagacaagcgccggcguuaauaugugcacccuuauugcgauggaccugggggaguucugugaagauacaaugaccuacaaaugcccgcgcaucacagaagcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaaguuuacgguuguggucggagauguggcuggcauucuggcccaggggaaaaagaugauccggccgcaacccauggaguacaaauauagcuggaaguccuggggaaaggccagaauuaucggcgcugacgugcagaauacaaccuucaucauugaugggccuaacacccccgaauguccugacgaucagcgcgcguggaauaucugggaggucgaggacuacggauuuggcauuuucacaaccaacaucuggcuccggcugagagauagcuauacgcagguuugcgaccaccgccugaugucugccgcuauuaaagauuccaaggccgugcacgccgacaugggcuacuggaucgaaagcgagaaaaaugaaacauggaaacuugcucgggccucuuucaucgaggugaaaaccuguauuuggcccaagucccauacacucuggagcaacgggguccuggaaucugagaugaucauuccgaagaucuauggaggcccuauuagccaacacaauuacagacccggguacuuuacccagacagcgggaccuuggcaucugggcaaacucgagcuggauuucgaccuuugcgaagggaccacggugguuguggaugagcacugcggaaaccggggccccucccugcgcaccacaaccgucacaggcaagaucgugcacgaaugguguugcagaagcuguacccucccuccccugcgguuuaaaggggaggacggaugcugguauggcauggagaucagaccgguuaaggaaaaagaggaaaaucuggugaagucuauggucuccgcugggagcggagagguggacuccuucucucuuggccuccuguguauuagcaucaugauugaagagguuaugcgcucccgguggucuagaaagaugcugaugacggggacacucgccguguuuuuccugcuuaucaugggacagcugaccuggaacgaucucauucgccugugcaucauggucggcgccaaugcuagcgacagaaugggcauggggaugacauaccuggcccuuauggcgaccuuuaaaaugcggccuauguucgcugugggacugcucuuucgcagacugaccucccgggaggugcuccugcuuacaauuggccugucucucgucgccagcgccgaacugcccaacucccuggaggaacuuggggauggacuggcuaugggcaucaugauccucaagcugcucacggacuuccaaagccaucagcugugggccacccuucugucucucacauuuauuaaaaccacauucucccugcacuaugcuuggaagaccauggccaugguucugagcaucgugucucuuuuuccccugugucucuccacgacaagccagaaaaccaccuggcugccugugcuccuggggucucuuggaugcaagccgcugacaauguuccugauugcggagaauaagaucuggggccgcaaauccuggccccucaacgaaggcauuauggccgucgggaucgugagcauccugcuuuccagccugcucaagaacgauguuccucuggcuggaccccucauugccggcgggaugcugaucgcuuguuacgugauuucuggaagcuccgccgaccuuucucuggagaaagccgcugaggucagcugggaagaggaagcggagcauuccggcgccucucacaauauccugguggaaguucaggaugacgggaccaugaagauuaaagaugaggagagagacgauacacucacgauccugcuuaaggcuacccugcucgccgugagcggagucuauccucuguccauccccgccacacucuucgugugguacuuuuggcagaagaagaagcagcggucuggcguccugugggacaccccuuccccucccgaaguggagcgcgcuguucuugaugacggcauuuauagaaucaugcagcgggggcugcugggacgcucccaggugggcgucgggguguuccaagaaaacguuuuucauacaauguggcacgugaccagaggagccguccucauguaccagggcaaacggcuggagcccagcugggcgucugugaagaaagaccuuauuuccuacgggggaggcuggagacugcagggcagcuggaauacgggggaggaagugcagguuaucgcugucgagcccggaaagaacccuaaaaaugugcaaaccgcccccggcacauucaagaccucugaaggggaggugggagccauugcucucgauuuuaagccgggcacauccgggagcccuaucgucaaccgcgaaggaaaaauugugggccuguauggcaaugggguugugaccacauccggaacguacgucucugccaucgcgcaggcuaaggccagccaggagggcccccucccugagaucgaagacgagguguuccggaaaagaaaccugaccauuauggaucuucaccccggguccggaaagacacgccgguaucugcccgccaucguuagagaagcuauuaaacgcaagcugcggacccucauccuggccccuaccagaguggucgcuagcgagauggccgaagcgcuuaagggcaugccgauucgcuaccaaacaacggccgugaaaucugagcauaccgggaaggagaucguugaccugaugugccacgcuacauuuaccaugcggcuccugucccccgugagagucccuaauuauaacaugaucauuauggaugaagcccauuucacagaccccagcucuaucgcugcccggggcuacauuagcacccgcgugggaaugggcgaggccgcugcgaucuuuaugacggccacaccucccggguccguggaggcuuucccucagucuaaugccgucauucaggaugaagaaagagacaucccggagcggagcuggaacuccggauaugaguggaucaccgauuuucccggcaaaaccguuugguucgugccuucuauuaagagcgggaaugacaucgccaacugucugcgcaaaaauggaaagagagugauucagcucucccggaagacauucgauaccgaauaccagaagacaaagaacaacgacugggacuacgucgugaccacggauaucagcgagaugggcgcuaauuuuagagccgaccgcguuauugauccccggagaugccuuaaaccugugauccugaaggacgggcccgaacgcgucauucuggcgggcccgaugccugugacaguugcuucugccgcccagcggagaggacgcaucggccggaaccacaauaaagagggggaucaguauaucuacaugggacagccccucaacaaugacgaggaucaugcucacuggaccgaagccaagaugcugcuugacaacauuaauacacccgagggcaucauuccugcgcuguucgaacccgagagagaaaaguccgccgcuaucgauggggaguaucgccucagaggagaggcccggaaaaccuuuguggaacugaugcgcagaggcgaccugccugucuggcucagcuacaagguggcuuccgagggguuccaauauucugaucggcgcuggugcuuugacggcgaaagaaacaaucagguccuugaggaaaacauggauguggagauuuggacgaaagagggagaacggaagaaacugagaccgcgcuggcuggacgcccggaccuacagcgacccccucgcucugagagaguucaaggaauuugccgcgggccgccgguccguuucuggggaucuuauccuggagaucggaaaacucccucagcaccugacacagagagcccaaaaugcucuggacaaccucgugaugcuucauaauagcgaacagggcgggcgggccuaucgccacgcuauggaggagcugcccgauaccauugaaacacugaugcuccuggcccuuaucgccgugcugaccggaggcgucacacucuucuuucuguccggcagagggcugggaaagaccagcauuggccuccuuuguguuauggcuucuuccgugcugcuguggauggcgagcguggagccucauuggaucgccgcuucuauuauccucgaguucuuucugaugguccuucugauccccgagccggaccggcagcgcacgccucaggauaaccaacucgccuacgugguuauugggcugcuguucaugauccucacaguggccgcuaaugagaugggacuucuggaaaccaccaagaaagaccugggcauugggcacgucgccguggagaaccaccaucacgcggccaugcucgaugucgaccugcaucccgcuuccgccuggacacuuuacgcuguggccaccacaaucauuacgccuaugaugagacacaccaucgaaaacacaaccgcgaauauuagccugacagccaucgcuaaccaggccgcuauccucaugggacuggauaagggcuggcccauuucuaaaauggacaucggcguuccucugcucgcccuugggugcuauagccaggugaauccccugacccugacggcugccguccucaugcugguggcgcauuacgccauuaucggaccgggccuucaagcuaaggccacccgggaggcucagaaacgcacagccgccgggauuaugaagaacccuaccguugauggaaucguggcgaucgaccuggaucccgucguguaugacgcuaaguuugaaaaacagcucggccagauuaugcugcugauccucuguacaucccaaauucuucugaugagaaccacgugggcccugugcgagucuaucacacucgcuaccgggccccugacaacccuuugggagggaagcccuggcaaguucuggaauaccacaauugccguguccauggccaacaucuuccggggcagcuaccuggcuggggccggacucgcguuuucccugaugaaaucucugggcgggggacgcagaggcacgggggcccagggagaaacccucggcgagaaguggaaacggcagcuuaaucagcugagcaaguccgaguucaacacauauaagagaucuggcaucauggagguugaccgcagcgaagcuaaagaggggcugaagcggggagagaccacaaaacacgccgucuccagaggcaccgcuaagcuccgcugguuuguggaacggaaucuggugaaaccggaggggaaggucauugaucuuggauguggcagagggggauggucuuacuauugcgccggccugaagaaaguuacggaagugaagggcuacacaaaagggggacccggccacgaggaaccuauccccauggcgaccuacggguggaaccucgugcgccugcauagcggaaaggacgucuucuuuaccccucccgagaaaugugauacacugcucugcgacauuggcgaguccagcccuaauccgaccaucgaagaggggcggacacuuagagugcugaagaugguugaacccuggcugcgcggaaaccaauucuguauuaaaauccucaauccuuauaugcccucuguggucgagacgcuggagcagaugcagcggaagcacggcggcaugcuugugagaaacccucugucccgcaauagcacccaugaaauguacuggguuucuugcgggacaggaaacauuguguccgccgucaauaugaccagccggaugcuccugaacagauuuacaauggcucaccgcaagcccaccuaugagagagauguggaccugggcgccgggacgcggcacguggcugucgaaccggagguugccaaccucgauaucaucggacagcgcauugaaaauaucaaacaugagcacaagucuaccuggcauuacgacgaggauaacccuuauaaaacaugggcuuaccacggcuccuaugaagugaagcccagcggguccgccagcucuauggugaauggagucgugaaacugcuuaccaagcccugggacguuauuccuauggugacacaaaucgcgaugaccgauacaacccccuucggccagcagagagucuuuaaggagaaaguggacacgcggacaccuaaggccaaaagaggcaccguucaaauuauggaagugaccgcuaaguggcuguggggguuccucagccggaacaaaaagccgcgcaucuguacaagagaggaauuuacgcggaagguccgcuccaaugccgcuaucggagccguguucguugacgagaaccaguggaacucugccaaagaggcgguggaagaugagagauuuugggaccugguccaucgggaacgcgagcuucacaagcagggcaaaugcgcuaccugcguguacaacaugauggggaagagagagaagaagcugggagaguucggcaaggccaaagggagccgggccauuugguacauguggcucggcgcucgcuuccuggaguuugaagcccugggauucaugaaugaggaucacugguuuuccagagaaaacucucucagcggcgucgagggggagggacugcauaaacuuggcuauauccugcgggacauuuccaaaauccccgggggaaauauguacgcugaugacacagccggcugggauacccgcauuacagaagacgaucuccagaacgaggcgaagaucaccgacaucauggaaccugagcacgcccugcuugcuaaaucuauuuucaagcugacauaucaaaauaaagugguuagagugcagcggcccgccaagaacgggaccgucauggaugugaucagccgcagagaccagcggggcuccggacaggugggcacguacgggcucaauaccuuuacaaacauggaagcucaacugauuagacagauggagagcgagggaaucuucucuccuuccgaacuggagacccccaaccucgccgaacgcgcgcuggauuggcuugagaagcauggcguugaacggcugaaaagaauggccauuagcggggacgacuguguggucaagccgaucgaugaccgcuuugcuacagcccucaccgcucugaaugauaugggaaaagugcggaaggacaucccucagugggagcccucuaaaggcuggaacgauuggcagcaaguuccuuucugcucccaccacuuucaucagcuuauuaugaaggacgggagagagaucgugguccccugucgcaaucaggaugaacuggugggccgggccagagucagccagggagcuggcuggucccuccgcgagacggccugccuggggaagucuuaugcgcaaauguggcagcugauguacuuccaccggagagaccuccgccuggccgcuaacgccauuuguagcgccgugccuguugauugggugcccacaucccggaccacauggagcauccaugcucaccaucaguggaugaccacggaagacaugcuuucugucuggaauagaguguggauugaggaaaacccguggauggaggauaaaacccacaucuccagcuggggagacguuccuuaucugggcaagcgggaggaccaauggugcgggucucucauuggacugacagccagagcgaccugggcuacaaauauccagguggccaucaaccagguccgccggcuuauuggcaaugaaaacuaccuggauuacaugaccagcaugaaaagauuuaagaaugaguccgaccccgaaggggcccucugguga

SEQ ID NO: 19075 - RNA, 9879 nt, Artificial Sequence
  derived and/or modified CDS sequence (opt5) from DENV-1__GQ199828__SS-prME
agcgugaccaugcugcucaugcugaugcccaccgcccuugcuuuccaccugacgacccggggaggggaaccucauaugaucgucuccaagcaggaacggggaaaaucucuccuguuuaagacaagcgccggcguuaauaugugcacccuuauugcgauggaccugggggaacucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucuguugcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaagcucacaguuguggucggagauguggcuggcauucuggggcagggcaagaaaaugauccggccgcaacccauggaguacaaauauucuuggaaaagcuggggcaaggccaagauuaucggggccgacgcucagaauaccaccuucaucauugauggaccuaacacacccgaauguccugacgaucagagagcguggaauaucugggagguggaggacuacggcuuuggcauuuucaccacgaacaucuggcugaaacuucgcgauuccuauacacaggucugcgaccaccggcucaugagcgccgcuauuaaagauucuaaggccguucacgccgacaugggguacuggaucgaauccgagaaaaaugaaaccuggaagcuggcuagagccagcuuuaucgaggugaagacauguguguggcccaaaucucauacccugugguccaacggaguccgcgaaagcgagaugauuaucccgaagauuuauggcgggccuaucucucaacacaauuaccggcccggauacuucacacagaccgcgggcccuuggcaucucgggaaacuggagcuugauuucgaccugugcgaaggaacgaccgugguuguggaugagcacugcggcaacagaggccccagccuccggacaaccacagucaccgggaagauuauccacgaaugguguugccgcuccuguacgcugccuccccugagauuucggggagaggacggcugcugguaugggauggagaucagaccggugaaagaaaaggaggaaaaucuuguuaagagcauggugucugcuggauccggcgaggucgacagcuucucccucgggcugcuguguauuucuaucaugauugaagaggugaugcgcagccggugguccagaaaaaugcucaugaucggaacacuggccgucuuuuuccuucugauuaugggccagcucaccuggaacgaucugauccgccugugcauuauggugggcgccaaugcuucugacagaauggggaugggaacaaccuaccuugcccugauggcgaccuuuaagaugcggccuauguucgcugucggccuccuguuucgcagacucacaagccgggaggugcugcuucugacgaucgggcucucccugguggccucugucgaacugcccaacagccuugaggaacugggagauggccucgccauggggaucaugauucugaaacuccugaccgacuuccaaucccaucagcuuugggcuacacugcucagccugaccuuuaucaagacaaccuucucucugcacuaugccuggaaaacgauggcuaugguucuuuccauugugagccuguuuccccucugucugucuacaaccucccagaagaccacauggcucccugugcugcuuggaagccugggcugcaagccgcugaccauguuccucaucgccgagaauaaaauuuggggccgcaagucuuggccccugaacgaagggaucauggcggucggaaucguguccauucuucugagcucccuccugaaaaacgauguuccucucgccggcccccugaucgcugggggaaugcuuauugccuguuacgugaucagcggcucuagcgcugaccugucccuggagaaggccgccgaggucucuugggaagaggaagcugagcauagcggggcgucccacaauauucucguggaaguucaggaugacggaacaaugaaaaucaagaacgaggagagagaugacacgcugaccauccuucugaaagccacacuccuggcugugucuggcgucuauccucucagcauucccgccacccuguuugugugguacuucuggcaaaagaagaaacagcgguccggcguccuuugggauacaccuucucccccggaaguggagcgcgccguucuggacgaugggaucuauagaauuaugcagcggggacugcucggccgcagccaggugggggucggaguguuccaagaaaauguuuuucauaccauguggcacgugacgagaggcgcuguccugauguaccaggggaagcggcuugagccuuccugggccagcgugaaaaaggaccugaucucuuacggaggcggcuggagacuccgcggguccuggaacaccggagaggaagugcagguuauugcggucgagcccggcaaaaauccuaagaacgugcagacagcucccgggaccuucaagacaccggaaggagaggugggcgccaucgcccuggacuuuaaaccugggaccagcggaucucccauugucaaucgggaaggcaagaucgugggccucuaugggaacggaguugugacaacguccggcaccuacgucagcgcuaucgcccaagcgaaggcuucccaggaggggccucugcccgagauugaagaugagguguucagaaagcgcaaucuuacaaucauggaccugcaccccggaucuggcaaaacccggagauaucugccugccauuguucgcgaagccaucaagcggaagcucagaacccugauucuugcuccgacacgcguggucgccagcgagauggcugaagcccugaaagggaugcccauccgguaccagacgaccgcggugaaguccgagcauacaggcaaagagaucguugaucucaugugccacgccaccuuuacaaugagacugcugagcccugugcggguccccaacuauaauaugauuaucauggacgaagcucauuucaccgauccuucuuccauugccgcucgcggauacaucagcacgagagugggcaugggggaggccgccgcuauuuuuaugacagcgacacccccuggaucuguggaagccuucccgcaaagcaacgcugucauccaggacgaggaacgggauauccccgagcgcuccuggaacucuggcuaugaguggauuaccgacuuuccugggaagacaguuugguucgugcccagcaucaaauccggaaacgauauugccaauugucucagaaagaacggcaagcgggugauccagcuuucuagaaaaaccuuugacacagaauaccagaagaccaaaaacaaugauugggacuacgucgugacgacagacauuagcgagaugggggccaacuuccgcgcugaucggguuaucgacccuagacgcugccugaagcccgugauucugaaagauggcccggaacgggucauccucgccggaccuaugcccgugaccguugcguccgcugcccaaagacgcggccggaucgggagaaaucacaacaaggagggagaccaguauauuuacaugggccagccccugaauaacgaugaggaccaugcccacuggacagaagcuaagaugcuucuggauaauaucaacaccccugaggggauuauccccgcccucuucgaaccugagcgcgaaaagagcgcggccguggacggagaguauagacugcggggcgaggcucgcaagacguuugucgagcugaugagaagaggggaucucccgguguggcuuucuuacaaagucgccuccgagggcuuccaguauagcgaccgcagauggugcuuugauggagaacggaauaaccaagugcuggaggaaaauauggacguugagauuuggaccaaggagggcgaacgcaagaagcugcgcccccgguggcucgaugcuagaacauacuccgacccucuggcccuucgcgaguucaaagaauuugcugccgggcggagaucugugagcggagaccugauccucgagaucggcaagcugccccagcaccugacccagcgggcgcagaacgcccucgauaaucuugugaugcugcauaacuccgaacaagggggacgcgcuuauagacacgccauggaggagcugccugacacaauugaaacccucaugcugcuugcucugaucgccguccucacaggcggcguuacccuguucuuucugucugggcggggacucggcaagacgagcauugggcuucugugugugauggccuccagcgugcugcucuggauggcuucugucgagccccauuggaucgcggccuccauuauccuggaguucuuucuuauggugcugcucaucccggagccugaucgccagagaacaccccaggacaaucagcuggcuuacguugugauuggacuccuguucaugauccuuaccgucgccgccaacgagaugggccugcuggaaaccaccaaaaaggaucucgggauuggacacguggcugucgagaaccaccaucacgccgcgaugcuggacguggaucuucauccugccagcgcuuggacccuguacgccguugcuacaacgaucauuacccccaugaugcggcacacaaucgaaaauaccacagccaacauuucucucaccgcgaucgccaaucaagcugccauccugaugggccuggacaaaggcuggccuauuuccaagauggauaucggggugccccuccuugcucugggaugcuauagccaggucaacccgcugacgcucaccgccgcugugcugaugcuuguugcccauuacgcgauuaucggcccugggcugcaggccaaagcuacacgcgaggcccaaaagagaaccgcugccggaauuaugaagaaucccacaguggacggcaucgucgccaucgaucucgaccccgugguguaugaugcgaaauuugaaaagcagcuggggcagauuaugcugcucauccuuuguaccucucagauucugcugaugcggacgacaugggcucucugcgagagcaucacccuggccacaggaccucuuaccacccugugggagggcuccccgggcaaauucuggaacacaacgauugcuguuucuauggccaauaucuuucgcgggagcuaccucgccggagcuggccuggccuucucccugaugaaaagccucgggggaggcagacgggggaccggagcgcaaggcgaaacacuuggcgagaaauggaagagacagcugaaccagcuguccaagucugaguucaauaccuauaaacgcagcgggaucauggaggucgaccgguccgaagccaaggagggacucaaaagaggcgagacaaccaagcacgcugugucucgcgggacggccaaacugcggugguuuguggaaagaaaccuugucaagcccgagggaaagguuauugaccugggcugugggcgcggaggcuggagcuacuauugcgcuggccucaaaaaggugacagaagugaaaggguacaccaagggaggcccugggcacgaggaacccaucccuauggccaccuacggauggaaucuggucaaacugcauuccggcaaggauguguucuuuauucccccugagaaaugugacacacuccuuugcgauaucggggagucuagcccgaaccccaccauugaagagggacggacacugagaguucugaagaugguggaaccuuggcuccgcggcaaucaguucuguaucaagauucugaaccccuauaugccuuccgucguggagacgcuugagcaaaugcagcggaaacacggcgggaugcugguuagaaauccccucagccgcaacucuacccaugaaauguacuggguguccugcggaacaggcaauaucgucagcgcggugaacaugaccucucggaugcugcugaacagauuuacaauggcccaccgcaagccgaccuaugagagagacguggaucucgggacgggaacccggcacgucgcuguugaaccugagguggccaaucuggacaucauuggccagcgcaucgaaaacauuaaacaugagcacaaguccacauggcauuacgaugaggacaaucccuauaaaaccugggcuuaccacgggagcuaugaagugaagcccucuggauccgccagcuccauggucaacggcgugguuaaacuucugacaaaaccuugggaugugauccccauggucacccagauugcuaugacagacaccacgccuuucggccaacagagaguguuuaaggagaaaguugauacacggaccccgaaggccaaaagagggaccgcgcagaucauggaagugacagcccgguggcucuggggauuccugagccgcaauaagaagcccagaaucuguacgcgggaggaauuuacccgcaaagucagaucuaacgcugccauuggcgcuguguucguugacgagaaucaauggaacagcgccaaggaggccguggaagacgagcgguuuugggaucuuguccaucgcgaaagagagcugcacaaacaggggaagugcgcgacaugcguguacaauaugaugggaaaacgggaaaagaagcucggcgaguucgggaaagcuaagggcucccgcgccaucugguacauguggcugggagccagauuucuggaguucgaagcucucggcuucaugaacgaggaccacugguuuucucgggaaaauagccuguccggggucgagggagagggccuucauaaacugggguauauucuccgcgauaucucuaagauuccuggaggcaacauguacgccgacgauaccgcugggugggacacaagaaucaccgaagaugaccugcagaaugaggccaaaaucacagauauuauggaacccgagcacgcgcuucuggccaaggcuaucuucaaacucaccuaucagaacaaggugguucgggugcaacgcccugccaagaauggcacggucauggacgugauuagcagacgggaucagagaggauccggccagguggggaccuacggacugaacacauuuaccaacauggaagcucagcugauccgccaaauggagucugaggaaauuuucagccccuccgagcucgaaacaccgaaucuggccgagcgggcgcuugacuggcuggaaaaauauggcguugagagacucaagcgcauggccaucagcggggaugacuguguggucaaaccuaucgacgaucgguuugcuaccgcccugacggcucuuaacgacaugggaaaggugagaaaagauauuccccagugggagccuucuaagggcuggaaugacuggcagcagguucccuucugcucccaucacuuucaccaacugaucaugaaggaugggcgcgaaauuguggucccuugucggaaccaggacgagcucgugggcagagcccgcgucagccagggagcuggcuggucucugcgggaaacagccugccuggggaaauccuacgcgcagauguggcaacucauguauuuccauagacgcgaucugcggcuugccgacaaggcuaucggaagcgccgugcccguugauugggugccgaccuccagaacaaccuggucuauucacgcccaucaccaguggaugacgaccgaggacaugcugagcgucuggaaucggguguggaucgaagagaacccuuggauggaggauaaaacacauauuuccagcugggaagacguucccuaccucggcaagagagaggaccaguggugugggucucugaucggacuuaccgcucgcgccacaugggcgaccaauauccaaguggcuauuaaccagguccggagacugaucggcaaugaaaacuaccucgauuauaugacauccaugaaacgcuuuaagaaugagagcgaccccgagggggcccugugguga

SEQ ID NO: 19076 - RNA, 9879 nt, Artificial Sequence
  derived and/or modified CDS sequence (opt5) from DENV-1__GQ199829__SS-prME
agcgugaccaugcugcugaugcugaugcccaccgcccuugcuuuccaccugacgacccggggcggggaaccucauaugaucgucuccaagcaggaacggggaaagucucuccuguuuaagaccagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcaccggcgggacaagcgcucuguugcccuggccccucauguggggcugggacucgagacccggacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcacccucgucgauagaggcuggggcaauggguguggacuguuuggcaaagggucucuuauuacaugcgcuaaguucaagugcgugacgaaacuggagggaaagaucguucaguacgaaaaccucaaauauuccgugaucgucaccgugcacacaggcgaccagcaucaaguugggaaugagagcaccgaacacggaacaaccgccacgauuacaccccaagcuccuaccaccgagauccagcugacagacuacggcgcccugacccucgauuguucuccccggacgggccuggacuuuaacgaaauggugcuucugacaaugaaggagaaauccuggcucguccauaagcagugguuccuggaucuuccucugcccuggaccagcggggccuccacaucucaagagaccuggaaucgccaggaccuccuggugaccuuuaaaacagcucacgcgaagaagcaggaagucgugguucugggaagccaagagggcgccaugcacacggcucucaccggggccacagaaauucagaccuccggaacaaccacgaucuucgccggccaucugaaaugcagacuuaagauggauaaacugacacucaaggggaugagcuaugugauguguaccggcucuuuuaaacuggagaaggaagucgcugagacccagcacggaacagugcugguucagauuaaguacgagggcaccgacgccccgugcaaaaucccuuucuccacacaagaugaaaagggggugacgcagaacggacggcuuaucaccgcgaaucccauugucacagacaaagagaagccugugaacaucgaagcugagccgcccuucggcgagagcuauauugugaucggggccggagaaaaagcccucaagcugucuugguuuaagaaaggcagcuccauugggaagauguucgaggcuaccgccagaggcgcucgccggauggccauccugggagauacagcgugggacuuuggcucuaucgggggaguuuucaccagcgucggcaaacucgugcaucagauuuuugggacggccuacggagugcuguucuccggcgucagcuggaccaugaagaucgggauuggcgugcuucugacauggcucggacucaauucuagauccaccagccugucuaugacauguaucgcuguuggccuugugacccucuaccugggggucauggugcaggccgauuccggaugcguuauuaacuggaaaggccgcgaacugaagugugggagcggaaucuuugugacaaaugagguccacaccuggacggaacaauauaaguuccaggcugacuccccuaaacggcucucugccgcgauuggcaaggccugggaggagggggugugcggcaucagaagcgcuacacgccuggaaaacaucauguggaaacagauuuccaacgagcuuaaucauauccugcucgaaaacgacaugaaguuuaccguuguggucggagauguggccggcauucuggcucaggggaaaaagaugauccggccgcaacccauggaguacaaauauucuuggaaaagcuggggaaaggccaagauuaucggcgccgacgugcagaauaccacauucaucauugaugggccuaacacccccgaauguccugacgaucagagagcuuggaauaucugggaggucgaggacuacggauuuggcauuuucacgacaaacaucuggcugaaacuucgcgauuccuauacccagguuugcgaccaccggcucaugagcgcggccauuaaagauucuaaggcugugcacgccgacaugggcuacuggaucgaauccgagaaaaaugaaacauggaagcuggccagagcuagcuuuaucgaggugaagaccuguauuuggccccgcucucauacacugugguccaacgggguccucgaaagcgagaugaucauuccgaaaaucuauggaggcccuauuucucaacacaauuaccggcccggguacuucacccaggccgcgggaccuuggcaucugggcaaacuugagcuggauuucgaccucugcgaagggacgaccgugguuguggaugagcacugcggaaacagaggccccagccugcggacaaccacagucaccggcaaaaucauccacgaaugguguugccgcuccuguacgcugccuccccuuagauuuagaggggaagacggaugcugguauggcauggagauuagaccggugaaggaaaaagaggaaaaucucguuaagagcauggugucugcuggguccggagaggucgacagcuucucccugggccugcucuguaucucuauuaugaucgaagaggugaugcgcagccggugguccagacgcaugcugaugacagggacccuugccgucuuuuuccugcucauuaugggacagcugacauggaacgaucugaucagacuuugcauuauggugggcgccaaugcuucugaccggaugggcauggggaccaccuaccuggcccucauggcgacauuuaagaugcgcccuauguucgcugucggacugcucuuuagacggcugacgagccgcgaggugcuucugcucaccaucggccugucccugguggccucugucgaacuucccaacagccuggaggaacucggggauggacuggccaugggcaucaugauucucaaacugcuuacagacuuccaaucccaucagcugugggcuacccuccugagccugacauuuaucaagaccacguucucucuucacuaugccuggaaaacaauggcuaugguucuguccauugugagccucuuuccccugugucucucuaccaccucccagaagacaaccuggcugccugugcuucuggggagccugggaugcaaaccgcucacaauguuccugaucgccgagaauaagauuuggggcagacggucuuggccccuuaacgaaggcaucauggcggucgggaucguguccauucugcucagcucccugcucaagaacgauguuccucuggccggaccccuuaucgcuggcgggaugcugauugccuguuacgugaucagcggaucuagcgcugaccugucccucgagaaagccgccgaggucucuugggaagaggaagcugagcauagcggcgcgucccacaauauucugguggaaguucaggaugacgggacgaugaagaucaaagaugaggagcgcgacgauacccuuacaauccugcucaaggccacccugcucgcugugucuggagucuauccucugagcauucccgccacacuuuuugugugguacuucuggcagaagaagaaacagagauccggcguccugugggacaccccuucucccccggaaguggagcgggccguucuggaugacggcaucuaucgcauuaugcagagagggcuccugggacggagccaggugggcgucgggguguuccaagaaaacguuuuucauacgauguggcacgugaccagaggagcuguccuuauguaccagggcaagcgccuggagccuuccugggccagcgugaagaaagaccucaucucuuacgggggaggcuggcggcugcagggcuccuggaauacaggggaggaagugcagguuauugcggucgagcccggaaagaacccuaaaaaugugcaaaccgcucccggcacauucaagaccccggaaggggaggugggagccaucgcccucgauuuuaaaccuggcacaagcgggucucccauugucaacagagaaggaaagaucgugggccuguauggcaaugggguugugacgaccuccggaacauacgucagcgcuaucgcccaggcgaaggcuucccaggagggcccucuucccgagauugaagacgagguguuccgcaaacggaaccugaccaucauggaucugcaccccgggucuggaaagaccagacgcuaucucccugccauuguucgggaagccaucaaaagaaagcugcgcacacuuauucuggcuccgacgcggguggucgccagcgagauggcugaagcccucaaaggcaugcccaucagauaccaaaccacagcggugaaguccgagcauaccgggaaggagaucguugaccugaugugccacgccacauuuaccaugcggcugcucagcccugugcgcguccccaauuauaacaugauuaucauggaugaagcucauuucacggacccuucuuccauugccgcuagaggcuacaucagcacacgggugggaaugggcgaggccgccgcuauuuuuaugaccgcgacacccccugggucuguggaagccuucccgcagagcaaugcugucauccaggaugaggaacgcgacauccccgagagauccuggaacucuggauaugaguggauuacagauuuuccuggcaaaaccguuugguucgugcccagcaucaaguccgggaaugacauugccaacugucuucggaaaaauggaaagagagugauccagcugucucgcaaaacauuugauaccgaauaccaaaagacgaagaacaacgacugggacuacgucgugacaaccgauauuagcgagaugggcgccaauuuccgggcugacagaguuaucgauccucgccggugccugaaacccgugauucucaaggacgggccggaaagagucauccuggccggcccuaugcccgugacaguugcguccgcugcccagcgccggggaagaaucggccgcaaccacaauaaagagggggaucaguauauuuacaugggacagccccuuaacaaugacgaggaucaugcccacuggaccgaagcuaagaugcugcucgacaacaucaauacgccugagggcauuauccccgcccuguucgaaccugagagagaaaagagcgcggccauugauggggaguaucggcugcgcggagaggcuagaaagaccuuuguggagcucaugcggcgcggcgaccuuccggucuggcugucuuacaagguggccuccgagggguuccaauauagcgauagacgguggugcuuugacggcgaaagaaacaaucagguccuggaggaaaacauggauguggagaucuggacaaaagagggagaacgcaagaaacuccggcccagauggcuggacgcucgcaccuacuccgacccucuugcccugcgggaguucaaggaauuugcugccggcagacggucuguuagcggggaucucauccuggagauuggaaaacugccccagcaccucacacagcgcgcgcaaaaugcccuugacaaccuggugaugcugcauaauuccgaacagggcgggagagcuuaucggcacgccauggaggagcucccugauaccaucgaaacacugaugcuucuggcucucauugccgugcugaccggaggcgucacgcuguucuuucucucuggccgcgggcuuggaaagacaagcaucggccugcuguguguuauggccuccagcgugcuccuguggauggcuucuguggagccccauuggauugcggccuccaucauccuugaguucuuucugaugguccuccugauuccggagccugacagacagcggacaccccaggauaaccaacuggcuuacgugguuaucgggcuccuuuucaugauucugaccguggccgccaaugagaugggacugcucgaaacaaccaaaaaggaccugggcaucgggcacgucgcuguggagaaccaccaucacgccgcgaugcuugaugucgaccugcauccugccagcgcuuggacacucuacgccguggcuacgaccauuaucacacccaugaugcgccacaccauugaaaacacaaccgccaauaucucucugacggcgaucgccaaccaggcugccauucugaugggacucgauaagggcuggccuaucuccaaaauggacauuggcguuccccuucuggcucuggggugcuauagccaggugaauccgcucacccugacagccgcuguccuuaugcugguggcccauuacgcgaucauuggaccuggccuccaagccaaggcuaccagagaggcccagaaacggacagcugccgggaucaugaagaaccccaccguugauggaaucguggccauugaccuggaucccgucguguaugacgcgaaauuugaaaagcagcugggccagaucaugcuccuuauucuguguacgucucaaauccugcucaugcgcacaaccugggcucugugcgagagcauuacacuugccaccgggccucugaccacacucugggagggauccccgggcaaguucuggaauacgaccaucgcugugucuauggccaacaucuuuagaggcagcuaccuggccggggcuggacuggccuucucccucaugaaaagccuuggcgggggacggagaggcacaggggcgcagggagaaacccugggcgagaaguggaaacgccagcugaaucagcucuccaagucugaguucaacacauauaaacggagcggcauuauggagguugacagauccgaagccaaggaggggcugaagcgcggagagaccacgaaacacgcugucucucggggcacagccaaacuuagaugguuuguggaacgcaaucuggugaaacccgaggggaaggucaucgaucucggauguggcagagggggauggagcuacuauugcgcuggccugaaaaagguuaccgaagugaagggcuacaccaaagggggaccuggccacgaggaacccauuccuauggccacauacggguggaaccuggugaagcuccauuccggaaaagacgucuucuuuauucccccugagaagugugauacccuucugugcgacaucggcgagucuagcccgaaucccacaaucgaagaggggagaacgcugcgcgugcucaaaaugguugaaccuuggcugcggggaaaccaauucuguauuaagauccuuaaucccuauaugccuuccguggucgagacccuggagcagaugcagagaaaacacggcggcaugcucgugcgcaacccccugagcagaaauucuacacaugaaauguacuggguuuccugcgggaccggaaacaucgugagcgcggucaauaugacaucuagaaugcugcucaaccgcuuuaccauggcccacagaaagccgacguaugagcgggauguggaccugggcgcugggacccgccacguggccgucgaaccugagguugcuaaccuugauauuaucggacagagaauugaaaauaucaagcaugagcacaaauccacauggcauuacgacgaggauaaccccuauaagaccugggccuaccacggcagcuaugaagugaaacccucuggguccgcuagcuccauggugaauggagucgugaagcugcucacaaaaccuugggacguuauucccauggugacccaaaucgccaugacagauaccacgccuuucggccagcagcgggucuuuaaggagaagguggacacaagaaccccgaaagcgaagcggggcaccgcccaaaucauggaaguuacagcuaaauggcuguggggguuccuuagccgcaacaagaaacccagaauuuguacgcgggaggaauuuacccgcaaggugagaucuaaugccgcuaucggagccgucuucguggacgagaaccaguggaauagcgccaaggaggcgguugaagaugagcgguuuugggaccuggugcaucgcgaaagagagcuccacaaacagggcaagugcgcuacaugcgucuacaacaugauggggaaacgggaaaagaaacugggagaguucggcaaggccaaggggucccgcgccauuugguacauguggcugggcgcuagauuucucgaguucgaagcccugggauucaugaaugaggaucacugguuuucucgggaaaacagccuuuccggcguggagggggagggacugcauaaacucggcuauauccugcgcgacauuucuaagaucccugggggaaauauguacgcugaugacaccgccggcugggauacaagaaucaccgaagacgaucuucagaacgaggcgcggauuacagacaucauggaacccgagcacgcccugcucgcuaaaagcauuuucaagcugaccuaucaaaauaaagucgugcgcguucagagaccugccaagaacgggacggugauggaugucaucucccggagagaccagcgcggcucuggacaggugggcaccuacgggcugaauacauuuaccaacauggaagcucaacucauucggcagauggagagcgagggaaucuucucccccagcgaacuggagacaccgaaccuugccgaaagagugcuggauuggcucgagaaauauggcguugaacgccugaagcggauggcgaucucuggggacgacuguguggucaagccuauugaugacagauuugccaccgcucuuacggcccugaaugauaugggaaaagugcgcaaggacaucccccagugggagccuuccaaaggcuggaacgauuggcagcaaguucccuucugcagccaucacuuucaccagcucauuaugaaggacgggcgggagaucguggucccuuguagaaaucaggaugaacuggugggccgcgcucgggucucucagggagccggcuggucccugagagagacagcuugccucgggaaaagcuacgcccaaauguggcagcugauguauuuccaucgccgggaccuuagacuggcggccaacgcuauuuguuccgccgugcccguugauuggaucccgaccucucggacaaccuggagcauucacgcccaucaccaguggaugacgaccgaagacaugcucuccguguggaauagagucuggaucgaggaaaacccuuggauggaggauaagacacauaucagcucuuggggagacgugcccuaccugggcaagcgcgaggaccaauggugcgggucccuuauuggacugaccgcucgggccacaugggcgaccaauauccagguugcuauuaaccaggugagacgccucaucggcaaugaaaacuaccuggauuauaugacaagcaugaaaagauuuaagaaugagucugaccccgaaggggcccugugguga

SEQ ID NO: 19077 - RNA, 9879 nt, Artificial Sequence
  derived and/or modified CDS sequence (opt5) from DENV-1__FJ882562__SS-prME
agcgugaccaugcugcucaugcugaugcccaccgcccuugcuuuccaccugacgacccggggaggggaaccucauaugaucgucuccaagcaggaacggggaaaaucucuccuguuuaagaccagcgccggcguuaacaugugcacccuuaucgcgauggaccugggggaacucugugaagauacaaugaccuacaaaugccccagaaucacagaagcugaacccgacgauguggacuguuggugcaaugccaccgauacgugggugaccuauggaacauguucccaaaccggcgagcaccggcgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggacuguuuacaagcguuggcaaacucguccaucagauuuucgggaccgcuuacggagugcuguuuuccggcgugagcuggacgaugaagaucgggauuggcguccuucugaccuggcucggacucaauucuagauccacaagccugucuaugaccuguaucgccgugggccuuguuacacucuaccugggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcucucugcggccauuggcaaggcuugggaggagggggucugcggcaucagaagcgccacgcgccuggaaaacaucauguggaaacagauuuccaacgagcuuaaucauauccugcucgaaaacgacaugaagcugacagugguugugggagaugucgcuggcauucuggcccaggggaaaaagaugauccggccgcaacccauggaguacaaauauucuuggaaaagcuggggaaaggccaagauuaucggcgcugacgcgcagaauaccaccuucaucauugaugggccuaacacacccgaauguccugacgaucagagagccuggaauaucugggagguggaggacuacggauuuggcauuuucaccacgaacaucuggcuuaagcuccgcgauuccuauacacaggugugcgaccaccggcugaugagcgcugccauuaaagauucuaaggccguccacgcugacaugggcuacuggaucgaauccgagaaaaaugaaaccuggaagcuggccagagcgagcuuuaucgagguuaagacauguauuuggcccaaaucucauacccucugguccaacggggugcuggaaagcgagaugaucauuccgaagaucuauggaggcccuauuucucaacacaauuaccgccccggguacuucacacagaccgcuggaccuuggcaucuuggcaaacuggagcucgauuucgaccugugcgaagggacgaccguggucguggaugagcacugcggaaaccggggccccagccugagaacaaccacaguuaccggcaagaucauccacgaaugguguugccgguccuguacgcuuccuccccuccgcuuuagaggggaggacggaugcugguauggcauggagauucggccggugaaagaaaaggaggaaaaucuggucaagagcauggugucugccggguccggagagguugacagcuucucccugggccuccuguguaucucuauuaugaucgaagaggugaugagaagccgcuggucccggaaaaugcuuaugacagggacccuggccgucuuuuuccuccugauuaugggacagcugacauggaacgaucuuaucagacugugcauuauggugggcgcuaaugccucugaccgcaugggcauggggaccaccuaccucgcgcugauggcuacauuuaagaugagaccuauguucgccguuggacuccuguuucggcgccuuacgagcagagaggugcugcuccugaccaucggccugucccuugucgccucuguggaacugcccaacagccucgaggaacugggggauggacucgcuaugggcaucaugauucugaaacuucugacagacuuccaaucccaucagcucugggccacccugcugagccuuacauuuaucaagaccacguucucucugcacuaugcuuggaaaacaauggccauggugcucuccauugucagccuguuuccccucugucugucuaccaccucccagaagacaaccuggcuuccuguucugcuggggagccucggaugcaagccgcugacaauguuccuuaucgcggagaauaaaauuuggggccggaagucuuggccccugaacgaaggcaucauggccguggggaucguguccauucuccugagcucccuccugaaaaacgaugucccucuugcuggaccccugaucgccggcgggaugcugauugcuuguuacgugaucagcggaucuagcgccgaccucucccuggagaaggccgcugagguuucuugggaagaggaagcggagcauagcggcgccucccacaauauucuuguggaaguccaggaugacgggacgaugaaaaucaaggaugaggagcgcgacgauacccugacaauccuccugaaagcuacccuccuggccgugucuggaguuuauccucuuagcauucccgccacacuguuugugugguacuucuggcaaaagaagaaacagagauccggcguccugugggacaccccuucucccccggaaguggagcgggcuguccucgaugacggcaucuaucgcauuaugcagagagggcugcuuggacggagccaggugggcguugggguguuccaagaaaacgucuuucauacgauguggcacgugacccgcggagccguucugauguaccagggcaagagacucgagccuuccugggcgagcgugaaaaaggaccugaucucuuacgggggaggcuggcggcuccagggcuccuggaauacaggggaggaaguccaggugauugcuguggagcccggcaagaacccuaagaauguucaaaccgcccccggcacauucaagaccccggaaggggaggucggagccaucgcucuggauuuuaaaccuggcacaagcgggucucccauugugaacagagaaggaaagaucgugggccuuuauggcaauggggucgugacgaccuccggaacauacguuagcgccaucgcgcaggcuaaagccucccaggagggcccucugcccgagauugaagacgagguguuccgcaagcggaaccugaccaucauggaucuccaccccgggucuggaaaaaccagacgcuaucugccugccauuguccgggaagcuaucaagagaaaacuucgcacacugauucucgccccgacgcgggugguugcuagcgagauggccgaagcgcugaaaggcaugcccaucagauaccaaaccacagccgugaaguccgagcauaccgggaaagagaucgucgaccugaugugccacgcuacauuuaccaugcgccuccuuagcccugugcggguucccaauuauaacaugauuaucauggaugaagcccauuucacggacccuucuuccauugcugccagaggcuacaucagcacacgggugggaaugggcgaggccgcugcgauuuuuaugaccgccacacccccugggucugucgaggcuuucccgcagagcaaugccgugauccaggaugaggaacgcgacauccccgagagauccuggaacucuggauaugaguggauuacagauuuuccuggcaagaccgugugguucguccccagcaucaaauccgggaaugacauugccaacugucugcggaagaauggaaagcgcguuauccagcugucuagaaaaacauuugauaccgaauaccaaaagacgaaaaacaacgacugggacuacguggugacaaccgauauuagcgagaugggcgcuaauuuccgggccgacagagucaucgauccucgccggugccucaagcccgugauucugaaagacgggccggaaagaguuauccuugcgggcccuaugcccgugacagucgcuuccgccgcccagcgccggggaagaaucggccgcaaccacaauaaggagggggaucaguauauuuacaugggacagccccugaacaaugacgaggaucaugcucacuggaccgaagccaagaugcuccuggacaacaucaauacgccugagggcauuauccccgcgcuguucgaaccugagcgggaaaagagcgccgcuauugauggggaguauagacuccgcggagaggccagaaagaccuuuguggagcuuaugcggcgcggcgaccugccgguuuggcugucuuacaaaguggcuuccgagggguuccaauauagcgauagacgguggugcuuugacggcgaacgcaacaaucagguccucgaggaaaacauggauguggagaucuggacaaaggagggagaacgcaagaagcugcggcccagauggcuugacgcccgcaccuacuccgacccucuggcucuccgggaguucaaagaauuugccgcgggcagacgcucugucagcggggaucugauccuggagauuggaaagcucccccagcaccuuacacagcgggcccaaaaugcucuggacaaccuggugaugcuccauaauuccgaacagggcgggagagccuaucggcacgcuauggaggagcugccugauaccaucgaaacacuuaugcugcucgcccugauugccguucugaccggaggcgugacgcuguucuuucuuucuggccgcgggcugggaaagacaagcaucggccugcucugugugaugaccuccagcguccugcuuuggauggcuucuguugagccccauuggauugcggccuccaucauccuggaguucuuucucauggugcugcugauuccggagccugacagacagcggacaccccaggauaaccaacucgcuuacguggucaucgggcuucuguucaugauucugacaguggccgccaaugagaugggacuccuggaaaccaccaaaaaggaccuuggcaucgggcacguugcuguggagaaccaccaucacgccgcgaugcuggaugucgaccuccauccugccagcgcuuggacgcuguacgccguggcuaccacaauuaucacccccaugaugcgccacacaauugaaaacaccacggccaauaucucucugaccgcgaucgccaaccaggcugccauucucaugggacuugauaaaggcuggccuaucuccaagauggacauuggcgucccccugcuggcucucgggugcuauagccaggugaauccgcugacacuuaccgccgcuguucugaugcucguggcccauuacgcgaucauuggaccuggccugcaagccaaagcuacaagagaggcccagaagcggaccgcugccgggaucaugaagaaccccacggucgauggaaucguggccauugaccuggaucccguuguguaugacgcgaaauuugaaaagcagcucggccagaucaugcuucugauucuguguacaucucaaauccuccugaugcgcaccacaugggcucuuugcgagagcauuacccuggccaccgggccucucacaacgcugugggagggauccccgggcaaauucuggaauaccacaaucgcugucucuauggccaacaucuuuagaggcagcuaccuggccggggcuggacucgccuucucccuuaugaaaagccugggcgggggacggcgcggcaccggggcgcagggagaaacacugggcgagaaauggaagagacagcucaaucagcuguccaagucugaguucaacaccuauaaacggagcggcauuauggagguggacagauccgaagccaaggaggggcuuaaacgcggagagacgacaaagcacgcugugucucggggcaccgccaaacugagaugguuuguugaacgcaaucucgucaagcccgaggggaaggugaucgaucugggauguggcagagggggauggagcuacuauugcgcuggccugaaaaaggugaccgaagucaaaggcuacacaaaagggggaccuggccacgaggaacccauuccuauggccaccuacggguggaaccucguuaaacuucauuccggaaaggacguguucuuuauucccccugagaaaugugauacacugcugugcgacauuggcgagucuagcccgaaucccacgaucgaagaggggagaacccuccgcgugcugaagauggucgaaccuuggcuucggggaaaccaauucuguauuaagauccugaaucccuauaugccuuccgugguugagacacucgagcagaugcagagaaaacacggcggcaugcuggugcgcaacccccugagcagaaauucuacccaugaaauguacugggucuccugcgggacaggaaacaucgugagcgcgguuaauaugaccucuagaaugcuccugaaccgcuuuacgauggcccaccggaagccgaccuaugagagagauguggaccuuggcacagggacccgccacgucgcuguggaaccugagguggccaaccuggauauuaucggacagagaauugaaaauaucaaacaugagcacaaguccacauggcauuacgacgaggauaaccccuauaaaaccugggcuuaccacggcagcuaugaagucaagcccucuggguccgccagcuccaugguuaauggaguggugaagcuccugacaaaaccuugggacgucauucccauggugacccaaaucgcuaugacggauacaaccccuuucggccagcagcggguuuuuaaggagaaaguggacacccgcacaccgaaggccaaaagaggcacggcgcaaaucauggaagucaccgcccgguggcuuuggggguuccugagcagaaacaagaagccccggauuuguacacgcgaggaauuuaccagaaaagugcggucuaaugcugccaucggagcuguuuucguggacgagaaccaguggaauagcgccaaggaggccgucgaagaugagcgcuuuugggaccucgugcauagagaacgggagcugcacaaacagggcaagugcgcgacaugcguuuacaacaugauggggaaacgcgaaaagaagcugggagaguucggcaaagcuaagggguccagagccauuugguacauguggcucggcgcccgguuucuggaguucgaagcucuuggauucaugaaugaggaucacugguuuucucgcgaaaacagccuguccggcguggagggggagggacuccauaaacugggcuauauccuuagagacauuucuaagaucccugggggaaauauguacgccgaugacaccgcuggcugggauacacggaucaccgaagacgaucugcagaacgaggccaaaauuacggacaucauggaacccgagcacgcgcuccuggccaaggcuauuuucaaacugaccuaucaaaauaaggucgugcgcguccagagaccugccaagaacgggacagugauggauguuaucagccggcgcgaccagagaggcuccggacaggugggcaccuacgggcucaauacauuuaccaacauggaagcucaacugauucggcagauggagucugagggaaucuucagccccuccgaacuugagacgccgaaccuggccgaaagagcgcucgauuggcuggagaaauauggcgucgaacgccuuaagcggauggccaucagcggggacgacuguguggugaaaccuauugaugacagauuugcuacagcccugaccgcucucaaugauaugggaaagguucgcaaagacaucccccagugggagccuucuaagggcuggaacgauuggcagcaagugcccuucugcucccaucacuuucaccagcugauuaugaaggacgggcgggagaucgucgugccuuguagaaaucaggaugaacugguuggccgcgcccgggugagccagggagcuggcuggucucucagagagacagccugccuggggaaauccuacgcgcaaauguggcagcuuauguauuuccaucgccgggaccugagacucgccgcuaacgccauuuguagcgccguccccguggauugggucccgaccucccgcacgaccuggucuauccacgcucaucaccaguggaugacaaccgaagacaugcugagcguguggaaucggguuuggauugaggaaaacccuuggauggaggauaagacacauaucuccagcugggaggacgugcccuaccuuggaaaaagagaagaccaauggugcggcucucugaucgggcucaccgcccgggcgacaugggcuaccaauauucaggucgccaucaaccaggugagacgccugauuggaaaugagaacuaccuggauuauaugacguccaugaagcgguuuaaaaaugaaagcgaccccgagggcgcccucugguga

SEQ ID NO: 19078 - RNA, 9879 nt, Artificial Sequence
  derived and/or modified CDS sequence (opt5) from DENV-1__FJ882564__SS-prME
agcgugaccaugcugcucaugcugaugcccaccgcccuugcuuuccaccugacgacccggggaggggagccucauaugaucgucacaaagcaggaacggggaaaaucccuccuguuuaagaccucugccggcguuaacaugugcacacuuauugcgauggaccugggggagcucugugaagauaccaugacauacaaaugcccccgcaucaccgaggcugaacccgacgauguggacuguuggugcaaugccacggauaccugggugacauauggaaccuguagccagacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacggaaugaaguucacagugguugugggcgacgucguggggauucucgcucagggcaaaaagaugauccggccgcaacccauggagcacaaauacucuuggaaaagcuggggcaaggccaagauuaucggggccgaugugcagaauaccaccuuuaucauugacggaccuaacacacccgaauguccugaugaccagagagcuuggaauaucugggaggucgaggauuauggcuucggcauuuuuaccacgaacaucuggcugaagcugcgcgacuccuacacacagguuugcgaucaccggcuuaugagcgcggccauuaaagacucuaaggcugugcaugccgauaugggguauuggaucgaauccgagaaaaaugaaaccuggaagcucgccagagcuagcuucaucgaggugaagacauguauuuggcccaaaucucacacccugugguccaacggaguccuggaaagcgagaugaucauuccgaagaucuacggcgggccuauuucucaacauaauuaucgccccggauacuucacacagaccgccggcccuuggcaccucgggaaacuggagcuugacuuugaucugugcgaaggaacgaccgugguuguggacgagcacugcggcaaccggggccccagccucagaacaaccacagucaccgggaagaucauccaugaaugguguugccgguccuguacgcugccuccccugcgcuucaaaggagaggauggcugcugguacgggauggagauuagaccggugaaggaaaaggaggaaaaucuuguuaaaagcauggugucugcgggauccggcgaggucgacagcuuuucccucgggcugcuguguacaucuaucaugauugaagaggugaugcggagcagauggucccgcaagaugcucaugaccggaacacuggcuguuuuccuucugcucaucaugggccagcugaccuggaacgaccugauucggcuuugcaucauggugggcgccaaugccucugauagaauggggaugggaaccacauaucuggcucucauggccacguuuaaaaugcgcccuauggucgcggugggccugcuguucagacggcugaccagccgcgaggugcuucugcucacaauugggcugucccuggucgcuucuguugaacuucccaacagccuggaggaacucggagacggccuggccauggggaucaugauccucaagcugcuuaccgauuuucaaucccaccagcugugggccacacuccugagccugaccuucauuaaaacgacacuuucucugcauuacgcuuggaagaccauggccauggugcucuccaucgugagccuguuuccccucugucugucuaccacaucccagaagaccacauggcuuccuguccugcugggaagccucggcugcaaaccgcugacgauguuccuuauugcugagaauaagaucuggggcagaaaaucuuggccccugaacgaagggauuauggccgugggaguuguguccauccuccugagcucccuccugaagaacgacgucccucuugcgggcccccugaucgccgggggaaugcugauugcuuguuaugugaucagcggcucuagcgccgaucucucccuggagaaagcugccgagguuucuugggaagaggaagccgagcacagcggggcuucccauaauauucuuguggaaguccaggacgauggaaccaugaagaucaaagacgaggagcgggaugacacacugaccauucuccugaaggcgacacuccuggccgugucuggcgucuacccucuuagcauccccgcuacccuguuugugugguauuucuggcaaaagaaaaagcagcgcuccggcguucugugggauacgccuucucccccggaaguggagagagccguccucgacgaugggaucuaccggauuaugcagcgcggacugcuuggcagaagccagguggggguuggaguguuucaagaaaacgucuuccacaccauguggcacgugacacggggcgccgugcugauguaucaggggaaacgccucgagccuuccugggcuagcguuaagaaagaccugaucucuuacggaggcggcuggagacuccagggguccuggaauaccggagaggaaguccaggugauugccguggagcccggcaagaacccuaagaauguccaaacagcgcccgggaccuucaaaacaccggaaggagaggugggcgcuaucgcccuggacuuuaagccugggacgagcggaucucccauuguuaaccgggaaggcaaaaucgugggccuuuacgggaauggagucgugaccacauccggcaccuauguuagcgccauugcucaggccaaggcgucccaggaggggccucugcccgagaucgaagaugagguguucagaaaacgcaaccugaccaucauggaccuccaucccggaucuggcaagacacggagauaccugccugcuauuguccgcgaagccaucaagcggaaacuuagaacgcugauucucgccccgacccgcgugguugcuagcgagauggccgaagcucugaaggggaugcccauccgguaucaaacaaccgccgugaaauccgagcacacaggcaaggagauugucgaucugaugugccaugcgaccuuuacgaugagacuccuuagcccugugcgcgugcccaauuacaacaugaucaucauggacgaagcccacuucacagauccuucuuccauugcugcccggggauauaucagcaccagagucggcaugggggaggcugccgccauuuuuaugaccgcuacacccccuggaucuguugaagcguucccgcagagcaaugccgugauccaggacgaggaacgggauauucccgagcgcuccuggaacucuggcuacgaguggaucaccgacuuuccugggaaaacagugugguucguccccagcaucaaguccggaaaugauauugcuaacugucugagaaagaauggcaaacgggugauccagcugucucgcaagaccuuugacacggaauaucagaaaaccaagaacaacgauugggacuacguugugaccacagacauuagcgagaugggggccaauuucagagccgaucgggucaucgacccuagacgcugccucaaacccgugauucugaaggauggcccggaacggguuauccuugcuggaccuaugcccgugaccgucgccuccgcggcucagagacgcggccggauugggagaaaccauaauaaggagggagaccaguacaucuauaugggccagccccugaacaaugaugaggaccacgcccacuggacggaagccaaaaugcuccuggauaacaucaauaccccugaggggauuauccccgcucuguuugaaccugagcgcgaaaagagcgccgcgauugacggagaguaccggcucagaggcgaggcccgcaaaacauucguggaacuuaugagaagaggggaucugccggucuggcugucuuauaagguggcuuccgagggcuuccaauacagcgaccgcagauggugcuuugauggagaacggaacaaucagguucucgaggaaaacauggacguggagaucuggaccaaagagggcgaacgcaagaaacugagaccccgguggcuugaugccagaacauauuccgacccucuggcucuccgcgaguucaaggaauuugccgcugggcggagaucugugagcggagaccugauucuggagaucggcaagcucccccagcaucuuacccagcgcgcccaaaaugcgcuggauaaccuggucaugcuccacaauuccgaacaagggggacgggccuacagacaugcuauggaggagcugccugacacaaucgaaacccuuaugcugcucgcccugauugcuguucugacgggcggcgugacacucuucuuucuuucugggcggggacugggcaaaaccagcaucgggcugcucugugugauggccuccagcguccugcuuuggauggccucuguggagccccacuggauugcugcguccaucauucuggaguucuuucucaugguucugcugaucccggagccugaucgccagagaacaccccaggacaaccaacucgccuauguggucaucggacuucuguucaugauucugacaguggcugccaaugagaugggccuccuggaaaccacaaagaaagaucuugggaucggacacgucgccguggagaaccaucaccaugcuacgaugcuggacguugaucuccacccugccagcgcguggacccuguacgccguggcuacaaccauuaucacacccaugaugcggcauaccauugaaaacacgaccgccaauaucucucugacagcuauugccaaccaggcggccauccucaugggccuugacaagggcuggccuaucuccaaaauggauauuggggucccccugcuggcucucggaugcuacagccaggugaauccgcugacccuuacagccgcuguucugaugcucguggcccacuaugcuaucauuggcccugggcugcaagccaaggcgacccgcgaggcccagaagagaacggcugccggaaucaugaaaaaccccacagucgacggcauuguggcuaucgaucuggaccccgugguuuacgaugccaaguuugaaaaacagcucgggcagaucaugcuucugauucuguguaccucucaaauccuccugaugcggacaaccugggcccuuugcgagagcauuacccuggcgacaggaccucucacgacccugugggagggcuccccgggcaaguucuggaauacaaccaucgcugucucuauggccaacauuuuucgcgggagcuaucuggcuggagccggccucgccuucucccuuaugaaaagccucgggggaggcagacgggggacaggagcucagggcgaaacccugggcgagaaguggaagcgccagcucaaucagcuguccaaaucugaauuuaacaucuacaagagaagcgggaucauggagguggaccgguccgaagccaaagagggacuuaagagaggcgagacgacacgccacgcggugucucgggggaccgccaaacugagaugguucgucgaacgcaaucucguuaagcccgagggaaaggugauugaccugggcugugggcggggaggcuggagcuauuacugcgcuggccugaaaaaggugaccgaagucaaaggguauacaaagggaggcccugggcaugaggaacccaucccuauggccaccuacggauggaaccucgugaaacuucacuccggcaaggauguuuucuuuacacccccugagaaaugugacacgcugcugugcgauauuggggagucuagcccgaaucccaccaucgaagagggaagaacacuccgcgugcugaagauggucgaaccuuggcuucggggcaaccaauucuguauuaagauccugaaucccuacaugccuuccgugguugagacccucgagcagaugcagagaaaacauggcgggaugcuggugcgcaacccccugagcagaaauucuacacacgaaauguauugggucuccugcggaaccggcaacauugugagcgcugugaauaugacgucuagaaugcuccugaaccgcuuuaccauggcccaccggaagccgacauacgagagagacgucgaucuuggggcgggaacccgccauguugccguggaaccugagguggcuaaccuggacaucaucggccagagaauugaaaauaucaaacacgagcauaaguccacauggcacuaugaugaggacaaccccuacaaaaccugggccuaucaugggagcuacgaagucaagcccucuggauccgcuagcuccauggugaauggcguugugaagcuccugacaaaaccuugggaugucauucccauggugacccaaaucgccaugacggacacaaccccuuucggccagcagcggguuuuuaaggagaaaguggauacccgcacaccgaaggcuaaaagagggacggcccaaauuauggaagucaccgcgcgguggcuuuggggauuccugagcagaaacaagaagccccggaucuguacacgcgaggaauuuaccagaaaagugcggucuaaugccgcuaucggcgccguuuucguggacgagaaccaguggaauagcgcuaaggaggccgucgaagacgagcgcuuuugggaucucgugcagaaagaaagagagcugcacaagcaggggaaaugcgccacaugcgucuauaacaugaugggaaagcgggaaaagaaacugggcgaguucgggaaggcgaaaggcucccgcgcuauuugguacauguggcucggagccagauuucuggaguucgaagcccuuggcuuuaugaaugaggaccacugguucucucgggaaaacagccuguccgggguggagggagagggccuccauaagcugggguacauccuucgcgauauuucuaaaaucccuggaggcaauauguaugcugacgauaccgccgggugggacacaagaauuaccgaagaugaccugcaaaacgaggcuaagaucacggauaucauggaacccgagcacgcccuccuggcgaccagcauuuucaaacugacauaccagaauaagguugugcggguccagcgcccugccaagaacggcaccgugauggacgugaucuccagacgggaucagcgcggaucuggccaaguugggacauauggacucaauaccuuuacgaacauggaagcucagcugauuagacagauggagagcgagggcaucuuccuucccuccgaacuggagacaccgaaccucgccgaacgggugcuggacuggcuugagaaauacggggucgaaagacugaagcgcauggcuauuagcggagaugacugugugguuaaaccuaucgacgaucgguuugccaccgcgcucacagcccugaaugacaugggcaaggugagaaaagauaucccccagugggagccuucuaagggguggaacgacuggcaacagguccccuucugcucccaucacuuucaccagcugauuaugaaggauggccgcgagaucguggucccuugucggaaucaggacgaacucgugggacgggcucgcguuagccaaggcgccggguggucucugcgggagaccgcuugccuuggaaaauccuaugcccagauguggcagcugauguacuuccauagacgcgaucuccggcuggcugccaacgcgauuuguagcgccgugcccgucgacugggugccgacguccagaaccacauggucuauccacgcucaucaccaauggaugaccacagaagauaugcuuagcguuuggaaucgcguguggauugaggaaaacccuuggauggaggacaagacccaugucuccagcuggggcgaugugcccuaucuggggaaacgggaggaccaguggugcggaucucucaucggccugacagccagagccaccugggcuuccaauauucagguggccaucaaccagguucggagacugaucgggaaugaaaacuaccucgacuacaugacgagcaugaagcgcuuuaaaaaugagggcgaucccgaaggagcgcugugguga

SEQ ID NO: 19079 - RNA, 9879 nt, Artificial Sequence
  derived and/or modified CDS sequence (opt5) from DENV-1__FJ882565__SS-prME
agcgugaccaugcugcugaugcugaugcccaccgcccuugcuuuccaccugacgacccggggcggggaaccucauaugaucgucaccaagcaggaacggggaaaaucccuccuguuuaagaccucugccggcguuaacaugugcacccuuauugccauggaccugggggaacucugugaagauaccaugacauacaaaugcccccgcaucaccgaggcugaacccgacgauguggacuguuggugcaaugccacggauaccugggugaccuauggaaccuguagccagacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguucacagugguugugggagaugucgugggcauucucgcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaagcugcgcggcuccuacacacagguuugcgaucaccggcuuaugagcgcggccauuaaagacucuaaggcugugcaugccgauaugggguauuggaucgaauccgagaaaaaugaaaccuggaagcucgccagagcuagcuucaucgaggugaagacauguauuuggcccaaaucucacacccugugguccaacggaguccuggaaagcgagaugaucauuccgaagaucuacggcgggccuauuucucaacauaauuaucgccccggauacuucacacagaccgccggcccuuggcaccucgggaaacuggagcuugacuuugaucugugcgaaggaacgaccgugguuguggacgagcacugcggcaaccggggccccagccucagaacaaccacagucaccgggaagaucauccaugaaugguguugccgguccuguacgcugccuccccugcgcuucaaaggagaggauggcugcugguacgggauggagauuagaccggugaaggaaaaggaggaaaaucuuguuaaaagcauggugucugcgggauccggcgaggucgacagcuuuucccucgggcugcuguguaucucuauuaugaucgaagaggugaugcggagcagauggucccgcaagaugcucaugacaggaacccuggcuguuuuccuucugcucauuaugggccagcugacauggaacgaccugauccggcuuugcauuauggugggcgccaaugccucugauagaauggggaugggaaccaccuaucuggcucucauggccacauuuaaaaugcgcccuauguucgcggucggccugcucuuuagacggcugacgagccgcgaggugcuucugcucaccaucgggcugucccugguggcuucugucgaacuucccaacagccuggaggaacucggagacggccuggccauggggaucaugauucucaagcugcuuacagauuuccaaucccaccagcugugggccacccuccugagccugacauuuaucaaaaccacgcuuucucugcauuacgcuuggaagacaauggccaugguucucuccauugugagccuguucccccucugucugucuaccaccucccagaagacaaccuggcuuccugugcugcugggaagccucggcugcaaaccgcugacaauguuucuuaucgcugagaauaagauuuggggcagaaaaucuuggccccugaacgaagggaucauggccgucggagugguuuccauccuccugagcucccuccugaagaacgacgugccucuugcgggcccccugauugccgggggaaugcugaucgcuuguuaugucauuagcggcucuagcgccgaucucucccuggagaaagcugccgaggugucuugggaagaggaagccgagcacagcggggcuucccauaauauccuuguugaagugcaggacgauggaacgaugaagauuaaagacgaggagcgggaugacacccugacaauccuccugaaggcgacccuccuggccgucucuggcguguacccucuuagcauccccgcuacacuguucgucugguauuuuuggcaaaagaaaaagcagcgcuccggcgugcugugggauaccccuucucccccggaaguugagagagccgugcucgacgaugggauuuaccggaucaugcagcgcggacugcuuggcagaagccaggucggggugggaguuuuccaagaaaacguguuccacacgauguggcacgucacccggggcgccgugcugauguaucaggggaaacgccucgagccuuccugggcuagcgugaagaaagaccugauuucuuacggaggcggcuggagacuccagggguccuggaauacaggagaggaaguucaggucaucgccguggagcccggcaagaacccuaagaaugugcaaaccgcgcccgggacauuuaaaaccccggaaggagaggucggcgcuauugcccuggacuucaagccugggacaagcggaucucccaucgugaaccgggaaggcaaaauuguuggccuuuacgggaauggaguggucacgaccuccggcacauaugugagcgccaucgcucaggccaaggcgucccaggaggggccucugcccgagaucgaagaugagguuuuuagaaaacgcaaccugaccauuauggaccuccaucccggaucuggcaagacccggagauaccugccugcuaucgugcgcgaagccauuaagcggaaacuuagaacacugauccucgccccgacgcgcgucguggcuagcgagauggccgaagcucugaaggggaugcccauucgguaucaaaccacagccguuaaauccgagcacaccggcaaggagaucguggaucugaugugccaugcgacauucaccaugagacuccuuagcccuguccgcgugcccaauuacaacaugaucauuauggacgaagcccacuuuacggauccuucuuccaucgcugcccggggauauauuagcacaagagugggcaugggggaggcugccgccaucuucaugaccgcuacacccccuggaucugucgaagcguuuccgcagagcaaugccguuauucaggacgaggaacgggauauccccgagcgcuccuggaacucuggcuacgaguggaucacagacuucccugggaaaaccgugugguuugugcccagcauuaaguccggaaaugauaucgcuaacugucugagaaagaauggcaaacgggucauucagcugucucgcaagacauucgacaccgaauaucagaaaacgaagaacaacgauugggacuacgugguuacaaccgacaucagcgagaugggggccaauuuuagagccgaucgggugauugacccuagacgcugccucaaacccgucauccugaaggauggcccggaacgggugauucuugcuggaccuaugcccguuacaguggccuccgcggcucagagacgcggccggaucgggagaaaccauaauaaggagggagaccaguacaucuauaugggccagccccugaacaaugaugaggaccacgcccacuggaccgaagccaaaaugcuccuggauaacauuaauacgccugaggggaucauucccgcucuguucgaaccugagcgcgaaaagagcgccgcgaucgacggagaguaccggcucagaggcgaggcccgcaaaaccuucgucgaacuuaugagaagaggggaucugccgguguggcugucuuauaaggucgcuuccgagggcuuucaauacagcgaccgcagauggugcuucgauggagaacggaacaaucaggugcucgaggaaaacauggacguugagauuuggacaaaagagggcgaacgcaagaaacugagaccccgguggcuugaugccagaaccuauuccgacccucuggcucuccgcgaguuuaaggaguucgccgcugggcggagaucugugagcggagaccugauccuggagaucggcaagcucccccagcaucuuacacagcgcgcccaaaaugcgcuggauaaccuggugaugcuccacaauuccgaacaagggggacgggccuacagacaugcuauggaggagcugccugacaccauugaaacacuuaugcugcucgcccugaucgcuguccugaccggcggcguuacgcucuuuuuccuuucugggcggggacugggcaaaacaagcauugggcugcucugugugauggccuccagcgugcugcuuuggauggccucugucgagccccacuggaucgcugcguccauuauccuggaauuuuuccucauggugcugcugaucccggagccugaucgccagagaacaccccaggacaaccaacucgccuauguugugauuggacuucuguuuaugauccugaccgucgcugccaaugagaugggccuccuggaaacaaccaagaaagaucuugggauuggacacguggccgucgagaaccaucaccaugcuacaaugcuggacguggaucuccacccugccagcgcguggacgcuguacgccguugcuaccacaaucauuacccccaugaugcggcauacaaucgaaaacaccacggccaauauuucucugaccgcuaucgccaaccaggcggccauccucaugggccuugacaagggcuggccuauuuccaaaauggauaucggggugccccugcuggcucucggaugcuacagccaggucaauccgcugacacuuaccgccgcugugcugaugcucguugcccacuaugcuauuaucggcccugggcugcaagccaaggcgacacgcgaggcccagaagagaaccgcugccggaauuaugaaaaaccccacgguggacggcaucgucgcuaucgaucuggaccccgugguguacgaugccaaguucgaaaaacagcucgggcagauuaugcuucugauccuguguacaucucaaauucuccugaugcggaccacaugggcccuuugcgagagcaucacccuggcgaccggaccucucacaacgcugugggagggcuccccgggcaaguuuuggaauaccacaauugcuguuucuauggccaacaucuuccgcgggagcuaucuggcuggagccggccucgccuuuucccuuaugaaaagccucgggggaggcagacgggggaccggagcucagggcgaaacacugggcgagaaguggaagcgccagcucaaucagcuguccaaaucugaguucaacaucuacaagagaagcgggauuauggaggucgaccgguccgaagccaaagagggacuuaagagaggcgagaccacgcgccacgcggugucucgggggacagccaaacugagaugguucguggaacgcaaucucgucaagcccgagggaaagguuaucgaccugggcugugggcggggaggcuggagcuauuacugcgcuggccugaaaaaggugaccgaagugaaaggguauaccaagggaggcccugggcaugaggaacccauuccuauggccacauacggauggaaccucgucaaacuucacuccggcaaggauguguuuuucacacccccugagaaaugugacacacugcugugcgauaucggggagucuagcccgaaucccacgauugaagagggaagaacccuccgcguucugaagaugguggaaccuuggcuucggggcaaccaauuuuguaucaagauucugaaucccuacaugccuuccgucguggagacacucgagcagaugcagagaaaacauggcgggaugcugguucgcaacccccugagcagaaauucuacccacgaaauguauuggguguccugcggaacaggcaacaucgucagcgcugugaauaugaccucuagaaugcuccugaaccgcuucacgauggcccaccggaagccgaccuacgagagagacguggaucuuggggcgggaacacgccaugucgccguugaaccugagguggcuaaccuggacaucauuggccagagaaucgaaaauauuaaacacgagcauaaguccaccuggcacuaugaugaggacaaccccuacaaaacaugggccuaucaugggagcuacgaagugaagcccucuggauccgcuagcuccauggucaauggcgugguuaagcuccugaccaaaccuugggaugugauccccauggucacacaaauugccaugaccgacacgacaccuuuuggccagcagcggguguucaaggagaaaguugauacccgcaccccgaaggcuaaaagagggacagcccaaaucauggaagugacggcgcgguggcuuuggggauuucugagcagaaacaagaagccccggaucuguacccgcgaggaguucacaagaaaaguccggucuaaugccgcuauuggcgccguguuuguugacgagaaccaguggaauagcgcuaaggaggccguggaagacgagcgcuucugggaucucguccagaaagaaagagagcugcacaagcaggggaaaugcgcgaccugcguguauaacaugaugggaaagcgggaaaagaaacugggcgaguuugggaaggcgaaaggcucccgcgcuaucugguacauguggcucggagccagauuccuggaguuugaagcccuuggcuucaugaaugaggaccacugguucucucgggaaaacagccuguccggggucgagggagagggccuccauaagcugggguacauucuucgcgauaucucuaaaauuccuggaggcaauauguaugcugacgauacagccgggugggacaccagaaucacagaagaugaccugcaaaacgaggcuaagaucaccgauauuauggaacccgagcacgcccuccuggcgacgagcaucuuuaaacugaccuaccagaauaaggugguucgggugcagcgcccugccaagaacggcacagucauggacgugauuuccagacgggaucagcgcggaucuggccaaguggggaccuauggacucaauacauucaccaacauggaagcucagcugaucagacagauggagagcgagggcauuuuucuucccuccgaacuggagacgccgaaccucgccgaacggguucuggacuggcuugagaaauacgggguggaaagacugaagcgcauggcuaucagcggagaugacugugucgugaaaccuaucgacgaucgguucgccacagcgcucaccgcccugaaugacaugggcaagguuagaaaagauauuccccagugggagccuucuaagggguggaacgacuggcaacaggugcccuuuugcucccaucacuuccaccagcugaucaugaaggauggccgcgagauugucgugccuugucggaaucaggacgaacucgucggacgggcucgcgugagccaaggcgccggguggucucugcgggagacagcuugccuuggaaaauccuaugcccagauguggcagcugauguacuuucauagacgcgaucuccggcuggcugccaacgcgaucuguagcgccguucccguggacugggucccgaccuccagaacgaccuggucuauucacgcucaucaccaauggaugacaaccgaagauaugcuuagcguguggaaucgcguuuggaucgaggaaaacccuuggauggaggacaagacacauguguccagcuggggcgauguccccuaucuggggaaacgggaggaccaguggugcggaucucucauuggccugaccgccagagccacaugggcuuccaauauccagguggccaucaaccaggugcggagacugauugggaaugaaaacuaccucgacuacaugaccagcaugaagcgcuucaaaaaugagggcgaucccgaaggagcgcugugguga

SEQ ID NO: 19080 - RNA, 9879 nt, Artificial Sequence
  derived and/or modified CDS sequence (opt5) from DENV-1__FJ882567__SS-prME
agcgugaccaugcugcugaugcugaugcccaccgcccuugcuuuccaccugacgacccggggaggggaaccucauaugaucgucacaaagcaggaacggggaaaaucccuccuguuuaagaccucugccggcguuaacaugugcacacuuauugcgauggaccugggggaacucugugaagauaccaugacauacaaaugcccccgcaucaccgaggcugaacccgacgauguggacuguuggugcaaugccacggauaccugggugacauauggaaccuguagccagacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacggaaugaaguucacagugguugugggcgacgucguggggauucucgcucagggcaaaaagaugauccggccgcaacccauggagcacaaauacucuuggaaaagcuggggcaaggccaagauuaucggggccgaugugcagaauaccaccuuuaucauugacggaccuaacacacccgaauguccugaugaccagagagcuuggaauaucugggaggucgaggauuauggcuucggcauuuuuaccacgaacaucuggcugaagcugcgcgacuccuacacacagguuugcgaucaccggcuuaugagcgcggccauuaaagacucuaaggcugugcaugccgauaugggguauuggaucgaauccgagaaaaaugaaaccuggaagcucgccagagcuagcuucaucgaggugaagacauguauuuggcccaaaucucacacccugugguccaacggaguccuggaaagcgagaugaucauuccgaagaucuacggcgggccuauuucucaacauaauuaucgccccggauacuucacacagaccgccggcccuuggcaccucgggaaacuggagcuugacuuugaucugugcgaaggaacgaccgugguuguggacgagcacugcggcaaccggggccccagccucagaacaaccacagucaccgggaagaucauccaugaaugguguugccgguccuguacgcugccuccccugcgcuucaaaggagaggauggcugcugguacgggauggagauuagaccggugaaggaaaaggaggaaaaucuuguuaaaagcauggugucugcgggauccggcgaggucgacagcuuuucccucgggcugcuguguacaucuaucaugauugaagaggugaugcggagcagauggucccgcaagaugcucaugaccggaacacuggcuguuuuccuucugcucaucaugggccagcugaccuggaacgaccugauucggcuuugcaucauggugggcgccaaugccucugauagaauggggaugggaaccacauaucuggcucucauggccacguuuaaaaugcgcccuauguucgcggucggccugcucuuuagacggcugaccagccgcgaggugcuucugcucacaauugggcugucccugguggcuucugucgaacuucccaacagccuggaggaacucggagacggccuggccauggggaucaugauccucaagcugcuuaccgauuuccaaucccaccagcugugggccacacuccugagccugaccuuuauuaaaacgacacuuucucugcauuacgcuuggaagaccauggccaugguucucuccaucgugagccuguucccccucugucugucuaccacaucccagaagaccacauggcuuccugugcugcugggaagccucggcugcaaaccgcugacgauguuucuuauugcugagaauaagaucuggggcagaaaaucuuggccccugaacgaagggauuauggccgucggagugguuuccauccuccugagcucccuccugaagaacgacgugccucuugcgggcccccugaucgccgggggaaugcugauugcuuguuaugucaucagcggcucuagcgccgaucucucccuggagaaagcugccgaggugucuugggaagaggaagccgagcacagcggggcuucccauaauauucuuguugaagugcaggacgauggaaccaugaagaucaaagacgaggagcgggaugacacacugaccauucuccugaaggcgacacuccuggccgucucuggcguguacccucuuagcauccccgcuacccuguucgucugguauuuuuggcaaaagaaaaagcagcgcuccggcgugcugugggauacgccuucucccccggaaguugagagagccgugcucgacgaugggaucuaccggauuaugcagcgcggacugcuuggcagaagccaggucggggugggaguuuuccaagaaaacguguuccacaccauguggcacgucacacggggcgccgugcugauguaucaggggaaacgccucgagccuuccugggcuagcgugaagaaagaccugaucucuuacggaggcggcuggagacuccagggguccuggaauaccggagaggaaguucaggucauugccguggagcccggcaagaacccuaagaaugugcaaacagcgcccgggaccuuuaaaacaccggaaggagaggucggcgcuaucgcccuggacuucaagccugggacgagcggaucucccauugugaaccgggaaggcaaaaucguuggccuuuacgggaauggaguggucaccacauccggcaccuaugugagcgccauugcucaggccaaggcgucccaggaggggccucugcccgagaucgaagaugagguuuuuagaaaacgcaaccugaccaucauggaccuccaucccggaucuggcaagacacggagauaccugccugcuauugugcgcgaagccaucaagcggaaacuuagaacgcugauucucgccccgacccgcgucguggcuagcgagauggccgaagcucugaaggggaugcccauccgguaucaaacaaccgccguuaaauccgagcacacaggcaaggagauuguggaucugaugugccaugcgaccuucacgaugagacuccuuagcccuguccgcgugcccaauuacaacaugaucaucauggacgaagcccacuuuacagauccuucuuccauugcugcccggggauauaucagcaccagagugggcaugggggaggcugccgccauuuucaugaccgcuacacccccuggaucugucgaagcguuuccgcagagcaaugccguuauccaggacgaggaacgggauauucccgagcgcuccuggaacucuggcuacgaguggaucaccgacuucccugggaaaacagugugguuugugcccagcaucaaguccggaaaugauauugcuaacugucugagaaagaauggcaaacgggucauccagcugucucgcaagaccuucgacacggaauaucagaaaaccaagaacaacgauugggacuacgugguuaccacagacauuagcgagaugggggccaauuuuagagccgaucgggugaucgacccuagacgcugccucaaacccgucauucugaaggauggcccggaacgggugauccuugcuggaccuaugcccguuaccguggccuccgcggcucagagacgcggccggauugggagaaaccauaauaaggagggagaccaguacaucuauaugggccagccccugaacaaugaugaggaccacgcccacuggacggaagccaaaaugcuccuggauaacaucaauaccccugaggggauuauccccgcucuguucgaaccugagcgcgaaaagagcgccgcgauugacggagaguaccggcucagaggcgaggcccgcaaaacauucgucgaacuuaugagaagaggggaucugccgguguggcugucuuauaaggucgcuuccgagggcuuucaauacagcgaccgcagauggugcuucgauggagaacggaacaaucaggugcucgaggaaaacauggacguugagaucuggaccaaagagggcgaacgcaagaaacugagaccccgguggcuugaugccagaacauauuccgacccucuggcucuccgcgaguuuaaggaguucgccgcugggcggagaucugugagcggagaccugauucuggagaucggcaagcucccccagcaucuuacccagcgcgcccaaaaugcgcuggauaaccuggugaugcuccacaauuccgaacaagggggacgggccuacagacaugcuauggaggagcugccugacacaaucgaaacccuuaugcugcucgcccugauugcuguccugacgggcggcguuacacucuuuuuccuuucugggcggggacugggcaaaaccagcaucgggcugcucugugugauggccuccagcgugcugcuuuggauggccucugucgagccccacuggauugcugcguccaucauucuggaauuuuuccucauggugcugcugaucccggagccugaucgccagagaacaccccaggacaaccaacucgccuauguugugaucggacuucuguuuaugauucugacagucgcugccaaugagaugggccuccuggaaaccacaaagaaagaucuugggaucggacacguggccgucgagaaccaucaccaugcuacgaugcuggacguggaucuccacccugccagcgcguggacccuguacgccguugcuacaaccauuaucacacccaugaugcggcauaccauugaaaacacgaccgccaauaucucucugacagcuauugccaaccaggcggccauccucaugggccuugacaagggcuggccuaucuccaaaauggauauuggggugccccugcuggcucucggaugcuacagccaggucaauccgcugacccuuacagccgcugugcugaugcucguugcccacuaugcuaucauuggcccugggcugcaagccaaggcgacccgcgaggcccagaagagaacggcugccggaaucaugaaaaaccccacaguggacggcauugucgcuaucgaucuggaccccgugguguacgaugccaaguucgaaaaacagcucgggcagaucaugcuucugauucuguguaccucucaaauccuccugaugcggacaaccugggcccuuugcgagagcauuacccuggcgacaggaccucucacgacccugugggagggcuccccgggcaaguuuuggaauacaaccaucgcuguuucuauggccaacauuuuccgcgggagcuaucuggcuggagccggccucgccuuuucccuuaugaaaagccucgggggaggcagacgggggacaggagcucagggcgaaacccugggcgagaaguggaagcgccagcucaaucagcuguccaaaucugaguucaacaucuacaagagaagcgggaucauggaggucgaccgguccgaagccaaagagggacuuaagagaggcgagacgacacgccacgcggugucucgggggaccgccaaacugagaugguucguggaacgcaaucucgucaagcccgagggaaagguuauugaccugggcugugggcggggaggcuggagcuauuacugcgcuggccugaaaaaggugaccgaagugaaaggguauacaaagggaggcccugggcaugaggaacccaucccuauggccaccuacggauggaaccucgucaaacuucacuccggcaaggauguguuuuucacacccccugagaaaugugacacgcugcugugcgauauuggggagucuagcccgaaucccaccaucgaagagggaagaacacuccgcguucugaagaugguggaaccuuggcuucggggcaaccaauuuuguauuaagauccugaaucccuacaugccuuccgucguggagacccucgagcagaugcagagaaaacauggcgggaugcugguucgcaacccccugagcagaaauucuacacacgaaauguauuggguguccugcggaaccggcaacauugucagcgcugugaauaugacgucuagaaugcuccugaaccgcuucaccauggcccaccggaagccgacauacgagagagacguggaucuuggggcgggaacccgccaugucgccguugaaccugagguggcuaaccuggacaucaucggccagagaauugaaaauaucaaacacgagcauaaguccacauggcacuaugaugaggacaaccccuacaaaaccugggccuaucaugggagcuacgaagugaagcccucuggauccgcuagcuccauggucaauggcgugguuaagcuccugacaaaaccuugggaugugauucccauggucacccaaaucgccaugacggacacaaccccuuuuggccagcagcggguguucaaggagaaaguugauacccgcacaccgaaggcuaaaagagggacggcccaaauuauggaagugaccgcgcgguggcuuuggggauuucugagcagaaacaagaagccccggaucuguacacgcgaggaguucaccagaaaaguccggucuaaugccgcuaucggcgccguguuuguugacgagaaccaguggaauagcgcuaaggaggccguggaagacgagcgcuucugggaucucguccagaaagaaagagagcugcacaagcaggggaaaugcgccacaugcguguauaacaugaugggaaagcgggaaaagaaacugggcgaguuugggaaggcgaaaggcucccgcgcuauuugguacauguggcucggagccagauuccuggaguuugaagcccuuggcuucaugaaugaggaccacugguucucucgggaaaacagccuguccggggucgagggagagggccuccauaagcugggguacauccuucgcgauauuucuaaaaucccuggaggcaauauguaugcugacgauaccgccgggugggacacaagaauuaccgaagaugaccugcaaaacgaggcuaagaucacggauaucauggaacccgagcacgcccuccuggcgaccagcauuuuuaaacugacauaccagaauaaggugguucgggugcagcgcccugccaagaacggcaccgucauggacgugaucuccagacgggaucagcgcggaucuggccaaguggggacauauggacucaauaccuucacgaacauggaagcucagcugauuagacagauggagagcgagggcaucuuucuucccuccgaacuggagacaccgaaccucgccgaacggguucuggacuggcuugagaaacaugggguggaaagacugaagcgcauggcuauuagcggagaugacugugucgugaaaccuaucgacgaucgguucgccaccgcgcucacagcccugaaugacaugggcaagguuagaaaagauaucccccagugggagccuucuaagggguggaacgacuggcaacaggugcccuuuugcucccaccacuuccaucagcugauuaugaaggauggccgcgagaucgucgugccuugucggaaucaggacgaacucgucggacgggcucgcgugagccaaggcgccggguggucucugcgggagaccgcuugccuuggaaaauccuacgcccagauguggcagcugauguauuuucacagacgcgaucuccggcuggcugccaacgcgauuuguagcgccguucccguggacugggucccgacguccagaaccacauggucuauccaugcucaccaucaauggaugaccacagaagauaugcuuagcguguggaaucgcguuuggauugaggaaaacccuuggauggaggacaagacccacguguccagcuggggcgauguccccuaccuggggaaacgggaggaccaguggugcggaucucucaucggccugacagccagagccaccugggcuuccaauauucagguggccaucaaccaggugcggagacugaucgggaaugaaaacuaucucgacuacaugacgagcaugaagcgcuucaaaaaugagggcgaucccgaaggagcgcugugguga

SEQ ID NO: 19081 - RNA, 9879 nt, Artificial Sequence
  derived and/or modified CDS sequence (opt5) from DENV-1__GQ199831__SS-prME
agcgugaccaugcugcucaugcugaugcccacagcccuugcuuuccaccugacgacccggggcggggaaccucauaugaucgucacaaagcaggaacggggaaaaucccuccuguuuaagaccucugccggcguuaacaugugcacacuuauugcgauggaccugggggaacucugugaagauaccaugacauacaaaugcccccgcaucaccgaaacggaacccgacgauguggacuguuggugcaaugcuaccgauacaugggugaccuauggaacauguagccaaaccggcgagcaccggcgggacaagcgcuccgucgcccuggccccucauguggggcugggacucgagacgagaacagaaaccuggaugucuagcgagggcgcuuggaaacagauucagcggguugaaacaugggcccugcgccaccccggcuucaccgugaucgcucuuuuucuggcccaugcgauugggaccuccaucacacagaagggaaucauuuucauccuccugaugcuugucacgccuucuauggccaugagaugcgugggcauugggagccgggauuuuguugagggacuguccggcgcuaccuggguggacgucgugcucgagcacgggagcugugugacaaccauggccaaggauaaacccacacuggacaucgaacugcucaagaccgaggucacgaacccugcuguucugcgcaaacuuugcauugaagccaagaucucuaauacaaccaccgauuccagauguccgacacaaggagaggcgacccugauggaagaacaagacgccaacuucgugugccggcgcacauuuguggauagaggcuggggcaauggguguggacucuucggcaaagggagccugauuacgugcgcuaaguuuaagugcgucaccaaacuugagggaaagaucgugcaguacgaaaaccugaaauauucuguuaucgugacaguccacaccggcgaccagcaucaaguggggaaugaguccacagaacacggaaccacggccaccauuacaccccaggcuccuaccagcgagauccagcucacagacuacggcgcccugacccuggauuguucuccccggacgggccucgacuucaacgaaaugguucugcuuacaaugaaggagaaauccuggcuggugcauaagcagugguuucucgaucugccucuucccuggaccagcggggccuccacaucucaagagaccuggaaucgccaggaccugcucgucaccuucaaaacagcucacgcgaagaagcaggaaguggucgugcugggaagccaagagggcgccaugcacacggcucugaccggggccacagaaauucagaccuccggaacaaccacgaucuuugccggccaucucaaaugcagacugaagauggauaaacuuacacugaaggggaugagcuauguuauguguaccggcucuuucaaacucgagaaggaaguggcugagacccagcacggaacaguccuggugcagauuaaguacgagggcaccgacgccccgugcaaaaucccuuucuccacacaagaugaaaaggggguuacgcagaacggacggcugaucaccgcgaaucccauugugacagacaaagagaagccugucaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguguuuaccagcguuggcaaacugguccaucagauuuucgggacggccuacggagugcucuuuuccggcgugagcuggaccaugaagaucgggauuggcguccugcuuacauggcugggacucaauucuagauccaccagccugucuaugacauguaucgcugugggccugguuacccuuuaccucggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcugucugccgcgauuggcaaggccugggaggagggggucugcggcaucagaagcgcuacacgccucgaaaacaucauguggaaacagauuuccaacgagcugaaucauauccuucuggaaaacgacaugaaguucaccgugguugugggagaugucgugggcauucucgcccaggggaaaaagaugauccggccgcaacccauggagcacaaauacucuuggaaaagcuggggaaaggcuaagauuaucggcgccgacgugcagaauaccacauuuaucauugaugggccuaacacccccgaauguccugacgaucagagagccuggaauaucugggaggucgaggacuauggauucggcauuuuuacgacaaacaucuggcugaagcugcgcgauuccuacacccagguuugcgaccaccggcuuaugagcgcugcgauuaaagauucuaaggccgugcaugcugacaugggcuauuggaucgaauccgagaaaaaugaaacauggaagcucgccagagccagcuucaucgaggugaagaccuguauuuggcccaaaucucacacacugugguccaacgggguccuggaaagcgagaugaucauuccgaagaucuacggaggcccuauuucucaacauaauuaucgccccggguacuucacccagacggcuggaccuuggcaccucggcaaacuggagcuugauuuugaccugugcgaagggaccacagugguuguggaugagcacugcggaaaccggggccccagccucagaaccacaaccgucacgggcaagaucauccaugaaugguguugccgguccuguacacugccuccccugcgcuucaaaggggaggacggaugcugguacggcauggagauuagaccggugaaggaaaaggaggaaaaucuuguuaaaagcauggugucugccggguccggagaggucgacagcuuuucccucggccugcuguguaucucuauuaugaucgaagaggugaugcggagcagauggucccgcaagaugcucaugaccgggacacuggcgguuuuccuucugcucauuaugggacagcugaccuggaacgaucugauccggcuuugcauuauggugggcgcuaaugccucugacagaaugggcauggggaccacauaucuggcccucauggcuacguuuaaaaugcgcccuauguucgccgucggacugcucuuuagacggcugaccagccgcgaggugcuucugcucacaaucggccugucccugguggcgucugucgaacuucccaacagccuggaggaacucggggauggacuggcuaugggcaucaugauucucaagcugcuuaccgacuuccaaucccaccagcugugggccacacuccugagccugaccuuuaucaaaacgacacuuucucugcauuacgccuggaagaccauggcuaugguucucuccauugugagccuguucccccucugucugucuaccacaucccagaagaccacauggcuuccugugcugcuggggagccucggaugcaaaccgcugacgauguuucuuaucgccgagaauaagauuuggggcagaaaaucuuggccccugaacgaaggcaucauggcugucggggugguuuccauccuccugagcucccuccugaagaacgaugugccucuugccggaccccugauugcgggcgggaugcugaucgccuguuaugucauuagcggaucuagcgcugaccucucccuggagaaagccgcugaggugucuugggaagaggaagccgagcacagcggcgccucccauaauauccuuguugaagugcaggaugacgggaccaugaagauuaaagaugaggagcgggacgauacacugaccauccuccugaaggcuacacuccuggcggucucuggaguguacccucuuagcauccccgccacccuguucgucugguauuuuuggcaaaagaaaaagcagcgcuccggcgugcugugggacacgccuucucccccggaaguugagagagcugugcucgaugacggcauuuaccggaucaugcagcgcgggcugcuuggaagaagccaggucggcguggggguuuuccaagaaaacguguuccacaccauguggcacgucacacggggagccgugcugauguaucagggcaaacgccucgagccuuccugggccagcgugaagaaagaccugauuucuuacgggggaggcuggagacuccagggcuccuggaauaccggggaggaaguucaggucaucgcuguggagcccggaaagaacccuaagaaugugcaaacagcccccggcaccuuuaaaacaccggaaggggaggucggagcgauugcucuggauuucaagccuggcacgagcgggucucccaucgugaaccgggaaggaaaaauuguuggccuuuacggcaaugggguggucaccacauccggaaccuaugugagcgccaucgcccaggcuaaggccucccaggagggcccucugcccgagaucgaagacgagguuuuuagaaaacgcaaccugaccauuauggaucuccaucccgggucuggaaagacacggagauaccugccugcgaucgugcgcgaagcuauuaagcggaaacuuagaacgcugauccucgccccgacccgcgucguggccagcgagauggcugaagcccugaagggcaugcccauucgguaucaaacaaccgcuguuaaauccgagcacacagggaaggagaucguggaccugaugugccaugccaccuucacgaugagacuccuuagcccuguccgcgugcccaauuacaacaugaucauuauggaugaagcgcacuuuacagacccuucuuccaucgccgcucggggcuauauuagcaccagagugggaaugggcgaggccgcugccaucuucaugaccgccacacccccugggucugucgaggcuuuuccgcagagcaaugcgguuauucaggaugaggaacgggacauccccgagcgcuccuggaacucuggauacgaguggaucaccgauuucccuggcaaaacagugugguuugugcccagcauuaaguccgggaaugacaucgccaacugucugagaaagaauggaaaacgggucauucagcugucucgcaagaccuucgauacggaauaucagaagaccaagaacaacgacugggacuacgugguuaccacagauaucagcgagaugggcgcuaauuuuagagccgaccgggugauugauccuagacgcugccucaaacccgucauccugaaggacgggccggaacgggugauucuugccggcccuaugcccguuaccguggcuuccgccgcgcagagacgcggacggaucggcagaaaccauaauaaggagggggaucaguacaucuauaugggacagccccugaacaaugacgaggaucacgcucacuggacggaagccaaaaugcuccuggacaacauuaauaccccugagggcaucauucccgcccuguucgaaccugagcgcgaaaagagcgcugccaucgauggggaguaccggcucagaggagaggcgcgcaaaacauucgucgaacuuaugagacggggcgaccugccgguguggcugucuuauaaggucgccuccgagggguuucaauacagcgaucgcagauggugcuucgacggcgaacggaacaaucaggugcucgaggaaaacauggauguugagauuuggaccaaagagggagaacgcaagaaacugagaccccgguggcuugacgcuagaacauauuccgacccucuggcccuccgcgaguuuaaggaguucgcugccggccggagaucugugagcggggaucugauccuggagaucggaaagcucccccagcaucuuacccagcgcgcucaaaaugcccuggacaaccuggugaugcuccacaauuccgaacagggcgggcgggcguacagacaugccauggaggagcugccugauacaauugaaacccuuaugcugcucgcucugaucgccguccugacgggaggcguuacacucuuuuuccuuucuggccgggggcugggaaaaaccagcauuggccugcucugugugauggcuuccagcgugcugcuuuggauggccucugucgagccccacuggaucgccgcuuccauuauccuggaauuuuuccucauggugcugcugaucccggagccugaccgccagagaacaccccaggauaaccaacucgcguauguugugauugggcuucuguuuaugauccugacagucgccgcuaaugagaugggacuccuggaaaccacaaagaaagaccuuggcauugggcacguggccgucgagaaccaucaccaugccacgaugcuggauguggaccuccacccugcuagcgccuggacccuguacgcgguugccacaaccaucauuacacccaugaugcggcauaccaucgaaaacacgaccgcuaauauuucucugacagccaucgcuaaccaggccgcgauccucaugggacuugauaagggcuggccuauuuccaaaauggacaucggcgugccccugcuggcccucgggugcuacagccaggucaauccgcugacccuuacagcugccgugcugaugcucguugcucacuaugccauuaucggaccuggccugcaagcuaaggccacccgcgaggcgcagaagagaacggccgcugggauuaugaaaaaccccacaguggauggaaucgucgccaucgaccuggaucccgugguguacgacgcuaaguucgaaaaacagcucggccagauuaugcuucugauccuguguaccucucaaauucuccugaugcggacaaccugggcccuuugcgagagcaucacccuggccacagggccucucacgacccugugggagggauccccgggcaaguuuuggaauacaaccauugcgguuucuauggcuaacaucuuccgcggcagcuaucuggccggggcuggacucgccuuuucccuuaugaaaagccugggcgggggaagacggggcacaggggcccagggagaaacccugggcgagaaguggaagcgccagcucaaucagcuguccaaaucugaguucaacaucuacaagagaagcggcauuauggaggucgaccgguccgaagcuaaagaggggcuuaagagaggagagacgacacgccacgccgugucucggggcaccgcgaaacugagaugguucguggaacgcaaucucgucaagcccgaggggaagguuaucgaucugggauguggcagagggggauggagcuauuacugcgccggccugaaaaaggugaccgaagugaaaggcuauacaaaagggggaccuggccaugaggaacccauuccuauggcuaccuacggguggaaccucgucaaacuucacuccggaaaggacguguuuuucacacccccugagaaaugugauacgcugcugugcgacaucggcgagucuagcccgaaucccaccauugaagaggggagaacacuccgcguucugaagaugguggaaccuuggcuucggggaaaccaauuuuguaucaagauucugaaucccuacaugccuuccgucguggagacccucgagcagaugcagagaaaauauggcggcaugcugguucgcaacccccugagcagaaauucuacacaugaaauguacuggguguccugcgggaccggaaacaucgucagcgccgugaauaugacgucuagaaugcuccugaaccgcuucaccauggcucaccggaagccgacauaugagagagauguggaccuuggcgccgggacccgccacgucgcgguugaaccugagguggccaaccuggauaucauuggacagagaaucgaaaauauuaaacaugagcacaaguccacauggcauuacgacgaggauaaccccuauaaaaccugggcuuaccacggcagcuaugaagugaagcccucuggguccgccagcuccauggucaauggagugguuaagcuccugacaaaaccuugggacgugauccccauggucacccaaauugcuaugacggauacaaccccuuuuggccagcagcggguguucaaggagaaaguugacacccgcacaccgaaggccaaaagaggcacggcucaaaucauggaagugaccgcccgguggcuuuggggguuucugagcagaaacaagaagccccggaucuguacacgcgaggaguucaccagaaaaguccggucuaaugcggccauuggagcuguguuuguugacgagaaccaguggaauagcgccaaggaggcuguggaagaugagcgcuucugggaccucguccagaaagaaagagagcugcauaagcagggcaaaugcgccacaugcguguacaacaugauggggaagcgggaaaagaaacugggagaguuuggcaaggccaaagggucccgcgcgaucugguacauguggcucggcgcuagauuccuggaguuugaagcccuuggauucaugaaugaggaucacugguucucucgggaaaacagccuguccggcgucgagggggagggacuccacaagcugggcuauauucuucgcgacaucucuaaaauuccugggggaaauauguacgccgaugacaccgcuggcugggauacaagaaucaccgaagacgaucugcaaaacgaggccaagaucacggacauuauggaacccgagcaugcucuccuggccaccagcaucuuuaaacugacauaucagaauaaggugguucgggugcagcgcccugcgaagaacgggaccgucauggaugugauuuccagacgggaccagcgcggcucuggacaagugggcacauacgggcucaauaccuucacgaacauggaagcccagcugaucagacagauggagagcgagggaauuuuucuucccuccgaacuggagacaccgaaccucgcugaacggguucuggauuggcuugagaaauauggcguggaaagacugaagcgcauggccaucagcggggacgacugugucgugaaaccuaucgaugaccgguucgcuaccgcccucacagcgcugaaugauaugggaaagguuagaaaagacauuccccagugggagccuucuaagggcuggaacgauuggcaacaggugcccuuuugcucccaccauuuccaccagcugaucaugaaggacgggcgcgagauugucgugccuugucggaaucaggaugaacucgucggcagagcccgcgugagccaaggagcuggcuggucucugcgggagaccgccugccuugggaaauccuacgcucagauguggcagcugauguauuuucacagacgcgaccuccggcuggccgcuaacgccaucuguagcgcggaucccguugacugggugccgacguccagaaccacauggucuauucaugcccaccaucaauggaugaccacagaagauaugcuuagcgucuggaaucgcguguggaucgaggaaaacccuuggauggaggacaagacccacguuuccagcuggggagacgugcccuaccugggcaaacgggaggaucaguggugcgggucucucauuggacugacagcuagagccaccugggccuccaauauccaggucgcuaucaaccaggugcggagacugauuggcaaugaaaacuaccucgacuauaugacgagcaugaagcgcuucaaaaaugagggggaucccgaaggcgcccugugguga

SEQ ID NO: 19082 - RNA, 9879 nt, Artificial Sequence
  derived and/or modified CDS sequence (opt5) from DENV-1__GQ199832__SS-prME
agcgugaccaugcugcugaugcugaugcccacagcccuugcuuuccaccugacgacccggggaggggaaccucauaugaucgucacaaagcaggaacggggaaaaucccuccuguuuaagaccucugccggcguuaacaugugcacacuuaucgccauggaccugggggaacucugugaagauaccaugacauacaaaugcccccgcaucaccgaagcugaacccgacgauguggacuguuggugcaaugccacggauaccugggugacauauggaaccuguagccagacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacggaaugaaguucacagugguugugggcgacgucguggggauucucgcucagggcaagaagaugauccggccgcaacccauggagcacaaauacucuuggaaaagcuggggcaaggccaagauuaucggggccgaugugcagaauaccaccuuuaucauugacggaccuaacacacccgaauguccugaugaccagagagcuuggaauaucugggaggucgaggauuauggcuucggcauuuuuaccacgaacaucuggcugaagcugcgcgacuccuacacacagguuugcgaucaccggcuuaugagcgcggccauuaaagacucuaaggcugugcaugccgauaugggguauuggaucgaauccgagaaaaaugaaaccuggaagcucgccagagcuagcuucaucgaggugaagacauguauuuggcccaaaucucacacccugugguccaacggaguccuggaaagcgagaugaucauuccgaagaucuacggcgggccuauuucucaacauaauuaucgccccggauacuucacacagaccgccggcccuuggcaccucgggaaacuggagcuugacuuugaucugugcgaaggaacgaccgugguuguggacgagcacugcggcaaccggggccccagccucagaacaaccacagucaccgggaagaucauccaugaaugguguugccgguccuguacgcugccuccccugcgcuucaaaggagaggauggcugcugguacgggauggagauuagaccggugaaggaaaaggaggaaaaucuuguuaaaagcauggugucugcgggauccggcgaggucgacagcuuuucccucgggcugcuguguacaucuaucaugauugaagaggugaugcggagcagauggucccgcaagaugcucaugaccggaacacuggcuguuuuccuucugcucaucaugggccagcugaccuggaacgaccugauucggcuuugcaucauggugggcgccaaugccucugauagaauggggaugggaaccacauaucuggcucucauggccacguuuaaaaugcgcccuauguucgcggucggccugcucuuuagacggcugaccagccgcgaggugcuucugcucacaauugggcugucccugguggcuucugucgaacuucccaacagccuggaggaacucggagacggccuggccauggggaucaugauccucaagcugcuuaccgauuuccaaucccaccagcugugggccacacuccugagccugaccuuuauuaaaacgacacuuucucugcauuacgcuuggaagaccauggccaugguucucuccaucgugagccuguucccccucugucugucuaccacaucccagaagaccacauggcuuccugugcugcugggaagccucggcugcaaaccgcugacgauguuucuuauugcugagaauaagaucuggggcagaaaaucuuggccccugaacgaagggauuauggccgucggagugguuuccauccuccugagcucccuccugaagaacgacgugccucuugcgggcccccugaucgccgggggaaugcugauugcuuguuaugucaucagcggcucuagcgccgaucucucccuggagaaagcugccgaggugucuugggaagaggaagccgagcacagcggggcuucccauaauauucuuguugaagugcaggacgauggaaccaugaagaucaaagacgaggagcgggaugacacacugaccauucuccugaaggcgacacuccuggccgucucuggcguguacccucuuagcauccccgcuacccuguucgucugguauuuuuggcaaaagaaaaagcagcgcuccggcgugcugugggauacgccuucucccccggaaguugagagagccgugcucgacgaugggaucuaccggauuaugcagcgcggacugcuuggcagaagccaggucggggugggaguuuuccaagaaaacguguuccacaccauguggcacgucacacggggcgccgugcugauguaucaggggaaacgccucgagccuuccugggcuagcgugaagaaagaccugaucucuuacggaggcggcuggagacuccagggguccuggaauaccggagaggaaguucaggucauugccguggagcccggcaagaacccuaagaaugugcaaacagcgcccgggaccuuuaaaacaccggaaggagaggucggcgcuaucgcccuggacuucaagccugggacgagcggaucucccauugugaaccgggaaggcaaaaucguuggccuuuacgggaauggaguggucaccacauccggcaccuaugugagcgccauugcucaggccaaggcgucccaggaggggccucugcccgagaucgaagaugagguuuuuagaaaacgcaaccugaccaucauggaccuccaucccggaucuggcaagacacggagauaccugccugcuauugugcgcgaagccaucaagcggaaacuuagaacgcugauucucgccccgacccgcgucguggcuagcgagauggccgaagcucugaaggggaugcccauccgguaucaaacaaccgccguuaaauccgagcacacaggcaaggagauuguggaucugaugugccaugcgaccuucacgaugagacuccuuagcccuguccgcgugcccaauuacaacaugaucaucauggacgaagcccacuuuacagauccuucuuccauugcugcccggggauauaucagcaccagagugggcaugggggaggcugccgccauuuucaugaccgcuacacccccuggaucugucgaagcguuuccgcagagcaaugccguuauccaggacgaggaacgggauauucccgagcgcuccuggaacucuggcuacgaguggaucaccgacuucccugggaaaacagugugguuugugcccagcaucaaguccggaaaugauauugcuaacugucugagaaagaauggcaaacgggucauccagcugucucgcaagaccuucgacacggaauaucagaagaccaagaacaacgauugggacuacgugguuaccacagacauuagcgagaugggggccaauuuuagagccgaucgggugaucgacccuagacgcugccucaaacccgucauucugaaggauggcccggaacgggugauccuugcuggaccuaugcccguuaccguggccuccgcggcucagagacgcggccggauugggagaaaccauaauaaggagggagaccaguacaucuauaugggccagccccugaacaaugaugaggaccacgcccacuggacggaagccaaaaugcuccuggauaacaucaauaccccugaggggauuauccccgcucuguucgaaccugagcgcgaaaagagcgccgcgauugacggagaguaccggcucagaggcgaggcccgcaaaacauucgucgaacuuaugagaagaggggaucugccgguguggcugucuuauaaggucgcuuccgagggcuuucaauacagcgaccgcagauggugcuucgauggagaacggaacaaucaggugcucgaggaaaacauggacguugagaucuggaccaaagagggcgaacgcaagaaacugagaccccgguggcuugaugccagaacauauuccgacccucuggcucuccgcgaguuuaaggaguucgccgcugggcggagaucugugagcggagaccugauucuggagaucggcaagcucccccagcaucuuacccagcgcgcccaaaaugcgcuggauaaccuggugaugcuccacaauuccgaacaagggggacgggccuacaaacaugcuauggaggagcugccugacacaaucgaaacccuuaugcugcucgcccugauugcuguccugacgggcggcguuacacucuuuuuccuuucugggagaggacugggcaagaccagcaucgggcugcucugugugauggccuccagcgugcugcuuuggauggccucugucgagccccacuggauugcugcguccaucauucuggaauuuuuccucauggugcugcugaucccggagccugaucggcagcgcacaccccaggacaaccaacucgccuauguugugaucggacuucuguuuauuauccugacagucgcugccaaugagaugggccuccuggaaaccaccaaaaaggaucuugggauuggacacguggccgucgagaaccaucaccaugcuacgaugcuggacguggaucuccacccugccagcgcguggacccuguacgccguugcuacaaccaucauuacacccaugaugagacauaccaucgaaaacacgaccgccaauauuucucugacagcuaucgccaaccaggcggccauccucaugggccuugacaaaggcuggccuauuuccaagauggauaucggggugccccugcuggcucucggaugcuacagccaggucaauccgcugacccuuacagccgcugugcugaugcucguugcccacuaugcuauuaucggcccugggcugcaagccaaggcgacccgggaggcccagaaacgcacggcugccggaauuaugaagaaccccacaguggacggcaucgucgcuaucgaucuggaccccgugguguacgaugccaaauucgaaaagcagcucgggcagauuaugcuucugauccuguguaccucucaaauucuccugaugagaacaaccugggcccuuugcgagagcaucacccuggcgacaggaccucucacgacccugugggagggcuccccgggcaaauuuuggaauacaaccauugcuguuucuauggccaacaucuuccgggggagcuaucuggcuggagccggccucgccuuuucccuuaugaaaagccucgggggaggccgcagagggacaggagcucagggcgaaacccugggcgagaaguggaaacggcagcucaaucagcuguccaagucugaguucaacaucuacaaacgcagcgggauuauggaggucgacagauccgaagccaaggagggacuuaaacggggcgagacgacaagacacgcggugucucgcgggaccgccaagcugcggugguucguggaaagaaaucucgucaagcccgagggaaaaguuaucgaccugggcugugggcgcggaggcuggagcuauuacugcgcuggccugaagaaagugaccgaagugaagggguauacaaaaggaggcccugggcaugaggaacccauuccuauggccaccuacggauggaaccucgucaaacuucacuccggcaaagauguguuuuucauucccccugagaagugugacacacugcugugcgauauuggggagucuagcccgaaucccacgaucgaagagggacggacccucagaguucugaagaugguggaaccuuggcuucgcggcaaccaauuuuguauuaaaauccugaaucccuacaugccuuccgucguggagacacucgagcagaugcagcggaagcauggcgggaugcugguuagaaacccccugagccgcaauucuacccacgaaauguauuggguguccugcggaacaggcaacaucgucagcgcugugaauaugaccucucggaugcuccugaacagauucacgauggcccaccgcaaaccgaccuacgagcgggacguggaucuuggggcgggaacaagacaugucgccguugaaccugagguggcuaaccuggacauuaucggccagcgcauugaaaauaucaagcacgagcauaaauccaccuggcacuaugaugaggacaaccccuacaagacaugggccuaucaugggagcuacgaagugaagcccucuggauccgcuagcuccauggucaauggcgugguuaaacuccugaccaagccuugggaugugauucccauggucacacaaaucgccaugaccgacacgacaccuuuuggccagcagagaguguucaaagagaagguugauacccggaccccgaaagcuaagcgcgggacagcccaaaucauggaagugacggcgagauggcuuuggggauuucugagccggaacaagaaacccagaauuuguacccgggaggaguucacacgcaaggucagaucuaaugccgcuaucggcgccguguuuguugacgagaaccaguggaauagcgcuaaagaggccguggaagacgagcgguucugggaucucguccagaaggaacgcgagcugcacaaacaggggaagugcgcgaccugcguguauaacaugaugggaaagagagagaaaaagcugggcgaguuugggaaagcgaagggcucccgggcuauuugguacauguggcucggagcccgcuuccuggaguuugaagcccuuggcuucaugaaugaggaccacugguucucuagagaaaacagccuguccggggucgagggagagggccuccauaaacugggguacauccuucgggauauuucuaagaucccuggaggcaauauguaugcugacgauacagccgggugggacacccgcaucacagaagaugaccugcaaaacgaggcuaaaauuaccgauaucauggaacccgagcacgcccuccuggcgacgagcauuuuuaagcugaccuaccagaauaaggugguuagagugcagcggccugccaaaaacggcacagucauggacgugaucucccgcagagaucagcggggaucuggccaaguggggaccuauggacucaauacauucaccaacauggaagcucagcugauucgccagauggagagcgagggcaucuuucuucccuccgaacuggagacgccgaaccucgccgaaagaguucuggacuggcuugagaaguacgggguggaacggcugaaaagaauggcuaucagcggagaugacugugucgugaagccuauugacgaucgcuucgccacagcgcucaccgcccugaaugacaugggcaaaguucggaaggauaucccccagugggagccuucuaagggguggaacgacuggcaacaggugcccuuuugcucccaucacuuccaccagcugauuaugaaagauggcagagagaucgucgugccuugucgcaaucaggacgaacucgucggacgggcuagagugagccaaggcgccggguggucucugcgcgagacagcuugccuuggaaaguccuaugcccagauguggcagcugauguacuuucaucggagagaucuccgccuggcugccaacgcgauuuguagcgccguucccguggacugggucccgaccucccggacgaccuggucuauccacgcucaucaccaauggaugacaaccgaagauaugcuuagcguguggaauagaguuuggauugaggaaaacccuuggauggaggacaaaacacauguguccagcuggggcgauguccccuaucuggggaagcgcgaggaccaguggugcggaucucucaucggccugaccgcccgggccacaugggcuuccaauauccagguggccauuaaccaggugagacggcugaucgggaaugaaaacuaccucgacuacaugaccagcaugaaaagauucaagaaugagggcgaucccgaaggagcgcugugguga

SEQ ID NO: 19083 - RNA, 9879 nt, Artificial Sequence
  derived and/or modified CDS sequence (opt5) from DENV-1__FJ882568__SS-prME
uccgugaccaugcugcugaugcugaugcccaccgcccuugcuuuccaccugacgaccagaggaggggagccucauaugaucgucacaaagcaggaacggggaaagucccuccuguuuaagaccucugccggcguuaauaugugcacacuuauugcgauggaccugggggagcucugugaagauaccaugacauacaagugcccgcgcaucaccgaggcugaacccgacgauguggacuguuggugcaaugccacggauaccugggugacauauggaaccuguagccagacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccguggucgauagaggcuggggcaauggguguggacucuuuggcaaagggagccugauuacaugcgccaaguucaagugcgugacgaaacuugagggaaagaucguucaguacgaaaaccugaaauauucugugaucgucaccgugcacacaggcgaccagcaucaaguugggaaugaguccaccgaacacggaacaaccgcuacgauuacaccccaggccccuacaagcgagauccagcucaccgacuacggcgcccugacacuggauuguucuccccggaccggccucgacuuuaacgaaauggugcugcuuacgaugaaggagaaauccuggcugguccauaagcagugguuccucgaucugccucuucccuggacaagcggggcuuccaccucucaagagacauggaaucgccaggaccugcucgugaccuuuaaaaccgcgcacgccaagaagcaggaagucgugguucugggaagccaagagggcgcuaugcacacagcccugacgggggccaccgaaauucagacauccggaaccacaaccaucuucgcuggccaucucaaaugcagacugaagauggauaaacuuacgcugaaggggaugagcuaugugauguguacaggcucuuuuaaacucgagaaggaagucgccgagacccagcacggaaccgugcugguucagauuaaguacgagggcacagacgcgccgugcaaaaucccuuuccugacccaagaugaaaagggggugacacagaacggacggcuuaucacggcuaaucccauugucaccgacaaagagaagccugugaacaucgaagccgagccgcccuucggcgaguccuauauugugaucggggccggagaaaaagcucucaagcugagcugguuuaagaaaggcucuagcauugggaagauguucgaggccacagcuagaggcgcccgccggauggcgauccugggagauaccgccugggacuuuggcuccaucgggggaguuuucacaucugucggcaaacucgugcaucagauuuuugggaccgcuuacggagugcuguucagcggcgucuccuggacgaugaagaucgggauuggcgugcuucugaccuggcucggacugaauagcagaucuacaucccugagcaugaccuguaucgccguuggccuugugacacucuaccugggggucauggugcaggcugauucuggaugcguuauuaacuggaaaggccgcgaacugaaguguggguccggaaucuuugugaccaaugagguccacacauggaccgaacaauauaaguuccaggccgacagcccuaaacggcucuccgcggccauuggcaaggcuugggaggagggggugugcggcaucagaucugccacgcgccuggaaaacaucauguggaaacagauuagcaacgagcuuaaucauauccugcucgaaaacggaaugaaguuuacaguuguggucggcgacgugguggggauucuggcucagggcaagaagaugauccggccgcaacccauggagcacaaauacuccuggaagucuuggggcaaggccaaaauuaucggggccgauguccagaauaccaccuucaucauugacggaccuaacacacccgaauguccugaugaccagagagcuuggaauaucugggagguugaggauuauggcuuuggcauuuucaccacgaacaucuggcugaaacuucgcgacagcuacacacaggugugcgaucaccggcucauguccgcggccauuaaagacagcaaggcugugcaugccgauaugggguauuggaucgaaucugagaaaaaugaaaccuggaagcuggccagagcuuccuuuaucgaggucaagacauguauuuggcccaaaagccacacccuguggucuaacggagugcucgaauccgagaugaucauuccgaagaucuacggcgggccuauuagccaacauaauuaucgccccggauacuucacacagaccgccggcccuuggcaccuggggaaacuugagcuggacuucgaucucugcgaaggaacgaccguuguggucgacgagcacugcggcaaccggggccccucucugagaacaaccacagugaccgggaagaucauccaugaaugguguugccggagcuguacgcugccuccccuucgcuuuaaaggagaggauggcugcugguacgggauggagauuagaccgguuaaggaaaaggaggaaaaucucgugaaauccauggucagcgcgggaucuggcgagguggacuccuucagccuggggcugcucuguacauccaucaugauugaagagguuaugcggucuagauggagccgcaagaugcugaugaccggaacacuugcuguguuucugcuccugaucaugggccagcugaccuggaacgaccuuauucggcugugcaucauggucggcgccaaugccuccgauagaauggggaugggaaccacauaucucgcucugauggccacguucaaaaugcgcccuauguuugcggugggccuccuguucagacggcuuaccucucgcgaggugcugcuccugacaauugggcugagccuugucgcuuccguugaacugcccaacucucucgaggaacugggagacggccucgccauggggaucaugauccugaaacuucugaccgauuuucaaagccaccagcucugggccacacugcugucccuuaccuucauuaaaacgacacugagccuccauuacgcuuggaagaccauggccauggugcugucuaucgugucccucuuuccccugugucuuagcaccacaucucagaagaccacauggcugccuguccugcucggaucccugggcugcaaaccgcuuacgauguuccugauugcugagaauaagaucuggggcagaaaaagcuggccccucaacgaagggauuauggccgugggaguugugucuauccugcucuccagccugcuuaagaacgacgucccucuggcgggcccccugaucgccgggggaaugcucauugcuuguuaugugaucuccggcagcucugccgaucugagccuugagaaagcugccgagguuuccugggaagaggaagccgagcacucuggggcuagccauaauauucugguggaaguccaggacgauggaaccaugaagaucaaagacgaggagcgggaugacacacucaccauucugcucaaggcgacacugcuugccguguccggcgucuacccucugucuauccccgcuacccuguuugugugguauuucuggcaaaagaaaaagcagcgcagcggcguucucugggauacgccuagcccucccgaaguggagagagccguccuggacgaugggaucuaccggauuaugcagcgcggacuucugggcagaucucagguggggguuggaguguuucaagaaaacgucuuccacaccauguggcacgugacacggggcgccgugcucauguaucaggggaaacgccuggagcccagcugggcuuccguuaagaaagaccucaucagcuacggaggcggcuggagacugcaggggucuuggaauaccggagaggaaguccaggugauugccguggagcccggcaagaacccuaagaauguccaaacagcgcccgggaccuucaaaacaccggaaggagaggugggcgcuaucgcccuugacuuuaagccugggacguccggaagccccauuguuaaccgggaaggcaaaaucgugggccuguacgggaauggagucgugaccacaucuggcaccuauguuuccgccauugcucaggccaaggcgagccaggaggggccucugcccgagaucgaagaugagguguucagaaaacgcaaccucaccaucauggaccugcaucccggauccggcaagacacggagauaccuuccugcuauuguccgcgaagccaucaagcggaaacugagaacgcucauucuggccccgacccgcgugguugcuucugagauggccgaagcucugaaggggaugcccauccgguaucaaacaaccgccgugaaaagcgagcacacaggcaaggagauugucgaucucaugugccaugcgaccuuuacgaugagacuucuguccccugugcgcgugcccaauuacaacaugaucaucauggacgaagcccacuucacagauccuagcucuauugcugcccggggauauaucuccaccagagucggcaugggggaggcugccgccauuuuuaugaccgcuacacccccuggaagcguugaagcguucccgcagucuaaugccgugauccaggacgaggaacgggauauucccgagcgcagcuggaacuccggcuacgaguggaucaccgacuuuccugggaaaacagugugguucguccccucuaucaagagcggaaaugauauugcuaacugucugagaaagaauggcaaacgggugauccagcucucccgcaagaccuuugacacggaauaucagaagaccaagaacaacgauugggacuacguugugaccacagacauuucugagaugggggccaauuucagagccgaucgggucaucgacccuagacgcugccugaaacccgugauucuuaaggauggcccggaacggguuauccuggcuggaccuaugcccgugaccgucgccagcgcggcucagagacgcggccggauugggagaaaccauaauaaggagggagaccaguacaucuauaugggccagccccucaacaaugaugaggaccacgcccacuggacggaagccaaaaugcugcuggauaacaucaauaccccugaggggauuauccccgcucucuuugaaccugagcgcgaaaaguccgccgcgauugacggagaguaccggcuuagaggcgaggcccgcaaaacauucguggaacugaugagaagaggggaucugccggucuggcucagcuauaagguggcuucugagggcuuccaauacuccgaccgcagauggugcuuugauggagaacggaacaaucagguucuggaggaaaacauggacguggagaucuggaccaaagagggcgaacgcaagaaacuuagaccccgguggcuggaugccagaacauauagcgacccucucgcucugcgcgaguucaaggaauuugccgcugggcggagauccgugucuggagaccugauucucgagaucggcaaacuuccccagcaucugacccagcgcgcccaaaaugcgcuggauaaccucgucaugcugcacaauagcgaacaagggggacgggccuacagacaugcuauggaggagcuuccugacacaaucgaaacccugaugcuccuggcccugauugcuguucucacgggcggcgugacacuuuucuuucuguccgggcggggacugggcaaaaccucuaucgggcuccugugugugauggccagcuccguccuucuguggauggccagcguggagccccacuggauugcugcgucuaucauucucgaguucuuucugaugguucugcucaucccggagccugaucgccagagaacaccccaggacaaccaacuugccuauguggucaucggacugcuguucauuauccucacaguggcugccaaugagaugggccugcuugaaaccacaaagaaagaucuggggauuggacacgucgccguggagaaccaucaccaugcuacgaugcucgacguugaucugcacccugccuccgcguggacccuguacgccguggcuacaaccaucauuacacccaugaugcggcauaccaucgaaaacacgaccgccaauauuagccucacagcuaucgccaaccaggcggccauccuuaugggccuggacaagggcuggccuauuucuaaaauggauaucggggucccccugcucgcucugggaugcuacucccaggugaauccgcuuacccugacagccgcuguucucaugcugguggcccacuaugcuauuaucggcccugggcugcaagccaaggcgacccgcgaggcccagaagagaacggcugccggaauuaugaaaaaccccacagucgacggcaucguggcuaucgaucucgaccccgugguuuacgaugccaaguuugaaaaacagcuugggcagauuaugcugcugauccucuguaccagccaaauucugcuuaugcggacaaccugggcccugugcgagucuaucacccucgcgacaggaccucugacgacccugugggagggcagcccgggcaaguucuggaauacaaccauugcugucuccauggccaacaucuuucgcgggucuuaucucgcuggagccggccuugccuucagccugaugaaaucccucgggggaggcagacgggggacaggagcucagggcgaaacccucggcgagaaguggaagcgccagcugaaucagcuuagcaaauccgaauuuaacaucuacaagagaucugggauuauggagguggaccggagcgaagccaaagagggacugaagagaggcgagacgacacgccacgcggugucccgggggaccgccaaacucagaugguucgucgaacgcaaucugguuaagcccgagggaaaggugaucgaccugggcugugggcggggaggcuggucuuauuacugcgcuggccucaaaaaggugaccgaagucaaaggguauacaaagggaggcccugggcaugaggaacccauuccuauggccaccuacggauggaaccuugugaaacugcacagcggcaaggauguuuucuuuacacccccugagaaaugugacacgcugcucugcgauaucggggaguccucuccgaaucccaccauugaagagggaagaacacugcgcgugcuuaagauggucgaaccuuggcugcggggcaaccaauucuguaucaagauucucaaucccuacaugccuagcgugguugagacccuggagcagaugcagagaaaacauggcgggaugcuggugcgcaacccccucucccggaauagcacacacgaaauguauugggucucuugcggaaccggcaacaucguguccgcugugaauaugacgagcagaaugcugcuuaaccgcuuuaccauggcccaccggaagccgacauacgagagagacgucgaucugggggcgggaacccgccauguugccguggaaccugagguggcuaaccucgacaucauuggccagagaaucgaaaauauuaaacacgagcauaagucuacauggcacuaugaugaggacaaccccuacaaaaccugggccuaucauggguccuacgaagucaagcccagcggaucugcuuccagcauggugaauggcguugugaagcugcuuacaaaaccuugggaugucauccccauggugacccaaauugccaugacggacacaaccccuuucggccagcagcggguuuuuaaggagaaaguggauacccgcacaccgaaggcuaaaagagggacggcccaaaucauggaagucaccgcgcgguggcuguggggauuccucuccagaaacaagaagccccggaucuguacacgcgaggaauuuaccagaaaagugcggagcaaugccgcuauuggcgccguuuucguggacgagaaccaguggaacucugcuaaggaggccgucgaagacgagcgcuuuugggaucuggugcagaaagaaagagagcugcacaagcaggggaaaugcgccacaugcgucuauaacaugaugggaaagcgggaaaagaaacucggcgaguucgggaaggcgaaaggcagccgcgcuaucugguacauguggcugggagccagauuucuugaguucgaagcccugggcuuuaugaaugaggaccacugguucucccgggaaaacucucucagcgggguggagggagagggccugcauaaacuuggguacauucugcgcgauaucuccaaaauuccuggaggcaauauguaugcugacgauaccgccgggugggacacaagaaucaccgaagaugaccuccaaaacgaggcuaagaucacggauauuauggaacccgagcacgcccugcuggcgaccucuaucuucaaacucacauaccagaauaagguugugcggguccagcgcccugccaagaacggcaccgugauggacgugauuagcagacgggaucagcgcggauccggccaaguugggacauauggacugaauaccuuuacgaacauggaagcucagcuuaucagacagauggagucugagggcauuuuccugcccagcgaacucgagacaccgaaccuggccgaacgggugcuugacuggcuggagaaauacggggucgaaagacucaagcgcauggcuaucuccggagaugacugugugguuaaaccuaucgacgaucgguuugccaccgcgcugacagcccugaaugacaugggcaaggugagaaaagauauuccccagugggagccuagcaagggguggaacgacuggcaacagguccccuucugcucucaucacuuucaccagcucaucaugaaggauggccgcgagauuguggucccuugucggaaucaggacgaacuggugggacgggcucgcguuucccaaggcgccggguggagccuucgggagaccgcuugccugggaaaaucuuaugcccagauguggcagcucauguacuuccauagacgcgaucugcggcuugcugccaacgcgaucuguuccgccgugcccgucgacugggugccgacgagcagaaccacaugguccauucacgcucaucaccaauggaugaccacagaagauaugcugucuguuuggaaucgcguguggaucgaggaaaacccuuggauggaggacaagacccaugucagcuccuggggcgaugugcccuaucucgggaaacgggaggaccaguggugcggaagccugauuggccugacagccagagccaccugggcuucuaauauccagguggccaucaaccagguucggagacucauugggaaugaaaacuaccuggacuacaugacguccaugaagcgcuuuaaaaaugagggcgaucccgaaggagcgcuuugguga

SEQ ID NO: 19084 - RNA, 9879 nt, Artificial Sequence
  derived and/or modified CDS sequence (opt5) from DENV-1__FJ882569__SS-prME
agcgugaccaugcugcugaugcugaugcccacagcccuugcuuuccaccugacgaccagaggaggggaaccucauaugaucgucacaaagcaggaacggggaaaaucccuccuguuuaagaccucugccggaguuaacaugugcacacuuauugcgauggaccugggggaacucugugaagauaccaugacauacaaaugccccagaaucaccgaagcugaacccgacgauguggacuguuggugcaaugccacggauaccugggugacauauggaaccuguagccagacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaggacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacggaaugaaguucacagugguugugggcgacgucguggggauucucgcucagggcaagaagaugauccggccgcaacccauggagcacaaauacucuuggaaaagcuggggcaaggccaagauuaucggggccgaugugcagaauaccaccuuuaucauugacggaccuaacacacccgaauguccugaugaccagagagcuuggaauaucugggaggucgaggauuauggcuucggcauuuuuaccacgaacaucuggcugaagcugcgcgacuccuacacacagguuugcgaucaccggcuuaugagcgcggccauuaaagacucuaaggcugugcaugccgauaugggguauuggaucgaauccgagaaaaaugaaaccuggaagcucgccagagcuagcuucaucgaggugaagacauguauuuggcccaaaucucacacccugugguccaacggaguccuggaaagcgagaugaucauuccgaagaucuacggcgggccuauuucucaacauaauuaucgccccggauacuucacacagaccgccggcccuuggcaccucgggaaacuggagcuugacuuugaucugugcgaaggaacgaccgugguuguggacgagcacugcggcaaccggggccccagccucagaacaaccacagucaccgggaagaucauccaugaaugguguugccgguccuguacgcugccuccccugcgcuucaaaggagaggauggcugcugguacgggauggagauuagaccggugaaggaaaaggaggaaaaucuuguuaaaagcauggugucugcgggauccggcgaggucgacagcuuuucccucgggcugcuguguacaucuaucaugauugaagaggugaugcggagcagauggucccgcaagaugcucaugaccggaacacuggcuguuuuccuucugcucaucaugggccagcugaccuggaacgaccugauucggcuuugcaucauggugggcgccaaugccucugauagaauggggaugggaaccacauaucuggcucucauggccacguuuaaaaugcgcccuauguucgcggucggccugcucuuuagacggcugaccagccgcgaggugcuucugcucacaauugggcugucccugguggcuucugucgaacuucccaacagccuggaggaacucggagacggccuggccauggggaucaugauccucaagcugcuuaccgauuuccaaucccaccagcugugggccacacuccugagccugaccuuuauuaaaacgacacuuucucugcauuacgcuuggaagaccauggccaugguucucuccaucgugagccuguucccccucugucugucuaccacaucccagaagaccacauggcuuccugugcugcugggaagccucggcugcaaaccgcugacgauguuucuuauugcugagaauaagaucuggggcagacggucuuggccccugaacgaagggauuauggccgucggagugguuuccauccuccugagcucccuccugaaaaacgacgugccucuugcgggcccccugaucgccgggggaaugcugauugcuuguuaugucaucagcggcucuagcgccgaucucucccuggagaaggcugccgaggugucuugggaagaggaagccgagcacagcggggcuucccauaauauucuuguugaagugcaggacgauggaaccaugaaaaucaaggacgaggagcgcgaugacacacugaccauucuccugaaagcgacacuccuggccgucucuggcguguacccucuuagcauccccgcuacccuguucgucugguauuuuuggcaaaagaagaaacagagauccggcgugcugugggauacgccuucucccccggaaguugagcgggccgugcucgacgaugggaucuaccgcauuaugcagagaggacugcuuggccggagccaggucggggugggaguuuuccaagaaaacguguuccacaccauguggcacgucacacgcggcgccgugcugauguaucaggggaagagacucgagccuuccugggcuagcgugaaaaaggaccugaucucuuacggaggcggcuggcggcuccagggguccuggaauaccggagaggaaguucaggucauugccguggagcccggcaaaaacccuaagaaugugcaaacagcgcccgggaccuuuaagacaccggaaggagaggucggcgcuaucgcccuggacuucaaaccugggacgagcggaucucccauugugaacagagaaggcaagaucguuggccuuuacgggaauggaguggucaccacauccggcaccuaugugagcgccauugcucaggccaaagcgucccaggaggggccucugcccgagaucgaagaugagguuuuucgcaagcggaaccugaccaucauggaccuccaucccggaucuggcaaaacaagacgcuaccugccugcuauugugcgggaagccaucaagagaaaacuucgcacgcugauucucgccccgacccgggucguggcuagcgagauggccgaagcucugaaagggaugcccaucagauaucaaacaaccgccguuaaguccgagcacacaggcaaagagauuguggaucugaugugccaugcgaccuucacgaugcgccuccuuagcccuguccgggugcccaauuacaacaugaucaucauggacgaagcccacuuuacagauccuucuuccauugcugccagaggauauaucagcacccgggugggcaugggggaggcugccgccauuuucaugaccgcuacacccccuggaucugucgaagcguuuccgcagagcaaugccguuauccaggacgaggaacgcgauauucccgagagauccuggaacucuggcuacgaguggaucaccgacuucccugggaagacagugugguuugugcccagcaucaaauccggaaaugauauugcuaacugucugcggaagaauggcaagcgcgucauccagcugucuagaaaaaccuucgacacggaauaucaaaagaccaagaacaacgauugggacuacgugguuaccacagacauuagcgagaugggggccaauuuucgggccgauagagugaucgacccucgccggugccucaagcccgucauucugaaagauggcccggaaagagugauccuugcuggaccuaugcccguuaccguggccuccgcggcucagcgccggggcagaauugggcgcaaccauaauaaggagggagaccaguacaucuauaugggccagccccugaacaaugaugaggaccacgcccacuggacggaagccaagaugcuccuggauaacaucaauaccccugaggggauuauccccgcucuguucgaaccugagcgggaaaagagcgccgcgauugacggagaguacagacuccgcggcgaggccagaaagacauucgucgagcuuaugcggcgcggggaucugccgguguggcugucuuauaaagucgcuuccgagggcuuucaauacagcgacagacgguggugcuucgauggagaacgcaacaaucaggugcucgaggaaaacauggacguugagaucuggaccaaggagggcgaacgcaaaaagcugcggcccagauggcuugaugcccgcacauauuccgacccucuggcucuccgggaguuuaaagaguucgccgcugggagacgcucugugagcggagaccugauucuggagaucggcaagcucccccagcaucuuacccagcgggcccaaaaugcgcuggauaaccuggugaugcuccacaauuccgaacaagggggcagagccuaccggcaugcuauggaggagcugccugacacaaucgaaacccuuaugcugcucgcccugauugcuguccugacgggcggcguuacacucuuuuuccuuucugggcgcggacugggcaagaccagcaucgggcugcucugugugauggccuccagcgugcugcuuuggauggccucugucgagccccacuggauugcugcguccaucauucuggaauuuuuccucauggugcugcugaucccggagccugauagacagcggacaccccaggacaaccaacucgccuauguugugaucggacuucuguuuaugauucugacagucgcugccaaugagaugggccuccuggaaaccaccaaaaaggaucuugggaucggacacguggccgucgagaaccaucaccaugcuacgaugcuggacguggaucuccacccugccagcgcguggacccuguacgccguugcuacaaccauuaucacacccaugaugcgccauaccauugaaaacacgaccgccaauaucucucugacagcuauugccaaccaggcggccauccucaugggccuugacaaaggcuggccuaucuccaagauggauauuggggugccccugcuggcucucggaugcuacagccaggucaauccgcugacccuuacagccgcugugcugaugcucguugcccacuaugcuaucauuggcccugggcugcaagccaaagcgaccagagaggcccagaagcggacggcugccggaaucaugaagaaccccacaguggacggcauugucgcuaucgaucuggaccccgugguguacgaugccaaauucgaaaagcagcucgggcagaucaugcuucugauucuguguaccucucaaauccuccugaugcgcacaaccugggcccuuugcgagagcauuacccuggcgacaggaccucucacgacccugugggagggcuccccgggcaaauuuuggaauacaaccaucgcuguuucuauggccaacauuuucagagggagcuaucuggcuggagccggccucgccuuuucccuuaugaaaagccucgggggaggccggcgcgggacaggagcucagggcgaaacccugggcgagaaauggaagagacagcucaaucagcuguccaagucugaguucaacaucuacaaacggagcgggaucauggaggucgacagauccgaagccaaggagggacuuaaacgcggcgagacgacacggcacgcggugucuagagggaccgccaagcugcgcugguucguggaacggaaucucgucaaacccgagggaaagguuauugaccugggcugugggagaggaggcuggagcuauuacugcgcuggccugaagaaagugaccgaagugaagggguauacaaaaggaggcccugggcaugaggaacccaucccuauggccaccuacggauggaaccucgucaaacuucacuccggcaaagauguguuuuucacacccccugagaagugugacacgcugcugugcgauauuggggagucuagcccgaaucccaccaucgaagagggacgcacacuccggguucugaaaaugguggaaccuuggcuuagaggcaaccaauuuuguauuaagauccugaaucccuacaugccuuccgucguggagacccucgagcagaugcagcgcaagcauggcgggaugcugguucggaacccccugagcagaaauucuacacacgaaauguauuggguguccugcggaaccggcaacauugucagcgcugugaauaugacgucucgcaugcuccugaaccgguucaccauggcccacagaaaaccgacauacgagcgcgacguggaucuuggggcgggaaccagacaugucgccguugaaccugagguggcuaaccuggacaucaucggccagcggauugaaaauaucaagcacgagcauaaauccacauggcacuaugaugaggacaaccccuacaagaccugggccuaucaugggagcuacgaagugaaacccucuggauccgcuagcuccauggucaauggcgugguuaagcuccugacaaagccuugggaugugauucccauggucacccaaaucgccaugacggacacaaccccuuuuggccagcagcgcguguucaaagagaagguugauaccagaacaccgaaagcuaagcgggggacggcccaaauuauggaagugaccgcgagauggcuuuggggauuucugagccggaacaaaaagccccgcaucuguacaagagaggaguucacccggaagguccgcucuaaugccgcuaucggcgccguguuuguugacgagaaccaguggaauagcgcuaaagaggccguggaagacgagagauucugggaucucguccagaaggaacgggagcugcacaaacaggggaagugcgccacaugcguguauaacaugaugggaaaacgcgaaaagaagcugggcgaguuugggaaagcgaagggcuccagagcuauuugguacauguggcucggagcccgguuccuggaguuugaagcccuuggcuucaugaaugaggaccacugguucucucgcgaaaacagccuguccggggucgagggagagggccuccauaaacugggguacauccuuagagauauuucuaagaucccuggaggcaauauguaugcugacgauaccgccgggugggacacacggauuaccgaagaugaccugcaaaacgaggcuaaaaucacggauaucauggaacccgagcacgcccuccuggcgaccagcauuuuuaagcugacauaccagaauaaagugguucgcgugcagagaccugccaagaacggcaccgucauggacgugaucucccggcgcgaucagagaggaucuggccaaguggggacauauggacucaauaccuucacgaacauggaagcucagcugauucggcagauggagagcgagggcaucuuucuucccuccgaacuggagacaccgaaccucgccgaaagaguucuggacuggcuugagaaguacgggguggaacgccugaaacggauggcuauuagcggagaugacugugucgugaagccuaucgacgauagauucgccaccgcgcucacagcccugaaugacaugggcaaaguucgcaaggauaucccccagugggagccuucuaaaggguggaacgacuggcaacaggugcccuuuugcucccaucacuuccaccagcugauuaugaaggauggccgggagaucgucgugccuuguagaaaucaggacgaacucgucggacgcgcucgggugagccaaggcgccggguggucucugagagagaccgcuugccuuggaaaguccuaugcccagauguggcagcugauguacuuucaucgccgggaucucagacuggcugccaacgcgauuuguagcgccguucccguggacugggucccgacgucccgcaccacauggucuauccacgcucaucaccaauggaugaccacagaagauaugcuuagcguguggaaucggguuuggauugaggaaaacccuuggauggaggacaaaacccauguguccagcuggggcgauguccccuaucuggggaagagagaggaccaguggugcggaucucucaucggccugacagcccgggccaccugggcuuccaauauucagguggccaucaaccaggugagacgccugaucgggaaugaaaacuaccucgacuacaugacgagcaugaaacgguucaagaaugagggcgaucccgaaggagcgcugugguga

SEQ ID NO: 19085 - RNA, 9879 nt, Artificial Sequence
  derived and/or modified CDS sequence (opt5) from DENV-1__GQ199833__SS-prME
agcgugaccaugcugcucaugcugaugcccacagcccuugcuuuccaccugacgaccagaggcggggagccucauaugaucgucacaaagcaggaacggggaaaaucccuccuguuuaagaccucugccggcguuaacaugugcacacuuauugcgauggaccugggggagcucugugaagauaccaugacauacaaaugcccgcgcaucaccgaggcugaacccgacgauguggacuguuggugcaaugccacggauaccugggugacauauggaaccuguagccaaacaggcgagcacagacgggaccgcagauccgucgcccuggcuccucauguggggcugggacucgagacccggacggaaacauggaugucuagcgagggcgccuggaagcagauucagcgcguugaaaccugggcucugagacaccccggcuucacagugaucgcccuuuuucuggcgcaugccauugggaccuccaucacccagaaaggaaucauuuucauccuccugaugcuugucacaccuucuauggcuaugcggugcgugggcauugggagccgcgauuuuguugagggacuguccggcgccacguggguggacgucgugcucgagcacgggagcugugugaccacaauggcuaaggauaagcccacccuggacaucgaacugcucaaaacagaggucaccaacccugccguucugagaaagcuuugcauugaagcgaaaaucucuaauacgacaaccgauucccgguguccgacccaaggagaggccacacugauggaagagcaggacgcuaacuucgugugccgcagaaccuuuguggaucggggcuggggcaauggguguggacucuucggcaaggggagccugauuacaugcgccaaauuuaagugcgucacgaagcuugagggaaaaaucgugcaguacgaaaaccugaaguauucuguuaucgugaccguccacacaggcgaccagcaucaaguggggaaugaguccaccgaacacggaacaaccgcuacgauuaccccccaggccccuacaagcgagauccagcucaccgacuacggcgcccugacacuggauuguucuccccgcaccggccucgacuucaacgaaaugguucugcuuacgaugaaagggaaguccuggcuggugcauaaacagugguuucucgaucugccucuucccuggacaagcggagcuuccaccucucaagagacauggaauagacaggaccugcucgucaccuucaagaccgcgcacgccaaaaagcaggagguggucgugcugggcagccaagaaggggcuaugcacacagcccugacgggagccaccgagauucagacauccggcaccacaaccaucuuugcugggcaucucaagugccggcugaaaauggauaagcuuacgcugaaaggcaugagcuauguuauguguacaggaucuuucaagcucgaaaaagagguggccgaaacccagcacggcaccguccuggugcagauuaaguacgaggggacagacgcgccgugcaagaucccuuucuccacccaagaugagaaaggaguuacacagaacggcagacugaucacggcuaaucccauugugaccgacaaggaaaaaccugucaacaucgaggccgaaccccccuuuggggagagcuauauugugaucggagccggcgagaaggcucuuaaacucucuugguucaagaaggggagcuccauuggcaaaauguuugaagccacagcucgcggagcccggagaauggcgauccugggcgauaccgccugggacuucgggucuaucggaggcguguuuacaagcguugggaagcugguccaucagauuuucggaaccgcuuacggcgugcucuuuuccggggugagcuggacgaugaaaaucggcauuggaguccugcuuaccuggcugggccucaauucucgcuccacaagccugucuaugaccuguaucgccguggggcugguuacacuuuaccucggagugaugguccaggcugauuccggcugcgugauuaacuggaaggggcgggagcugaaauguggaagcggcaucuucguuaccaaugaagugcacacauggaccgagcaauauaaguuucaggccgacuccccuaagagacugucugcggccauugggaaagcuugggaagagggcgucugcggaauccgcagcgccacgcggcucgagaacaucauguggaagcagauuuccaacgaacugaaucauauccuucuggagaacggcaugaaauucacagugguugugggggacgucgugggaauucucgcucagggcaagaaaaugaucagaccgcaacccauggaacacaaguacucuuggaaaagcugggggaaggccaagauuaucggagccgaugugcagaauaccaccuuuaucauugacggcccuaacacacccgaguguccugaugaccagcgcgcuuggaauaucugggaagucgaggauuauggcuucgggauuuuuaccacgaacaucuggcugaaacugcgggacuccuacacacagguuugcgaucacagacuuaugagcgcggccauuaaggacucuaaagcugugcaugccgauaugggauauuggaucgaguccgaaaagaaugagaccuggaaacucgcccgcgcuagcuucaucgaagugaagacauguauuuggcccaagucucacacccugugguccaacggcguccuggagagcgaaaugaucauuccgaaaaucuacgggggaccuauuucucaacauaauuaucggcccggcuacuucacacagaccgccgggccuuggcaccucggaaagcuggagcuugacuuugaucugugcgagggcacgaccgugguuguggacgaacacugcggcaacagagggcccagccuccggacaaccacagucaccggaaaaaucauccaugagugguguugccgcuccuguacgcugccuccccugagauucaagggcgaagaugggugcugguacggaauggagauucggccggugaaagagaaggaagagaaucuuguuaagagcauggugucugcgggcuccggggaagucgacagcuuuucccucggacugcuguguaucucuauuaugaucgaggaagugaugagaagccgcuggucccggaaaaugcucaugacaggcacccuggcuguuuuccuucugcucauuaugggccagcugacauggaacgaccugaucagacuuugcauuauggugggggccaaugccucugaucgcaugggaaugggcaccaccuaucuggcucucauggccacauuuaagaugagaccuauguucgcggucgggcugcucuuucggcgccugacgagcagagaggugcuucugcucaccaucggacugucccugguggcuucugucgagcuucccaacagccuggaagagcucggcgacgggcuggccaugggaaucaugauucucaaacugcuuacagauuuccaaucccaccagcugugggccacccuccugagccugacauuuaucaagaccacgcuuucucugcauuacgcuuggaaaacaauggccaugguucucuccauugugagccuguucccccucugucugucuaccaccucccagaagacaaccuggcuuccugugcugcugggcagccucggcugcaagccgcugacaauguuucuuaucgcugaaaauaaaauuugggggcggaagucuuggccccugaacgagggaaucauggccgucggcgugguuuccauccuccugagcucccuccugaaaaacgacgugccucuugcggggccccugauugccggaggcaugcugaucgcuuguuaugucauuagcgggucuagcgccgaucucucccuggaaaaggcugccgaggugucuugggaggaagaggccgaacacagcggagcuucccauaauauccuuguugaggugcaggacgauggcacgaugaaaauuaaggacgaagagcgcgaugacacccugacaauccuccugaaagcgacccuccuggccgucucuggcguguacccucuuagcauccccgcuacacuguucgucugguauuuuuggcaaaagaagaaacagagauccggggugcugugggauaccccuucucccccggagguugaacgggccgugcucgacgauggaauuuaccgcaucaugcagagaggccugcuugggcggagccaggucggagugggcguuuuccaagagaacguguuccacacgauguggcacgucacccgcggggccgugcugauguaucagggaaagagacucgaaccuuccugggcuagcgugaaaaaggaccugauuucuuacggcggcggguggcggcuccagggauccuggaauacaggcgaggagguucaggucaucgccguggaacccgggaaaaacccuaagaaugugcaaaccgcgcccggaacauuuaagaccccggagggcgaagucggggcuauugcccuggacuucaaaccuggaacaagcggcucucccaucgugaacagagagggcaagauuguugggcuuuacggaaauggcguggucacgaccuccgggacauaugugagcgccaucgcucaggccaaagcgucccaggaaggaccucugcccgagaucgaggaugaaguuuuucgcaagcggaaccugaccauuauggaccuccaucccggcucugggaaaaccagacgcuaccugccugcuaucgugcgggaggccauuaagagaaagcuucgcacacugauccucgccccgacgcgggucguggcuagcgaaauggccgaggcucugaaaggcaugcccauuagauaucaaaccacagccguuaaguccgaacacaccggaaaagagaucguggaucugaugugccaugcgacauucaccaugcgccuccuuagcccuguccgggugcccaauuacaacaugaucauuauggacgaggcccacuuuacggauccuucuuccaucgcugccagaggcuauauuagcacacggguggggaugggagaagcugccgccaucuucaugaccgcuacccccccuggcucugucgaggcguuuccgcagagcaaugccguuauucaggacgaagagcgcgauauccccgaaagauccuggaacucuggguacgaguggaucacagacuucccuggaaagaccgugugguuugugcccagcauuaaauccggcaaugauaucgcuaacugucugcggaagaaugggaagcgcgucauucagcugucuagaaaaacauucgacaccgaguaucaaaagacgaaaaacaacgauugggacuacgugguuacaaccgacaucagcgaaaugggcgccaauuuucgggccgauagagugauugacccucgccggugccucaagcccgucauccugaaagauggaccggagagagugauucuugcuggcccuaugcccguuacaguggccuccgcggcucagcgccgggggagaaucggacgcaaccauaauaaggaaggcgaccaguacaucuauauggggcagccccugaacaaugaugaggaccacgcccacuggaccgaggccaagaugcuccuggauaacauuaauacgccugaaggaaucauucccgcucuguucgagccugaacgggagaaaagcgccgcgaucgacggcgaauacagacuccgcggggaggccagaaagaccuucgucgagcuuaugcggcgcggcgaucugccgguguggcugucuuauaaagucgcuuccgaaggauuucaauacagcgacagacgguggugcuucgauggcgagcgcaacaaucaggugcucgaagagaacauggacguugaaauuuggacaaaggagggggagagaaaaaagcugcggcccagauggcuugaugcccgcaccuauuccgacccucuggcucuccgggaauuuaaagaguucgccgcuggaagacgcucugugagcggcgaccugauccuggaaaucgggaagcucccccagcaucuuacacagcgggcccaaaaugcgcuggauaaccuggugaugcuccacaauuccgagcagggaggcagagccuaccggcaugcuauggaagagcugccugacaccauugagacacuuaugcugcucgcccugaucgcuguccugaccggcgggguuacgcucuuuuuccuuucuggacgcggccuggggaagacaagcauuggacugcucugugugauggccuccagcgugcugcuuuggauggccucugucgaaccccacuggaucgcugcguccauuauccuggaguuuuuccucauggugcugcugaucccggaaccugauagacagcggaccccccaggacaaccaacucgccuauguugugauuggccuucuguuuaugauccugaccgucgcugccaaugagauggggcuccuggagacaaccaaaaaggaucuuggaauuggccacguggccgucgaaaaccaucaccaugcuacaaugcuggacguggaucuccacccugccagcgcguggacgcuguacgccguugcuaccacaaucauuacccccaugaugcgccauacaaucgagaacaccacggccaauauuucucugaccgcuaucgccaaccaggcggccauccucaugggccuugacaaaggguggccuauuuccaagauggauaucggagugccccugcuggcucucggcugcuacagccaggucaauccgcugacacuuaccgccgcugugcugaugcucguugcccacuaugcuauuaucgggccuggacugcaagccaaagcgacaagagaagcccagaagcggaccgcugccggcauuaugaagaaccccacgguggacgggaucgucgcuaucgaucuggaccccgugguguacgaugccaaauucgagaagcagcucggacagauuaugcuucugauccuguguacaucucaaauucuccugaugcgcaccacaugggcccuuugcgaaagcaucacccuggcgaccggcccucucacaacgcugugggagggcuccccggggaaauuuuggaauaccacaauugcuguuucuauggccaacaucuucagaggaagcuaucuggcuggcgccgggcucgccuuuucccuuaugaagagccugggaggcgggcggcgcggaaccggcgcucagggcgagacacugggggaaaaauggaagagacagcucaaucagcuguccaagucugaguucaacaucuacaaacggagcggaauuauggaagucgacagauccgaggccaaggaaggccuuaaacgcggggagaccacgcggcacgcggugucuagaggaacagccaagcugcgcugguucguggagcggaaucucgucaaacccgaaggcaagguuaucgaccugggguguggaagaggcggcuggagcuauuacugcgcugggcugaagaaagugaccgaggugaagggauauaccaaaggcgggccuggacaugaagagcccauuccuauggccacauacggcuggaaccucgucaagcuucacuccgggaaagauguguuuuucacccccccugaaaagugugacacacugcugugcgauaucggagagucuagcccgaaucccacgauugaggaaggccgcacccuccggguucugaaaaugguggagccuuggcuuagaggcaaccaauuuuguaucaagauucugaaucccuacaugccuuccgucguggaaacacucgagcagaugcagcgcaagcaugggggaaugcugguucggaacccccugagcagaaauucuacccacgagauguauuggguguccugcggcacagggaacaucgucagcgcugugaauaugaccucucgcaugcuccugaaccgguucacgauggcccacagaaaaccgaccuacgaacgcgacguggaucuuggagcgggcacaagacaugucgccguugagccugaaguggcuaaccuggacaucauugggcagcggaucgagaauauuaagcacgaacauaaauccaccuggcacuaugaugaggacaaccccuacaagacaugggccuaucauggaagcuacgaggugaaacccucuggcuccgcuagcuccauggucaauggcgugguuaagcuccugaccaagccuugggaugugauccccauggucacacaaauugccaugaccgacacgacaccuuuugggcagcagcgcguguucaaagaaaagguugauaccagaaccccgaaagcuaagcggggaacagcccaaaucauggaggugacggcgagauggcuuuggggcuuucugagccggaacaaaaagccccgcaucuguaccagagaagaguucacacggaagguccgcucuaaugccgcuauuggggccguguuuguugacgaaaaccaguggaauagcgcuaaagaggccguggaggacgaaagauucugggaucucguccagaaggagcgggaacugcacaaacagggaaagugcgccaccugcguguauaacaugaugggcaaacgcgagaagaagcugggggaauuuggcaaagcgaagggauccagagcuaucugguacauguggcucggcgcccgguuccuggaguuugaggcccuuggguucaugaaugaagaccacugguucucucgcgagaacagccuguccggagucgaaggcgaggggcuccauaaacugggauacauucuuagagauaucucuaagauuccuggcgggaauauguaugcugacgauacagccggcugggacacccggaucacagaggaugaccugcaaaacgaagcuaaaaucaccgauauuauggagcccgaacacgcccuccuggcgacgagcaucuuuaagcugaccuaccagaauaaagugguucgcgugcagagaccugccaagaacggaacagucauggacgugauuucccggcgcgaucagagaggcucugggcaagugggaaccuauggccucaauacauucaccaacauggaggcucagcugauccggcagauggaaagcgaggggauuuuucuucccuccgagcuggaaacgccgaaccucgccgagagaguucuggacuggcuugaaaaguacggaguggagcgccugaaacggauggcuaucagcggcgaugacugugucgugaagccuaucgacgauagauucgccacagcgcucaccgcccugaaugacauggggaaaguucgcaaggauauuccccagugggaaccuucuaaaggcuggaacgacuggcaacaggugcccuuuugcucccaucacuuccaccagcugaucaugaaggauggacgggagauugucgugccuuguagaaaucaggacgagcucgucggccgcgcucgggugagccaaggggccggauggucucugagagaaacagcuugccuuggcaaguccuaugcccagauguggcagcugauguacuuucaucgccgggaucucagacuggcugccaacgcgaucuguagcgccguucccguggacugggucccgaccucccgcacgaccuggucuauucacgcucaucaccaauggaugacaaccgaggauaugcuuagcguguggaaucggguuuggaucgaagagaacccuuggauggaagacaaaacacauguguccagcuggggggauguccccuaucugggaaagagagaggaccaguggugcggcucucucauugggcugaccgcccgggccacaugggcuuccaauauccagguggccaucaaccaggugagacgccugauuggcaaugagaacuaccucgacuacaugaccagcaugaaacgguucaagaaugaaggagaucccgagggcgcgcugugguga

SEQ ID NO: 19086 - RNA, 9879 nt, Artificial Sequence
  derived and/or modified CDS sequence (opt5) from DENV-1__FJ882570__SS-prME
agcgugaccaugcugcucaugcugaugcccaccgcccuugcuuuccaccugacgacccggggcggggagccucauaugaucgucacaaagcaggaacggggaaaaucccuccuguuuaagaccucugccggcguuaacaugugcacacuuauugcgauggaccugggggagcucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaggaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugggaagggaguuacacagaacggccggcugaucacggcuaaucccauugugaccgacaaagaaaagccugucaacaucgaggccgaaccgcccuuuggggagagcuauauugugaucggagccggcgagaaagcucuuaagcucucuugguucaagaaagggagcuccauuggcaagauguuugaagccacagcuagaggagcccgccggauggcgauccugggcgauaccgccugggacuucgggucuaucggaggcguguuuacaagcguugggaaacugguccaucagauuuucggaaccgcuuacggcgugcucuuuuccggggugagcuggacgaugaagaucggcauuggaguccugcuuaccuggcugggccucaauucuagauccacaagccugucuaugaccuguaucgccguggggcugguuacacuuuaccucggagugaugguccaggcugauuccggcugcgugauuaacuggaaagggcgcgagcugaaguguggaagcggcaucuucguuaccaaugaagugcacacauggaccgagcaauauaaguuucaggccgacuccccuaaacggcugucugcggccauugggaaggcuugggaagagggcgucugcggaaucagaagcgccacgcgccucgagaacaucauguggaaacagauuuccaacgaacugaaucauauccuucuggagaacggcaugaaguucacagugguugugggggacgucguggggauucucgcucagggcaaaaagaugauccggccgcaacccauggaacacaaauacucuuggaaaagcugggggaaggccaagauuaucggagccgaugugcagaauaccaccuuuaucauugacggcccuaacacacccgaguguccugaugaccagagagcuuggaauaucugggaagucgaggauuauggcuucgggauuuuuaccacgaacaucuggcugaagcugcgcgacuccuacacacagguuugcgaucaccggcuuaugagcgcggccauuaaagacucuaaggcugugcaugccgauaugggauauuggaucgaguccgagaaaaaugagaccuggaagcucgccagagcuagcuucaucgaagugaagacauguauuuggcccaaaucucacacccugugguccaacggcguccuggagagcgaaaugaucauuccgaagaucuacgggggaccuauuucucaacauaauuaucgccccggcuacuucacacagaccgccgggccuuggcaccucggaaaacuggagcuugacuuugaucugugcgagggcacgaccgugguuguggacgaacacugcggcaaccgggggcccagccucagaacaaccacagucaccggaaagaucauccaugagugguguugccgguccuguacgcugccuccccugcgcuucaaaggcgaagaugggugcugguacggaauggagauuagaccggugaaggagaaggaagagaaucuuguuaaaagcauggugucugcgggcuccggggaagucgacagcuuuucccucggacugcuguguacaucuaucaugauugaggaagugaugcggagcagauggucccgcaagaugcucaugaccggcacacuggcuguuuuccuucugcucaucaugggccagcugaccuggaacgaccugauucggcuuugcaucauggugggggccaaugccucugauagaaugggaaugggcaccacauaucuggcucucauggccacguuuaaaaugcgcccuauguucgcggucgggcugcucuuuagacggcugaccagccgcgaggugcuucugcucacaauuggacugucccugguggcuucugucgagcuucccaacagccuggaagaacucggcgacgggcuggccaugggaaucaugauccucaagcugcuuaccgauuuccaaucccaccagcugugggccacacuccugagccugaccuuuauuaaaacgacacuuucucugcauuacgcuuggaagaccauggccaugguucucuccaucgugagccuguucccccucugucugucuaccacaucccagaagaccacauggcuuccugugcugcugggcagccucggcugcaaaccgcugacgauguuucuuauugcugaaaauaagaucugggggagaaaaucuuggccccugaacgagggaauuauggccgucggcgugguuuccauccuccugagcucccuccugaagaacgacgugccucuugcggggccccugaucgccggaggcaugcugauugcuuguuaugucaucagcgggucuagcgccgaucucucccuggaaaaagcugccgaggugucuugggaggaagaggccgaacacagcggagcuucccauaauauuuucguugaggugcaggacgauggcaccaugaagaucaaagacgaagaacgggaugacacacuuaccauucugcucaaggcgacacugcucgccgucucuggcguguacccucugagcauccccgcuacccuuuuugucugguauuucuggcaaaagaaaaagcagcgcuccggggugcugugggauacgccuucucccccggagguugaaagagccgcccuggacgauggaaucuaccggauuaugcagcgcggccuccuggggagaagccaggugggagucggcguguuccaagagaacguuuuucacaccauguggcacgugacaagaggggcuguccuuauguaucagggaaaacgccuggaaccuuccugggccagcgugaagaaagaccucaucucuuacggcggcggguggagacugcagggauccuggaauaccggcgaggaggugcagguuauugcggucgaacccgggaagaacccuaagaaugugcaaacagcucccggaaccuucaaaacaccggagggcgaagugggggccaucgcccucgacuuuaagccuggaacgagcggcucucccauugucaaccgggagggcaaaaucguggggcuguacggaaauggcguugugaccacauccgggaccuaugucagcgcuauugcccaggcgaaggcuucccaggaaggaccucuucccgagaucgaggaugaaguguucagaaaacgcaaccugaccaucauggaccugcaucccggcucugggaagacacggagauaccucccugccauuguucgcgaggccaucaagcggaaacugagaacgcuuauucuggcuccgacccgcguggucgccagcgaaauggcugaggcccucaagggcaugcccauccgguaucaaacaaccgcggugaaauccgaacacacaggaaaggagauuguugaucugaugugccaugccaccuuuacgaugagacugcucagcccugugcgcguccccaauuacaacaugaucaucauggacgaggcucacuucacagauccuucuuccauugccgcucggggcuauaucagcaccagaguggggaugggagaagccgccgcuauuuuuaugaccgcgacacccccuggcucuguggaggccuucccgcagagcaaugcugucauccaggacgaggaacgggauauucccgaacgcuccuggaacucuggguacgaguggaucaccgacuuuccuggaaaaacaguuugguucgugcccagcaucaaguccggcaaugauauugccaacugucuuagaaagaaugggaaacgggugauccagcugucucgcaagaccuuugacacggaguaucagaaaaccaagaacaacgauugggacuacgucgugaccacagacauuagcgaaaugggcgccaauuucagagcugaucggguuaucgacccuagacgcugccugaaacccgugauucucaaggauggaccggagcgggucauccuggccggcccuaugcccgugaccguugcguccgcugcccagagacgcgggcggauuggaagaaaccauaauaaggaaggcgaccaguacaucuauauggggcagccccuuaacaaugaugaggaccacgcccacuggacggaggcuaaaaugcugcucgauaacaucaauaccccugaaggaauuauccccgcccuguucgagccugaacgcgaaaagagcgcggccauugacggcgaauaccggcugagaggggaggcucgcaaaacauuuguggagcucaugagacggggcgaucuuccggucuggcugucuuauaagguggccuccgaaggauuccaauacagcgaccgcagauggugcuuugauggcgagcggaacaaucagguccuggaagagaacauggacguggaaaucuggaccaaagagggggagcgcaagaaacucagaccccgguggcuggaugcuagaacauauuccgacccucuugcccugcgcgaguucaaggaguuugcugccggacggagaucuguuagcggcgaccucauucuggaaaucgggaagcugccccagcaucucacccagcgcgcgcaaaaugcccuugauaaccuggugaugcugcacaauuccgagcagggaggccgggcuuacagacaugccauggaggaacucccugacacaaucgagacccugaugcuucuggcucucauugccgugcugacgggcggggucacacuguucuuucucucuggacggggccuugggaaaaccagcaucggacugcuguguguuauggccuccagcgugcuccuguggauggcuucuguggaaccccacuggauugcggccuccaucauucuugaguucuuucugaugguccuccugaucccggaaccugaucgccagagaacaccccaggacaaccaacuggcuuaugugguuaucggccuccuuuucauuauccugacaguggccgccaaugagauggggcugcucgagaccacaaagaaagaucugggaauuggccacgucgcuguggaaaaccaucaccaugccacgaugcuugacgucgaucugcacccugcgagcgccuggacccucuacgcuguggccacaaccaucauuacacccaugaugcggcauaccaucgagaacacgaccgcuaauauuucucugacagccaucgcgaaccaggccgcuauccugaugggccucgacaagggguggccuauuuccaaaauggauaucggaguuccccuucuggcccugggcugcuacagccaggugaauccgcucacccugacagcugccguccuuaugcugguggcucacuaugccauuaucgggccuggacuccaagcgaaggccacccgcgaagcucagaagagaacggccgcuggcauuaugaaaaaccccacaguugacgggaucguggccaucgaucuggaccccgucguguacgaugccaaguuugagaaacagcugggacagauuaugcuccuuauccuguguaccucucaaauucugcucaugcggacaaccugggcgcugugcgaaagcaucacccuugcuacaggcccucugacgacccucugggagggcuccccggggaaguucuggaauacaaccauugccgugucuauggcuaacaucuuucgcggaagcuaucuggccggcgccgggcuggcuuucucccucaugaaaagccuuggaggcgggagacggggaacaggcgcccagggcgagacccugggggaaaaguggaagcgccagcugaaucagcucuccaaaucugaguucaacaucuacaagagaagcggaauuauggaaguugaccgguccgaggcgaaagaaggccugaagagaggggagacgacacgccacgccgucucucggggaaccgcuaaacuuagaugguuuguggagcgcaaucuggugaagcccgaaggcaaggucaucgaccucggguguggacggggcggcuggagcuauuacugcgccgggcugaaaaagguuaccgaggugaaaggauauacaaagggcgggccuggacaugaggaacccauuccuauggcuaccuacggcuggaaccuggugaaacuccacuccgggaaggaugucuucuuuacacccccugaaaaaugugacacgcuucugugcgauaucggagagucuagcccgaaucccaccauugaggaaggcagaacacugcgcgugcucaagaugguugagccuuggcugcggggcaaccaauucuguaucaagauucuuaaucccuacaugccuuccguggucgaaacccuggagcagaugcagagaaaacaugggggaaugcucgugcgcaacccccugagcagaaauucuacacacgagauguauuggguuuccugcggcaccgggaacaucgugagcgccgucaauaugacgucuagaaugcugcucaaccgcuuuaccauggcgcaccggaagccgacauacgaaagagacguggaucugggagccggcacccgccauguggcugucgagccugaaguugccaaccuugacaucauugggcagagaaucgagaauauuaaacacgaacauaaguccacauggcacuaugaugaggacaaccccuacaaaaccugggcuuaucauggaagcuacgaggugaagcccucuggcuccgccagcuccauggugaauggcgucgugaagcugcucacaaaaccuugggauguuauccccauggugacccaaauugcuaugacggacacaaccccuuucgggcagcagcgggucuuuaaggaaaaaguggauacccgcacaccgaaggccaaaagaggaacggcgcaaaucauggagguuaccgcccgguggcuguggggcuuccuuagcagaaacaagaagccccggaucuguacacgcgaagaguuuaccagaaaagugcggucuaaugcugccauuggggcugucuucguggacgaaaaccaguggaauagcgccaaggaggccguugaggacgaacgcuuuugggaucuggugcagaaagagagagaacuccacaagcagggaaaaugcgcgacaugcgucuauaacaugaugggcaagcgggagaagaaacugggggaguucggcaaggcuaaaggaucccgcgccaucugguacauguggcugggcgccagauuucucgaguucgaggcucugggguucaugaaugaagaccacugguuuucucgggagaacagccuuuccggaguggaaggcgaggggcugcauaagcucggauacauucugcgcgauaucucuaaaauuccuggcgggaauauguaugccgacgauaccgcuggcugggacacaagaaucaccgaggaugaccuucaaaacgaagccaagaucacggauauuauggagcccgaacacgcgcugcucgccaccagcaucuucaaacugacauaccagaauaaggucgugcggguucagcgcccugcuaagaacggaaccgugauggacgucauuuccagacgggaucagcgcggcucugggcaagugggaacauauggccugaauaccuuuacgaacauggaggcccagcucaucagacagauggaaagcgaggggauuuuccugcccuccgagcuugaaacaccgaaccuggcugagcgggugcucgacuggcuggaaaaauacggaguugagagacuuaagcgcauggccaucagcggcgaugacuguguggucaaaccuaucgacgaucgguuugcgaccgcccugacagcucucaaugacauggggaaggugagaaaagauauuccccagugggaaccuucuaagggcuggaacgacuggcaacagguucccuucugcucccaucacuuucaccagcugaucaugaaggauggacgcgagauuguggucccuugucggaaucaggacgagcuggugggcagagcccgcgucagccaaggggcuggauggucucuccgggaaaccgccugccugggcaaauccuaugcucagauguggcagcuuauguacuuccauagacgcgaucugcggcucgccgcgaacgccaucuguagcgcugugcccguugacugggugccgacguccagaaccacauggucuauucacgcccaucaccaauggaugaccacagaggauaugcugagcgucuggaaucgcguguggaucgaagagaacccuuggauggaagacaagacccauguuuccagcuggggagaugugcccuaucuuggaaaacgggaggaccaguggugcggcucucugauugggcucacagccagagcuaccugggccuccaauauccaggucgcgaucaaccaggugcggagacugauuggcaaugagaacuaccuggacuacaugacgagcaugaagcgcuuuaaaaaugaaggagaucccgagggcgcucucugguga

SEQ ID NO: 19087 - RNA, 9879 nt, Artificial Sequence
  derived and/or modified CDS sequence (opt5) from DENV-1__GQ199834__SS-prME
agcgugaccaugcugcugaugcugaugcccaccgcccuugcuuuccaccugacgacccggggaggggaaccucauaugaucgugaccaagcaggaacggggaaagucccugcuguuuaagaccucugccggcguuaacaugugcacccuuauugccauggaccugggggaacuuugugaagauaccaugacauacaagugcccccgcaucaccgaggcugaacccgacgauguggacuguuggugcaaugccacggauaccugggugacauauggaaccuguagccagacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaacuggccgagacccagcacggaaccgugcugguccagauuaaguacgagggcacagacgcgccgugcaaaaucccuuucuccacccaagaugaaaagggggugacacagaacggacggcuuaucacggcuaaucccauuguuaccgacaaagagaagccugugaacaucgaagccgagccgcccuuuggcgagagcuauauugucaucggggccggagaaaaagcucucaagcugucuugguucaagaaaggcagcuccauugggaagauguuugaggccacagcuagaggcgcccgccggauggcgauccugggagauaccgccugggacuucggcucuaucgggggaguguuuacaagcgugggcaaacucguucaucagauuuucgggaccgcuuacggaguccuguuuuccggcgugagcuggacgaugaagaucgggauuggcgugcuucugaccuggcucggacucaauucuagauccacaagccugucuaugaccuguaucgccgucggccuugugacacucuaccuggggguuauggugcaggcugauuccggaugcgucauuaacuggaaaggccgcgaacugaagugugggagcggaaucuucgugaccaaugagguucacacauggaccgaacaauauaaguuucaggccgacuccccuaaacggcucucugcggccauuggcaaggcuugggaggagggggugugcggcaucagaagcgccacgcgccuggaaaacaucauguggaaacagauuuccaacgagcuuaaucauauccugcucgaaaacggaaugaaguucacagucgugguuggcgacguggaugggauucuggcucagggcaagaagaugauccggccgcaacccauggagcacaaauacucuuggaaaagcuggggcaaggccaagauuaucggggccgacguccagaauaccaccuuuaucauugauggaccuaacacacccgaauguccugacgaucagagagcuuggaauaucugggagguggaggacuauggcuucggcauuuuuaccacgaacaucuggcugaaacuucgcgauuccuacacacaggugugcgaccaccggcucaugagcgcggccauuaaagauucuaaggcuguccaugccgacaugggguauuggaucgaauccgagaaaaaugaaaccuggaagcuggccagagcuagcuucaucgagguuaagacauguauuuggcccaaaucucacacccugugguccaacggagugcucgaaagcgagaugaucauuccgaagaucuacggcgggccuauuucucaacauaauuaucgccccggauacuucacacagaccgccggcccuuggcaccuggggaaacuugagcuggauuuugaccucugcgaaggaacgaccguggucguggaugagcacugcggcaaccggggccccagccugagaacaaccacaguuaccgggaagaucauccaugaaugguguugccgguccuguacgcugccuccccuucgcuucaaaggagaggacggcugcugguacgggauggagauuagaccggugaaggaaaaggaggaaaaucucgucaaaagcauggugucugcgggauccggcgagguugacagcuuuucccuggggcugcucuguaucucuauuaugaucgaagaggugaugcggagcagauggucccgcaagaugcugaugacaggaacccuugcugucuuccugcuccugauuaugggccagcugacauggaacgaucuuauccggcugugcauuauggugggcgccaaugccucugacagaauggggaugggaaccaccuaucucgcucugauggccacauuuaaaaugcgcccuauguucgcgguuggccuccuguuuagacggcuuacgagccgcgaggugcugcuccugaccaucgggcugucccuugucgcuucuguggaacugcccaacagccucgaggaacugggagauggccucgccauggggaucaugauucugaaacuucugacagacuuccaaucccaccagcucugggccacccugcugagccuuacauuuaucaaaaccacgcugucucuccauuacgcuuggaagacaauggccauggugcuguccauugucagccucuucccccugugucuuucuaccaccucccagaagacaaccuggcugccuguucugcucggaagccugggcugcaaaccgcuuacaauguuucugaucgcugagaauaagauuuggggcagaaaaucuuggccccucaacgaagggaucauggccgugggaguggucuccauccugcucagcucccugcuuaagaacgaugugccucuggcgggcccccugauugccgggggaaugcucaucgcuuguuauguuauuagcggcucuagcgccgaccugucccuugagaaagcugccgaggugucuugggaagaggaagccgagcacagcggggcuucccauaauauccuggucgaagugcaggaugacggaacgaugaagauuaaagaugaggagcgggacgauacccucacaauccugcucaaggcgacccugcuugccguuucuggcguguacccucugagcauccccgcuacacuguucgucugguauuuuuggcaaaagaaaaagcagcgcuccggcgugcucugggacaccccuucucccccggaagucgagagagccgugcuggaugacgggauuuaccggaucaugcagcgcggacuucugggcagaagccagguuggggugggagucuuccaagaaaacguguuccacacgauguggcacguuacccggggcgccgugcucauguaucaggggaaacgccuggagccuuccugggcuagcgucaagaaagaccucauuucuuacggaggcggcuggagacugcagggguccuggaauacaggagaggaaguccaggugaucgccguugagcccggcaagaacccuaagaauguccaaaccgcgcccgggacauuuaaaaccccggaaggagaggugggcgcuauugcccuugauuucaagccugggacaagcggaucucccaucgugaaccgggaaggcaaaauugucggccuguacgggaauggagugguuacgaccuccggcacauaugugagcgccaucgcucaggccaaggcgucccaggaggggccucugcccgagaucgaagacgaggucuuuagaaaacgcaaccucaccauuauggaucugcaucccggaucuggcaagacccggagauaccuuccugcuaucgugcgcgaagccauuaagcggaaacugagaacacucauccuggccccgacgcgcguuguggcuagcgagauggccgaagcucugaaggggaugcccauucgguaucaaaccacagccgucaaauccgagcacaccggcaaggagaucguggaccucaugugccaugcgacauucaccaugagacuucugagcccuguucgcgugcccaauuacaacaugaucauuauggaugaagcccacuuuacggacccuucuuccaucgcugcccggggauauauuagcacaagagucggcaugggggaggcugccgccaucuucaugaccgcuacacccccuggaucuguggaagcguuuccgcagagcaaugccgugauucaggaugaggaacgggacauccccgagcgcuccuggaacucuggcuacgaguggaucacagauuucccugggaaaaccgucugguuuguucccagcauuaaguccggaaaugacaucgcuaacugucugagaaagaauggcaaacgggugauucagcucucucgcaagacauucgauaccgaauaucagaagacgaagaacaacgacugggacuacguggucacaaccgauaucagcgagaugggggccaauuuuagagccgaccgggugauugauccuagacgcugccugaaacccguuauccuuaaggacggcccggaacgggugauucuggcuggaccuaugcccgucacaguggccuccgcggcucagagacgcggccggaucgggagaaaccauaauaaggagggagaucaguacaucuauaugggccagccccucaacaaugacgaggaucacgcccacuggaccgaagccaaaaugcugcuggacaacauuaauacgccugaggggaucauucccgcucucuucgaaccugagcgcgaaaagagcgccgcgaucgauggagaguaccggcuuagaggcgaggcccgcaaaaccuucguugaacugaugagaagaggggaccugccgguguggcucucuuauaaggucgcuuccgagggcuuucaauacagcgaucgcagauggugcuucgacggagaacggaacaaucaggugcuggaggaaaacauggaugucgagauuuggacaaaagagggcgaacgcaagaaacuuagaccccgguggcuggacgccagaaccuauuccgacccucucgcucugcgcgaguuuaaggaguucgccgcugggcggagaucugugagcggagaucugauccucgagaucggcaaacuuccccagcaucugacacagcgcgcccaaaaugcgcuggacaaccucguuaugcugcacaauuccgaacaagggggacgggccuacagacaugcuauggaggagcuuccugauaccauugaaacacugaugcuccuggcccugaucgcugugcucaccggcggcgugacgcucuuuuuccugucugggcggggacugggcaaaacaagcauugggcuccugugugucauggccuccagcguucuucuguggauggccucuguggagccccacuggaucgcugcguccauuauccucgaauuuuuccugauggugcugcucaucccggagccugaccgccagagaacaccccaggauaaccaacuugccuaugucgugauuggacugcuguuuaugauccucaccguugcugccaaugagaugggccugcuugaaacaaccaagaaagaccuggggauuggacacguggccgucgagaaccaucaccaugcuacaaugcucgauguggaccugcacccugccagcgcguggacgcuguacgccgucgcuaccacaaucauuacccccaugaugcggcauacaaucgaaaacaccacggccaauauuucucucaccgcuaucgccaaccaggcggccauccuuaugggccuggauaagggcuggccuauuuccaaaauggacaucggggugccccugcucgcucugggaugcuacagccagguuaauccgcuuacacugaccgccgcugugcucaugcuggucgcccacuaugcuauuaucggcccugggcugcaagccaaggcgacacgcgaggcccagaagagaaccgcugccggaauuaugaaaaaccccacgguggauggcaucguugcuaucgaccucgaucccguggucuacgacgccaaguucgaaaaacagcuugggcagauuaugcugcugauccucuguacaucucaaauucugcuuaugcggaccacaugggcccugugcgagagcaucacccucgcgaccggaccucugacaacgcugugggagggcuccccgggcaaguuuuggaauaccacaauugcugugucuauggccaacaucuuccgcgggagcuaucucgcuggagccggccuugccuuuucccugaugaaaagccucgggggaggcagacgggggaccggagcucagggcgaaacacucggcgagaaguggaagcgccagcugaaucagcuuuccaaaucugaguucaacaucuacaagagaagcgggauuauggagguggaccgguccgaagccaaagagggacugaagagaggcgagaccacgcgccacgcgguuucucgggggacagccaaacucagaugguucgucgaacgcaaucuggugaagcccgagggaaaggugaucgaucugggcugugggcggggaggcuggagcuauuacugcgcuggccucaaaaaggucaccgaaguuaaaggguauaccaagggaggcccugggcaugaggaacccauuccuauggccacauacggauggaaccuugugaaacugcacuccggcaaggacguguuuuucacacccccugagaaaugugauacccugcucugcgacaucggggagucuagcccgaaucccacgauugaagagggaagaacccugcgcguccuuaagaugguggaaccuuggcugcggggcaaccaauuuuguaucaagauucucaaucccuacaugccuuccguuguggagacacuggagcagaugcagagaaaacauggcgggaugcugguccgcaacccccucagcagaaauucuacccacgaaauguauuggguguccugcggaacaggcaacaucguuagcgcugugaauaugaccucuagaaugcugcuuaaccgcuucacgauggcccaccggaagccgaccuacgagagagaugucgaccugggggcgggaacacgccauguggccguggaaccugaggucgcuaaccucgauaucauuggccagagaaucgaaaauauuaaacacgagcauaaguccaccuggcacuaugacgaggauaaccccuacaaaacaugggccuaucaugggagcuacgaaguuaagcccucuggauccgcuagcuccauggugaauggcguggucaagcugcuuaccaaaccuugggacgugauccccaugguuacacaaauugccaugaccgauacgacaccuuuuggccagcagcggguguucaaggagaaagucgacacccgcaccccgaaggcuaaaagagggacagcccaaaucauggaagugacggcgcgguggcuguggggauuucucagcagaaacaagaagccccggaucuguacccgcgaggaguucacaagaaaaguucggucuaaugccgcuauuggcgccguguuugucgacgagaaccaguggaauagcgcuaaggaggccguggaagaugagcgcuucugggaccugguucagaaagaaagagagcugcacaagcaggggaaaugcgcgaccugcguguauaacaugaugggaaagcgggaaaagaaacucggcgaguuugggaaggcgaaaggcucccgcgcuaucugguacauguggcugggagccagauuccuugaguuugaagcccugggcuucaugaaugaggaucacugguucucucgggaaaacagccucuccggggucgagggagagggccugcauaaacuuggguacauucugcgcgacaucucuaaaauuccuggaggcaauauguaugcugaugacacagccgggugggauaccagaaucacagaagacgaucuccaaaacgaggcuaagaucaccgacauuauggaacccgagcacgcccugcuggcgacgagcaucuuuaaacucaccuaccagaauaaggugguccgggugcagcgcccugccaagaacggcacaguuauggaugugauuuccagacgggaccagcgcggaucuggccaagucgggaccuauggacugaauacauucaccaacauggaagcucagcuuaucagacagauggagagcgagggcauuuuucugcccuccgaacucgagacgccgaaccuggccgaacgggugcuugauuggcuggagaaauacgggguggaaagacucaagcgcauggcuaucagcggagacgacuguguugugaaaccuaucgaugaccgguucgccacagcgcugaccgcccugaaugauaugggcaaggucagaaaagacauuccccagugggagccuucuaagggguggaacgauuggcaacaggugcccuuuugcucccaucacuuccaccagcucaucaugaaggacggccgcgagauuguugugccuugucggaaucaggaugaacuggucggacgggcucgcgugagccaaggcgccggguggucucuucgggagacagcuugccugggaaaauccuaugcccagauguggcagcucauguacuuucauagacgcgaccugcggcuugcugccaacgcgaucuguagcgccguccccguggauuggguuccgaccuccagaacgaccuggucuauucacgcucaucaccaauggaugacaaccgaagacaugcugagcguguggaaucgcgucuggaucgaggaaaacccuuggauggaggauaagacacauguguccagcuggggcgacguucccuaucucgggaaacgggaggaccaguggugcggaucucugauuggccugaccgccagagccacaugggcuuccaauauccagguggccaucaaccagguccggagacucauugggaaugaaaacuaccuggauuacaugaccagcaugaagcgcuucaaaaaugagggcgaccccgaaggagcgcuuugguga

SEQ ID NO: 19088 - RNA, 9879 nt, Artificial Sequence
  derived and/or modified CDS sequence (opt5) from DENV-1__GQ199835__SS-prME
agcgugaccaugcugcucaugcugaugcccaccgcccuugcuuuccaccugacgacccggggcggggaaccucauaugaucgucacaaagcaggaacggggaaagucccuccuguuuaagaccucugccggcguuaacaugugcacacuuauugcgauggaccugggggagcucugugaagauaccaugacauacaagugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaagcagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguucacagugguugugggagaugucgugggcauucucgcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaagcugcgcgauuccuacacacagguuugcgaccaccggcuuaugagcgcggccauuaaagauucuaaggcugugcaugccgacaugggcuauuggaucgaauccgagaaaaaugaaaccuggaagcucgccagagcuagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgccggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuucaaaggggaggacggaugcugguacggcauggagauuagaccggugaaggaaaaggaggaaaaucuuguuaaaagcauggugucugcgggguccggagaggucgacagcuuuucccucggccugcuguguaucucuauuaugaucgaagaggugaugcggagcagauggucccgcaagaugcucaugacagggacccuggcuguuuuccuucugcucauuaugggacagcugacauggaacgaucugauccggcuuugcauuauggugggcgccaaugccucugacagaaugggcauggggaccaccuaucugacacucauggcuacguuuaaaaugcgcccuauguucgccgucggacugcuccugagacggcuuaccagccgcgaggugcugcuccugacaaucggccugucccuuguggcgucugucgaacugcccaacagccucgaggaacugggggauggacucgcuaugggcaucaugauucugaaacuucugaccgacuuucaaucccaccagcucugggccacacugcugagccuuaccuucaucaaaacgacacugucucuccauuacgccuggaagaccauggcuaugguucuguccauugugagccucuuuccccugugucuuucuaccacaucccagaagaccacauggcugccugugcugcucgggagccugggaugcaaaccgcuuacgauguuccugaucgccgagaauaagauuuggggcagaaaaucuuggccccucaacgaaggcaucauggcugucggggugguuuccauccugcucagcucccugcuuaagaacgaugugccucuggccggaccccugauugcgggcgggaugcucaucgccuguuaugucauuagcggaucuagcgcugaccugucccuugagaaagccgcugaggugucuugggaagaggaagccgagcacagcggcgccucccauaauauccugguugaagugcaggaugacgggaccaugaagauuaaagaugaggagcgggacgauacacucaccauccugcucaaggcuacacugcuugcggucucuggaguguacccucugagcauccccgccacccuguuugucugguauuucuggcaaaagaaaaagcagcgcuccggcgugcucugggacacgccuucucccccggaaguugagagagcugugcuggaugacggcauuuaccggaucaugcagcgcgggcuucugggaagaagccaggucggcguggggguuuuucaagaaaacguguuccacaccauguggcacgucacacggggagccgugcucauguaucagggcaaacgccuggagccuuccugggccagcgugaagaaagaccucauuucuuacgggggaggcuggagacugcagggcuccuggaauaccggggaggaaguucaggucaucgcuguggagcccggaaagaacccuaagaaugugcaaacagcccccggcaccuucaaaacaccggaaggggaggucggagcgauugcucuugauuuuaagccuggcacgagcgggucucccaucgugaaccgggaaggaaaaauuguuggccuguacggcaaugggguggucaccacauccggaaccuaugugagcgccaucgcccaggcuaaggccucccaggagggcccucugcccgagaucgaagacgagguuuucagaaaacgcaaccucaccauuauggaucugcaucccgggucuggaaagacacggagauaccuuccugcgaucgugcgcgaagcuauuaagcggaaacugagaacgcucauccuggccccgacccgcgucguggccagcgagauggcugaagcccugaagggcaugcccauucgguaucaaacaaccgcuguuaaauccgagcacacagggaaggagaucguggaccucaugugccaugccaccuuuacgaugagacuucugagcccuguccgcgugcccaauuacaacaugaucauuauggaugaagcgcacuucacagacccuucuuccaucgccgcucggggcuauauuagcaccagagugggaaugggcgaggccgcugccaucuuuaugaccgccacacccccugggucugucgaggcuuucccgcagagcaaugcgguuauucaggaugaggaacgggacauccccgagcgcuccuggaacucuggauacgaguggaucaccgauuuuccuggcaaaacagugugguucgugcccagcauuaaguccgggaaugacaucgccaacugucugagaaagaauggaaaacgggucauucagcucucucgcaagaccuuugauacggaauaucagaagaccaagaacaacgacugggacuacgugguuaccacagauaucagcgagaugggcgcuaauuucagagccgaccgggugauugauccuagacgcugccugaaacccgucauccuuaaggacgggccggaacgggugauucuggccggcccuaugcccguuaccguggcuuccgccgcgcagagacgcggacggaucggcagaaaccauaauaaggagggggaucaguacaucuauaugggacagccccucaacaaugacgaggaucacgcucacuggacggaagccaaaaugcugcuggacaacauuaauaccccugagggcaucauucccgcccucuuugaaccugagcgcgaaaagagcgcugccaucgauggggaguaccggcuuagaggagaggcgcgcaaaacauucgucgaacugaugagacggggcgaccugccgguguggcucucuuauaaggucgccuccgagggguuccaauacagcgaucgcagauggugcuuugacggcgaacggaacaaucaggugcuggaggaaaacauggauguugagauuuggaccaaagagggagaacgcaagaaacuuagaccccgguggcuggacgcuagaacauauuccgacccucucgcccugcgcgaguucaaggaauuugcugccggccggagaucugugagcggggaucugauccucgagaucggaaaacuuccccagcaucugacccagcgcgcucaaaaugcccuggacaaccucgugaugcugcacaauuccgaacagggcgggcgggcguacagacaugccauggaggagcuuccugauacaauugaaacccugaugcuccuggcucugaucgccguccucacgggaggcguuacacuuuucuuucugucuggccgggggcugggaaaaaccagcauuggccuccugugugugauggcuuccagcgugcuucuguggauggccucugucgagccccacuggaucgccgcuuccauuauccucgaguucuuucugauggugcugcucaucccggagccugaccgccagagaacaccccaggauaaccaacuugcguauguugugauugggcugcuguucaugauccucacagucgccgcuaaugagaugggacugcuugaaaccacaaagaaagaccugggcauugggcacguggccgucgagaaccaucaccaugccacgaugcucgauguggaccugcacccugcuagcgccuggacccuguacgcgguugccacaaccaucauuacacccaugaugcggcauaccaucgaaaacacgaccgcuaauauuucucucacagccaucgcuaaccaggccgcgauccuuaugggacuggauaagggcuggccuauuuccaaaauggacaucggcgugccccugcucgcccuggggugcuacagccaggucaauccgcuuacccugacagcugccgugcucaugcugguugcucacuaugccauuaucggaccuggccugcaagcuaaggccacccgcgaggcgcagaagagaacggccgcugggauuaugaaaaaccccacaguggauggaaucgucgccaucgaccucgaucccgugguguacgacgcuaaguuugaaaaacagcuuggccagauuaugcugcugauccucuguaccucucaaauucugcuuaugcggacaaccugggcccugugcgagagcaucacccucgccacagggccucugacgacccugugggagggauccccgggcaaguucuggaauacaaccauugcgguuucuauggcuaacaucuuucgcggcagcuaucucgccggggcuggacuugccuucucccugaugaaaagccugggcgggggaagacggggcacaggggcccagggagaaacccucggcgagaaguggaagcgccagcugaaucagcuuuccaaaucugaauuuaacaucuacaagagaagcggcauuauggaggucgaccgguccgaagcuaaagaggggcugaagagaggagagacgacacgccacgccgugucucggggcaccgcgaaacucagaugguucguggaacgcaaucuggucaagcccgaggggaagguuaucgaucugggauguggcagagggggauggagcuauuacugcgccggccucaaaaaggugaccgaagugaaaggcuauacaaaagggggaccuggccaugaggaacccauuccuauggcuaccuacggguggaaccuugucaaacugcacuccggaaaggacguguucuuuacacccccugagaaaugugauacgcugcucugcgacaucggcgagucuagcccgaaucccaccauugaagaggggagaacacugcgcguucuuaagaugguggaaccuuggcugcggggaaaccaauucuguaucaagauucucaaucccuacaugccuuccgucguggagacccuggagcagaugcagagaaaacauggcggcaugcugguucgcaacccccucagcagaaauucuacacacgaaauguauuggguguccugcgggaccggaaacaucgucagcgccgugaauaugacgucuagaaugcugcuuaaccgcuuuaccauggcucaccggaagccgacauacgagagagauguggaccugggcgccgggacccgccaugucgcgguugaaccugagguggccaaccucgauaucauuggacagagaaucgaaaauauuaaacacgagcauaaguccacauggcacuaugacgaggauaaccccuacaaaaccugggcuuaucauggcagcuacgaagugaagcccucuggguccgccagcuccauggucaauggagugguuaagcugcuuacaaaaccuugggacgugauccccauggucacccaaauugcuaugacggauacaaccccuuucggccagcagcggguguuuaaggagaaaguugacacccgcacaccgaaggccaaaagaggcacggcucaaaucauggaagugaccgcccgguggcuguggggguuccucagcagaaacaagaagccccggaucuguacacgcgaggaauuuaccagaaaaguccggucuaaugcggccauuggagcuguguucguugacgagaaccaguggaauagcgccaaggaggcuguggaagaugagcgcuuuugggaccugguccagaaagaaagagagcugcacaagcagggcaaaugcgccacaugcguguauaacaugauggggaagcgggaaaagaaacucggagaguucggcaaggccaaagggucccgcgcgaucugguacauguggcugggcgcuagauuucuugaguucgaagcccugggauuuaugaaugaggaucacugguucucucgggaaaacagccucuccggcgucgagggggagggacugcauaaacuuggcuacauucugcgcgacaucucuaaaauuccugggggaaauauguaugccgaugacaccgcuggcugggauacaagaaucaccgaagacgaucuccaaaacgaggccaagaucacggacauuauggaacccgagcacgcucugcuggccaccagcaucuucaaacucacauaccagaauaaggugguucgggugcagcgcccugcgaagaacgggaccgucauggaugugauuuccagacgggaccagcgcggcucuggacaagugggcacauaugggcugaauaccuuuacgaacauggaagcccagcuuaucagacagauggagagcgagggaauuuuccugcccuccgaacucgagacaccgaaccuggcugaacggguucuugauuggcuggagaaauacggcguggaaagacucaagcgcauggccaucagcggggacgacugugucgugaaaccuaucgaugaccgguuugcuaccgcccugacagcgcugaaugauaugggaaagguuagaaaagacauuccccagugggagccuucuaagggcuggaacgauuggcaacaggugcccuucugcucccaucacuuucaccagcucaucaugaaggacgggcgcgagauugucgugccuugucggaaucaggaugaacuggucggcagagcccgcgugagccaaggagcuggcuggucucuucgggagaccgccugccuggggaaauccuaugcucagauguggcagcucauguacuuccauagacgcgaccugcggcuugccgcuaacgccaucuguagcgcgguucccguggauugggucccgacguccagaaccacauggucuauucacgcccaucaccaauggaugaccacagaagacaugcugagcguguggaaucgcguuuggaucgaggaaaacccuuggauggaggauaagacccauguguccagcuggggagacguccccuaucucggcaaacgggaggaccaguggugcgggucucugauuggacugacagcuagagccaccugggccuccaauauccagguggcuaucaaccaggugcggagacucauuggcaaugaaaacuaccuggauuacaugacgagcaugaagcgcuuuaaaaaugagggggaccccgaaggcgcccuuugguga

SEQ ID NO: 19089 - RNA, 9879 nt, Artificial Sequence
  derived and/or modified CDS sequence (opt5) from DENV-1__FJ898386__SS-prME
agcgugaccaugcugcucaugcugaugcccaccgcccuugcuuuccaccugacgacccggggcggggaaccucauaugaucgucaccaagcaggaacggggaaaaucccuccuguuuaagaccucugccggcguuaacaugugcacccuuauugccauggaccugggggaacucugugaagauaccaugacauacaaaugcccccgcaucaccgaggcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguucacagugguugugggagaugucgugggcauucucgcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaagcugcgcgauuccuacacacagguuugcgaccaccggcuuaugagcgcggccauuaaagauucuaaggcugugcaugccgacaugggcuauuggaucgaauccgagaaaaaugaaaccuggaagcucgccagagcuagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgccggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuucaaaggggaggacggaugcugguacggcauggagauuagaccggugaaggaaaaggaggaaaaucuuguuaaaagcauggugucugcgggguccggagaggucgacagcuuuucccucggccugcuguguaucucuauuaugaucgaagaggugaugcggagcagauggucccgcaagaugcucaugacagggacccuggcuguuuuccuucugcucauuaugggacagcugacauggaacgaucugauccggcuuugcauuauggugggcgccaaugccucugacagaaugggcauggggaccaccuaucuggcucucauggccacauuuaaaaugcgcccuauguucgcggucggacugcucuuuagacggcugacgagccgcgaggugcuucugcucaccaucggccugucccugguggcuucugucgaacuucccaacagccuggaggaacucggggauggacuggccaugggcaucaugauucucaagcugcuuacagacuuccaaucccaccagcugugggccacccuccugagccugacauuuaucaaaaccacgcuuucucugcauuacgcuuggaagacaauggccaugguucucuccauugugagccuguucccccucugucugucuaccaccucccagaagacaaccuggcuuccugugcugcuggggagccucggaugcaaaccgcugacaauguuucuuaucgcugagaauaagauuuggggcagaaaaucuuggccccugaacgaaggcaucauggccgucggggugguuuccauccuccugagcucccuccugaagaacgaugugccucuugcgggaccccugauugccggcgggaugcugaucgcuuguuaugucauuagcggaucuagcgccgaccucucccuggagaaagcugccgaggugucuugggaagaggaagccgagcacagcggcgcuucccauaauauccuuguugaagugcaggaugacgggacgaugaagauuaaagaugaggagcgggacgauacccugacaauccuccugaaggcgacccuccuggccgucucuggaguguacccucuuagcauccccgcuacacuguucgucugguauuuuuggcaaaagaaaaagcagcgcuccggcgugcugugggacaccccuucucccccggaaguugagagagccgugcucgaugacggcauuuaccggaucaugcagcgcgggcugcuuggaagaagccaggucggcguggggguuuuccaagaaaacguguuccacacgauguggcacgucacccggggagccgugcugauguaucagggcaaacgccucgagccuuccugggcuagcgugaagaaagaccugauuucuuacgggggaggcuggagacuccagggcuccuggaauacaggggaggaaguucaggucaucgccguggagcccggaaagaacccuaagaaugugcaaaccgcgcccggcacauuuaaaaccccggaaggggaggucggagcuauugcccuggauuucaagccuggcacaagcgggucucccaucgugaaccgggaaggaaaaauuguuggccuuuacggcaaugggguggucacgaccuccggaacauaugugagcgccaucgcucaggccaaggcgucccaggagggcccucugcccgagaucgaagacgagguuuuuagaaaacgcaaccugaccauuauggaucuccaucccgggucuggaaagacccggagauaccugccugcuaucgugcgcgaagccauuaagcggaaacuuagaacacugauccucgccccgacgcgcgucguggcuagcgagauggccgaagcucugaagggcaugcccauucgguaucaaaccacagccguuaaauccgagcacaccgggaaggagaucguggaccugaugugccaugcgacauucaccaugagacuccuuagcccuguccgcgugcccaauuacaacaugaucauuauggaugaagcccacuuuacggacccuucuuccaucgcugcccggggcuauauuagcacaagagugggaaugggcgaggcugccgccaucuucaugaccgcuacacccccugggucugucgaagcguuuccgcagagcaaugccguuauucaggaugaggaacgggacauccccgagcgcuccuggaacucuggauacgaguggaucacagauuucccuggcaaaaccgugugguuugugcccagcauuaaguccgggaaugacaucgcuaacugucugagaaagaauggaaaacgggucauucagcugucucgcaagacauucgauaccgaauaucagaagacgaagaacaacgacugggacuacgugguuacaaccgauaucagcgagaugggcgccaauuuuagagccgaccgggugauugauccuagacgcugccucaaacccgucauccugaaggacgggccggaacgggugauucuugcuggcccuaugcccguuacaguggccuccgcggcucagagacgcggacggaucggcagaaaccauaauaaggagggggaucaguacaucuauaugggacagccccugaacaaugacgaggaucacgcccacuggaccgaagccaaaaugcuccuggacaacauuaauacgccugagggcaucauucccgcucuguucgaaccugagcgcgaaaagagcgccgcgaucgauggggaguaccggcucagaggagaggcccgcaaaaccuucgucgaacuuaugagacggggcgaccugccgguguggcugucuuauaaggucgcuuccgagggguuucaauacagcgaucgcagauggugcuucgacggcgaacggaacaaucaggugcucgaggaaaacauggauguugagauuuggacaaaagagggagaacgcaagaaacugagaccccgguggcuugacgccagaaccuauuccgacccucuggcucuccgcgaguuuaaggaguucgccgcuggccggagaucugugagcggggaucugauccuggagaucggaaagcucccccagcaucuuacacagcgcgcccaaaaugcgcuggacaaccuggugaugcuccacaauuccgaacagggcgggcgggccuacagacaugcuauggaggagcugccugauaccauugaaacacuuaugcugcucgcccugaucgcuguccugaccggaggcguuacgcucuuuuuccuuucuggccgggggcugggaaaaacaagcauuggccugcucugugugauggccuccagcgugcugcuuuggauggccucugucgagccccacuggaucgcugcguccauuauccuggaauuuuuccucauggugcugcugaucccggagccugaccgccagagaacaccccaggauaaccaacucgccuauguugugauugggcuucuguuuaugauccugaccgucgcugccaaugagaugggacuccuggaaacaaccaagaaagaccuuggcauugggcacguggccgucgagaaccaucaccaugcuacaaugcuggauguggaccuccacccugccagcgcguggacgcuguacgccguugcuaccacaaucauuacccccaugaugcggcauacaaucgaaaacaccacggccaauauuucucugaccgcuaucgccaaccaggcggccauccucaugggacuugauaagggcuggccuauuuccaaaauggacaucggcgugccccugcuggcucucgggugcuacagccaggucaauccgcugacacuuaccgccgcugugcugaugcucguugcccacuaugcuauuaucggaccuggccugcaagccaaggcgacacgcgaggcccagaagagaaccgcugccgggauuaugaaaaaccccacgguggauggaaucgucgcuaucgaccuggaucccgugguguacgacgccaaguucgaaaaacagcucggccagauuaugcuucugauccuguguacaucucaaauucuccugaugcggaccacaugggcccuuugcgagagcaucacccuggcgaccgggccucucacaacgcugugggagggauccccgggcaaguuuuggaauaccacaauugcuguuucuauggccaacaucuuccgcggcagcuaucuggcuggggccggacucgccuuuucccuuaugaaaagccugggcgggggaagacggggcaccggggcucagggagaaacacugggcgagaaguggaagcgccagcucaaucagcuguccaaaucugaguucaacaucuacaagagaagcggcauuauggaggucgaccgguccgaagccaaagaggggcuuaagagaggagagaccacgcgccacgcggugucucggggcacagccaaacugagaugguucguggaacgcaaucucgucaagcccgaggggaagguuaucgaucugggauguggcagagggggauggagcuauuacugcgcuggccugaaaaaggugaccgaagugaaaggcuauaccaaagggggaccuggccaugaggaacccauuccuauggccacauacggguggaaccucgucaaacuucacuccggaaaggacguguuuuucacacccccugagaaaugugauacacugcugugcgacaucggcgagucuagcccgaaucccacgauugaagaggggagaacccuccgcguucugaagaugguggaaccuuggcuucggggaaaccaauuuuguaucaagauucugaaucccuacaugccuuccgucguggagacacucgagcagaugcagagaaaacauggcggcaugcugguucgcaacccccugagcagaaauucuacccacgaaauguauuggguguccugcgggacaggaaacaucgucagcgcugugaauaugaccucuagaaugcuccugaaccgcuucacgauggcccaccggaagccgaccuacgagagagauguggaccuuggcgcggggacacgccaugucgccguugaaccugagguggcuaaccuggauaucauuggacagagaaucgaaaauauuaaacacgagcauaaguccaccuggcacuaugacgaggauaaccccuacaaaacaugggccuaucauggcagcuacgaagugaagcccucuggguccgcuagcuccauggucaauggagugguuaagcuccugaccaaaccuugggacgugauccccauggucacacaaauugccaugaccgauacgacaccuuuuggccagcagcggguguucaaggagaaaguugacacccgcaccccgaaggcuaaaagaggcacagcccaaaucauggaagugacggcgcgguggcuuuggggguuucugagcagaaacaagaagccccggaucuguacccgcgaggaguucacaagaaaaguccggucuaaugccgcuauuggagccguguuuguugacgagaaccaguggaauagcgcuaaggaggccguggaagaugagcgcuucugggaccucguccagaaagaaagagagcugcacaagcagggcaaaugcgcgaccugcguguauaacaugauggggaagcgggaaaagaaacugggagaguuuggcaaggcgaaagggucccgcgcuaucugguacauguggcucggcgccagauuccuggaguuugaagcccuuggauucaugaaugaggaucacugguucucucgggaaaacagccuguccggcgucgagggggagggacuccauaagcugggcuacauucuucgcgacaucucuaaaauuccugggggaaauauguaugcugaugacacagccggcugggauaccagaaucacagaagacgaucugcaaaacgaggcuaagaucaccgacauuauggaacccgagcacgcccuccuggcgacgagcaucuuuaaacugaccuaccagaauaaggugguucgggugcagcgcccugccaagaacgggacagucauggaugugauuuccagacgggaccagcgcggcucuggacaagugggcaccuaugggcucaauacauucaccaacauggaagcucagcugaucagacagauggagagcgagggaauuuuucuucccuccgaacuggagacgccgaaccucgccgaacggguucuggauuggcuugagaaauacggcguggaaagacugaagcgcauggcuaucagcggggacgacugugucgugaaaccuaucgaugaccgguucgccacagcgcucaccgcccugaaugauaugggaaagguuagaaaagacauuccccagugggagccuucuaagggcuggaacgauuggcaacaggugcccuuuugcucccaucacuuccaccagcugaucaugaaggacgggcgcgagauugucgugccuugucggaaucaggaugaacucgucggcagagcucgcgugagccaaggagccggcuggucucugcgggagacagcuugccuugggaaauccuaugcccagauguggcagcugauguacuuucauagacgcgaccuccggcuggcugccaacgcgaucuguagcgccguucccguggauugggucccgaccuccagaacgaccuggucuauucacgcucaucaccaauggaugacaaccgaagacaugcuuagcguguggaaucgcguuuggaucgaggaaaacccuuggauggaggauaagacacauguguccagcugggaggacguccccuaucugggaaaacgggaagaccaguggugcggcucucucauugggcugaccgccagagccacaugggcuuccaauauccagguggccaucaaccaggugcggagacugauuggaaaugagaacuaccucgauuacaugaccagcaugaagcgcuucaaaaaugaaggcgaccccgagggggcguuuugguga

SEQ ID NO: 19090 - RNA, 9879 nt, Artificial Sequence
  derived and/or modified CDS sequence (opt5) from DENV-1__FJ898387__SS-prME
agcgugaccaugcugcucaugcugaugcccaccgcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucucucacauuuauuaagaccacguucucccugcacuaugccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuacgugauuucuggaagcuccgcugaccuuucucuggagaaggccgccgaggucagcugggaagaggaagcugagcauuccggcgcgucucacaauauccugguggaaguucaggaugacgggacgaugaaaauuaaggaugaggagcgggacgauacccucacaauccugcuuaaggccacccugcucgcugugagcggagucuauccucuguccauccccgccacacucuucgugugguacuuuuggcagaaaaagaaacaacgcucuggcguccugugggacaccccuuccccucccgaaguggagagagccguucuugaugacggcauuuaucggaucaugcagcgcgggcugcugggaagaucccaggugggcgucgggguguuccaggaaaacguuuuucauacgauguggcacgugacccggggagcuguccucauguaccaaggcaagcgccuggagcccagcugggccucugugaaaaaggaccuuauuuccuacgggggaggcuggagacugcagggcagcuggaauacaggggaggaagugcagguuaucgcggucgagcccggaaagaacccuaaaaaugugcagaccgcucccggcacauucaagaccucugaaggggaggugggagccauugcccucgauuuuaaaccgggcacauccgggagcccuaucgucaaccgggaaggaaagauugugggccuguauggcaaugggguugugacgaccuccggaacauacgucucugcuaucgcccaagcgaaagcuagccaggagggcccccucccugagaucgaagacgagguguucagaaagcgcaaccugaccauuauggaucuucaccccggguccggaaagacccggagauaucugcccgccaucguucgcgaagccauuaaacggaagcugagaacacucauccuggcuccuacgcgcguggucgccagcgagauggcugaagcccuuaaaggcaugccgauucgguaccagaccacagcggugaagucugagcauaccgggaaagagaucguugaccugaugugccacgccacauuuaccaugagacuccugucccccgugcgcgucccuaauuauaacaugaucauuauggaugaagcucauuucacggaccccagcucuaucgccgcucggggcuacauuagcacaagagugggaaugggcgaggccgccgcuaucuuuaugaccgcgaccccucccggguccguggaagccuucccucaaucuaaugcugucauucaggaugaggaacgggacaucccggagcgcagcuggaacuccggauaugaguggaucacagauuuucccggcaagaccguuugguucgugccuucuauuaagagcgggaaugacaucgccaacugucugcgcaagaauggaaagcgggugauucagcucucccgcaaaacauucgauaccgaauaccagaagacgaaaaacaacgacugggacuacgucgugacaaccgauaucagcgagaugggcgccaauuuuagagcugaccggguuauugaucccagacgcugccuuaagccugugauccugaaggacgggcccgaacgggucauucuggccggcccgaugccugugacaguugcgucugcugcccaaagacgcggacggaucggcagaaaccacaauaaagagggggaucaguauaucuacaugggacagccccucaacaaugacgaggaucaugcccacuggaccgaagcuaagaugcugcuugacaacauuaauacgcccgagggcaucauuccugcccuguucgaacccgagcgcgaaaaauccgcggccaucgauggggaguaucggcucagaggagaggcucgcaagaccuuuguggaacugaugagacggggcgaccugccugucuggcucagcuacaaaguggccuccgagggguuccaguauucugaucgcagauggugcuuugacggcgaacggaacaaucaaguccuugaggaaaacauggauguggagauuuggacaaaggagggagaacgcaaaaagcugagaccgcgguggcuggacgcuagaaccuacagcgacccccucgcccugcgcgaguucaaggaauuugcugccggccggagauccguuucuggggaucuuauccuggagaucggaaaacucccucagcaccugacacagcgcgcgcagaaugcccuggacaaccucgugaugcuucauaauagcgaacaaggcgggcgggcuuauagacacgccauggaggagcugcccgauaccauugaaacacugaugcuccuggcucuuaucgccgugcugaccggaggcgucacgcuguucuuucuguccggccgggggcugggaaagacaagcauuggccuccuuuguguuauggccucuuccgugcugcuguggauggcuagcguggagccucauuggaucgcggccucuauuauccucgaguucuuucugaugguccuucugauccccgagccggaccgccagagaaccccucaggauaaccagcucgcuuacgugguuauugggcugcuguucaugauccucaccguggccgccaaugagaugggacuucuggaaacaaccaaaaaggaccugggcauugggcacgucgcuguggagaaccaccaucacgccgcgaugcucgaugucgaccugcaucccgccuccgcuuggacacuuuacgccguggcuacgaccaucauuacaccuaugaugcggcacaccaucgaaaacacaaccgccaauauuagccugacggcgaucgccaaccaagcugccauccucaugggacuggauaaaggcuggcccauuucuaagauggacaucggcguuccucugcucgcucuugggugcuauagccaggugaauccccugacccugacagccgcuguccucaugcugguggcccauuacgcgauuaucggaccgggccuucaggccaaggcuacccgcgaggcccagaagagaacagcugccgggauuaugaagaacccuaccguugauggaaucguggccaucgaccuggaucccgucguguaugacacgaaauuugaaaagcagcucggccagauuaugcugcugauccucuguacaucccagauucuucugaugcggaccacaugggcgcugugcgagucuaucacccucgcuaccgggccccugacaacgcuuugggagggaagcccuggcaaauucuggaauaccacaauugccguguccauggcuaacaucuuccgcggcagcuaccuggccggggccggacucgcuuuuucccugaugaagucucugggcgggggaagacggggcaccggggcccaaggagaaacacucggcgagaaguggaaacgccagcuuaaucagcugagcaaguccgaguucaacaccuauaaaagaucuggcaucauggagguugaccggagcgaagcgaaggaggggcugaaaagaggagagacgacaaagcacgccgucucccgcggcaccgcuaagcuccggugguuuguggaaagaaaucuggugaaaccggaggggaaggucauugaucuuggauguggccgcgggggauggucuuacuauugcgccggccugaaaaagguuaccgaagugaaaggcuacacaaaagggggacccggccacgaggaaccuauccccauggcuaccuacggguggaaccucgugaaacugcauagcggaaaggacgucuucuuuauuccucccgagaagugugauacacugcucugcgacaucggcgaguccagcccuaauccgacgauugaagaggggcggacccuuagagugcugaaaaugguugaacccuggcugcgcggaaaccaguucuguaucaagauucucaauccuuauaugcccucuguggucgagacacuggagcaaaugcagcggaaacacggcggcaugcuugugagaaacccucugucccgcaauagcacccaugaaauguacuggguuucuugcgggacaggaaacaucguguccgccgucaauaugaccagccggaugcuccugaacagauuuacgauggcgcaccgcaagcccaccuaugagcgggauguggaccugggcgccgggacaagacacguggcugucgaaccggagguugccaaccucgauaucauuggacagcgcaucgaaaauauuaaacaugagcacaagucuaccuggcauuacgacgaggauaacccuuauaagacaugggcuuaccacggcuccuaugaagugaaacccagcggguccgccagcucuauggugaauggagucgugaagcugcuuaccaaacccugggacguuaucccuauggugacacagauugcuaugaccgauacgacacccuucggccaacagagagucuuuaaggagaaaguggacacccggaccccuaaggccaagcgcggcacagcgcagaucauggaaguuacggccaaauggcuguggggguuccucagcagaaacaagaaaccgcggaucuguaccagagaggaauuuacacggaaggugcgcuccaaugcugccauuggagcugucuucguggacgagaaccaauggaacucugccaaagaggccguugaagaugagagauuuugggaccuggugcaucgggaacgcgagcuucacaagcagggcaagugcgcgaccugcgucuacaacaugauggggaaaagagaaaagaaacugggagaguucggcaaggcuaaagggagccgggccaucugguacauguggcucggcgcccgcuuccuggaguuugaagcucugggauucaugaaugaggaucacugguuuuccagagaaaacucucucagcggcguggagggggagggacugcauaaacuuggcuauauucugcgggacaucuccaaaauucccgggggaaauauguacgccgaugacacagcuggcugggauacccgcaucacagaagacgaucuccagaacgaggccaagaucaccgacauuauggaaccugagcacgcgcugcuugccaagucuaucuucaaacugacguaucagaauaaggucgugagaguucaacggcccgcuaaaaacgggaccgugauggaugucauuagccgcagagaccagcggggcuccggacaggugggcacauacgggcucaauaccuuuacaaacauggaagcccagcugauccgccaaauggagagcgagggaauuuucucuccuuccgaacuggagacccccaaccucgcuggcagagugcuggauuggcuugaaaagcaugggguugagcggcugaaaagaauggccaucagcggagacgacuguguggucaagccgaucgaugaccgcuuugcgacggcccucacagcucugaaugauaugggcaaggugcggaaagacauuccucagugggaacccucuaagggguggaacgauuggcagcagguuccuuucugcucccaccacuuucaucaacuuaucaugaaagacggcagagagauugugguccccugucgcaaucaggaugagcuggugggacgggccagagucagccagggcgcuggguggucccuccgcgaaaccgccugccugggaaagucuuaugcucagauguggcaacugauguacuuccaccggagagaccuccgccuggccgcgaacgccaucuguagcgcugugccuguugauugggugcccacaucccggaccacguggagcauucaugcccaccaucaguggaugaccacagaggacaugcuuucugucuggaauagaguguggaucgaagagaacccguggauggaagauaaaacccacauuuccagcuggggcgacguuccuuaucuggggaagcgcgaggaccaguggugcggaucucucaucggccugacagcccgggcuaccugggccacaaauauccaaguggcgauuaaccaggucagacggcuuaucgggaaugagaacuaccuggauuacaugaccagcaugaagagauuuaaaaaugaauccgaccccgagggcgcucucugguga

SEQ ID NO: 19091 - RNA, 9879 nt, Artificial Sequence
  derived and/or modified CDS sequence (opt5) from DENV-1__FJ898389__SS-prME
agcgugaccaugcugcucaugcugaugcccaccgcccuugcuuuccaccugacgaccagaggcggggaaccucauaugaucgucacaaagcaggaacggggaaagucccuccuguuuaagaccucugccggcguuaauaugugcacccuuauugcgauggaccugggggagcucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguucacagugguugugggagaugucgugggcauucucgcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaagcugcgcgauuccuacacacagguuugcgaccaccggcuuaugagcgcggccauuaaagauucuaaggcugugcaugccgacaugggcuauuggaucgaauccgagaaaaaugaaaccuggaagcucgccagagcuagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgccggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuucaaaggggaggacggaugcugguacggcauggagauuagaccggugaaggaaaaggaggaaaaucuuguuaaaagcauggugucugcgggguccggagaggucgacagcuuuucccucggccugcuguguaucucuauuaugaucgaagaggugaugcggagcagauggucccgcaagaugcucaugacagggacccuggcuguuuuccuuuuucugauuaugggacagcucacauggaacgaucugauccggcugugcauuauggugggcgccaaugccucugacagaaugggcauggggaccaccuaucuugcucugauggccacauucaaaaugcgcccuauguuugcggucggacuccuguucagacggcucacgagccgcgaggugcugcuucugaccaucggccucucccugguggcuucugucgaacugcccaacagccuugaggaacugggggauggacucgccaugggcaucaugauucugaagcuccugacagacuuucaaucccaccagcuuugggccacccugcucagccugacauucaucaaaaccacgcugucucuucauuacgcuuggaagacaauggccaugguucuguccauugugagccucuuuccccugugucucucuaccaccucccagaagacaaccuggcugccugugcuucuggggagcuucggaugcaaaccgcuggcuauguuucucaucgccgagaauaagauuuggggcagaaaaucuuggccccugaacgaaggcaucauggcggucggggugguuuccauccuucugagcucccuccugaagaacgaugugccucucgccggaccccugauugcuggcgggaugcuuaucgccuguuaugucauuagcggaucuagcgcugaccugucccuggagaaagccgccgaggugucuugggaagaggaagcugagcacagcggcgcgucccauaauauccucguugaagugcaggaugacgggacaaugaagauuaaagaugaggagcgggacgauacgcugaccauccuucugaaggccacacuccuggcugucucuggaguguacccucucagcauccccgccacccuguucgucugguauuucuggcaaaagaaaaagcagcgcuccggcgugcuuugggacacaccuucucccccggaaguugagagagccgugcuggaugacggcauuuaccggaucaugcagcgcgggcugcucggaagaagccaggucggcguggggguuuuucaagaaaacguguuccacaccauguggcacgucacgcggggagcugugcugauguaucagggcaaacgccuugagccuuccugggccagcgugaagaaagaccugauuucuuacgggggaggcuggagacuccagggcuccuggaauaccggggaggaaguucaggucaucgcgguggagcccggaaagaacccuaagaaugugcaaacagcucccggcaccuuuaaaacaccggaaggggaggucggagccauugcccuggauuucaagccuggcaccagcgggucucccaucgugaaccgggaaggaaaaauuguuggccucuacggcaaugggguggucacaacguccggaaccuaugugagcgcuaucgcccaggcgaaggcuucccaggagggcccucugcccgagaucgaagacgagguuuuuagaaaacgcaaccuuacaauuauggaucugcaucccgggucuggaaagacccggagauaccugccugccaucgugcgcgaagccauuaagcggaaacucagaacccugauccuugcuccgacacgcgucguggccagcgagauggcugaagcccugaagggcaugcccauucgguaucaaacgaccgcgguuaaauccgagcacacagggaaggagaucguggaccucaugugccaugccaccuucacaaugagacugcugagcccuguccgcgugcccaauuacaacaugaucauuauggaugaagcucacuuuaccgacccuuucucuaucgccgcucggggcuauauuuccacgagagugggaaugggcgaggccgccgcuaucuuuaugacagcgacacccccugggagcgucgaagccuucccgcagucuaaugcuguuauucaggaugaggaacgggacauccccgagcgcagcuggaacuccggauacgaguggaucaccgauuuuccuggcaaaacagugugguucgugcccucuauuaagagcgggaaugacaucgccaacugucucagaaagaauggaaaacgggucauucagcuuucccgcaagaccuucgauacagaauaucagaagaccaagaacaacgacugggacuacgugguuacgacagauaucucugagaugggcgccaauuuuagagcugaccgggugauugauccuagacgcugccugaaacccgucauccugaaggacgggccggaacgggugauucucgccggcccuaugcccguuaccguggcgagcgcugcccagagacgcggacggaucggcagaaaccauaauaaggagggggaucaguacaucuauaugggacagccccugaacaaugacgaggaucacgcccacuggacagaagcuaaaaugcuucuggacaacauuaauaccccugagggcaucauucccgcccucuucgaaccugagcgcgaaaaguccgcggccaucgauggggaguaccggcugagaggagaggcucgcaaaacguuugucgaacugaugagacggggcgaccucccgguguggcuuagcuauaaggucgccucugagggguuccaauacuccgaucgcagauggugcuuugacggcgaacggaacaaucaggugcuggaggaaaacauggauguugagauuuggaccaaagagggagaacgcaagaaacugagaccccgguggcucgacgcuagaacauauagcgacccucuggcccuucgcgaguucaaggaauuugcugccggccggagauccgugucuggggaucugauccucgagaucggaaagcugccccagcaucugacccagcgcgcgcaaaaugcccucgacaaccuugugaugcugcacaauagcgaacagggcgggcgggcuuacagacaugccauggaggagcugccugauacaauugaaacccucaugcugcuugcucugaucgccguccucacaggaggcguuacccuguucuuucuguccggccgggggcucggaaaaacgucuauuggccuucugugugugauggccagcuccgugcugcucuggauggcuagcgucgagccccacuggaucgcggccucuauuauccuggaguucuuucuuauggugcugcucaucccggagccugaccgccagagaacaccccaggauaaccaacuggcuuauguugugauugggcuccuguucaugauccuuaccgucgccgccaaugagaugggacugcuggaaaccacaaagaaagaccucggcauugggcacguggcugucgagaaccaucaccaugccaccaugcuggauguggaccuucacccugcguccgccuggacacuguacgcuguugccacgaccaucauuacacccaugaugcggcauaccaucgaaaacacaaccgcuaauauuagccucacggccaucgcgaaccaggccgcuauccugaugggacuggauaagggcuggccuauuucuaaaauggacaucggcgugccccuccuugcccuggggugcuacucccaggucaauccgcugacccucacagcugccgugcugaugcuuguugcucacuaugccauuaucggaccuggccugcaagcgaaggccacccgcgaggcucagaagagaacagccgcugggauuaugaaaaaccccaccguggauggaaucgucgccaucgaccucgaucccgugguguacgacgccaaguuugaaaaacagcugggccagauuaugcugcucauccuuuguacgagccaaauucugcugaugcggacaaccugggcgcucugcgagucuaucacacuggcuaccgggccucuuaccacacugugggagggaagcccgggcaaguucuggaauacgaccauugccguuuccauggcuaacaucuuccgcggcucuuaucucgccggggccggacuggcuuuuagccugaugaaaucccucggcgggggaagacggggcacaggggcccagggagaaacccuuggcgagaaguggaagcgccagcugaaucagcugagcaaauccgaguucaacaucuacaagagaucuggcauuauggaggucgaccggagcgaagcgaaagaggggcucaagagaggagagacaacccgccacgccgugucccggggcacggcuaaacugagaugguuuguggaacgcaaucuugucaagcccgaggggaagguuaucgaucugggauguggcagagggggauggucuuauuacugcgccggccucaaaaaggugacagaagugaaaggcuauaccaaagggggaccuggccaugaggaacccauuccuauggcuaccuacggguggaaccuggucaaacugcacagcggaaaggacguguucuuuacacccccugagaaaugugauacccuccuuugcgacaucggcgaguccucuccgaaucccacaauugaagaggggagaacgcugcgcguucugaagaugguggaaccuuggcuccggggaaaccaauucuguaucaagauucugaaucccuacaugccuagcgucguggagacccuugagcagaugcagagaaaacauggcggcaugcugguucgcaacccccucucccggaauagcacacacgaaauguauugggugucuugcgggaccggaaacaucgucuccgccgugaauaugacaagcagaaugcugcugaaccgcuuuaccauggcgcaccggaagccgacguacgagagagauguggaccucggcgccgggacccgccaugucgcuguugaaccugagguggccaaccuggauaucauuggacagagaaucgaaaauauuaaacacgagcauaagucuacauggcacuaugacgaggauaaccccuacaaaaccugggcuuaucauggcuccuacgaagugaagcccagcgggucugccuccagcauggucaauggagugguuaaacuucugacaaaaccuugggacgugauccccauggucacccaaauugcuaugacagauaccacgccuuucggccagcagcggguguuuaaggagaaaguugacacacgcaccccgaaggccaaaagaggcaccgcgcaaaucauggaagugacagcccgguggcucuggggguuccuguccagaaacaagaagccccggaucuguacgcgcgaggaauuuaccagaaaaguccggagcaaugcugccauuggagcuguguucguugacgagaaccaguggaacucugccaaggaggccguggaagaugagcgcuuuugggaccuuguccagaaagaaagagagcugcacaagcagggcaaaugcgcgacaugcguguauaacaugauggggaagcgggaaaagaaacucggagaguucggcaaggcuaaagggagccgcgccaucugguacauguggcugggcgccagauuccuggaguuugaagcucucggauucaugaaugaggaucacugguuuucccgggaaaacucucugagcggcgucgagggggagggacuucauaagcugggcuacauucuccgcgacaucuccaaaauuccugggggaaauauguaugccgaugacaccgcuggcugggauacaagaaucaccgaagacgaucugcaaaacgaggccaagaucacagacauuauggaacccgagcacgcgcuucuggccaccucuaucuucaaacucacguaccagaauaaggugguucgggugcagcgcccugcuaagaacgggaccgucauggaugugauuagcagacgggaccagcgcggcuccggacaagugggcacauaugggcugaauaccuuuacaaacauggaagcccagcugaucagacagauggagucugagggaauuuuccuccccagcgaacuggagaccccgaaccuugcugaacggguucuggauuggcucgagaaauacggcguggaaagacugaagcgcauggccaucuccggggacgacugugucgugaaaccuaucgaugaccgguuugcgacggcccuuacagcucugaaugauaugggaaagguuagaaaagacauuccccagugggagccuagcaagggcuggaacgauuggcaacaggugcccuucugcucucaucacuuucaccagcucaucaugaaggacgggcgcgagauugucgugccuugucggaaucaggaugaacuggucggcagagcccgcgugucccaaggagcuggcuggagccugcgggagaccgccugccucgggaaaucuuaugcucagauguggcagcugauguacuuccauagacgcgaccuucggcuggccgcgaacgccaucuguuccgcuguucccguggauugggucccgacaagcagaaccacgugguccauucacgcccaucaccaauggaugaccacagaagacaugcucucuguguggaaucgcguuuggaucgaggaaaacccuuggauggaggauaagacccaugugagcuccuggggagacguccccuaucugggcaaacgggaggaccaguggugcgggagccuuauuggacugacagccagagcuaccugggccucuaauauccagguggcgaucaaccaggugcggagacucauuggcaaugaaaacuaccuggauuacaugacauccaugaagcgcuuuaaaaaugagggggaccccgaaggcgcucugugguga

SEQ ID NO: 19092 - RNA, 9879 nt, Artificial Sequence
  derived and/or modified CDS sequence (opt5) from DENV-1__FJ898390__SS-prME
agcgugaccaugcugcucaugcugaugcccaccgcccuugcuuuccaccugacgacccggggcggggaaccucauaugaucgucaccaagcaggaacggggaaaaucccuccuguuuaagaccucugccggcguuaacaugugcacccuuauugccauggaccugggggaacucugugaagauaccaugacauacaaaugcccccgcaucaccgaagcugaacccgacgauguggacuguuggugcaaugccacggauaccugggugaccuauggaaccuguagccaaacaggcgagcaccggcgggacaagcgcuccguugcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggugggagaaaaagcccuuaagcucucuugguucaagaaaggcagcuccauugggaagauguuugaggcuacagccagaggcgcucgccggauggccauccugggagauaccgcgugggacuucggcucuaucgggggaguuuuuacaagcgucggcaaacuggugcaucagauuuucgggaccgccuacggagugcucuuuuccggcgucagcuggacgaugaagaucgggauuggcgugcugcuuaccuggcugggacucaauucuagauccacaagccugucuaugaccuguaucgcuguuggccuggugacacuuuaccucggggucauggugcaggccgauuccggaugcguuauuaacuggaaaggccgcgaacugaagugugggagcggaaucuucgugaccaaugagguccacacauggaccgaacaauauaaguuucaggcugacuccccuaaacggcugucugccgcgauuggcaaggccugggaggagggggugugcggcaucagaagcgcuacgcgccucgaaaacaucauguggaaacagauuuccaacgagcugaaucauauccuucuggaaaacgacaugaaguucacaguuguggucggagauguggugggcauucucgcccaggggaaaaagaugauccggccgcaacccauggagcacaaauacucuuggaaaagcuggggaaaggcuaagauuaucggcgccgacguccagaauaccaccuuuaucauugaugggccuaacacacccgaauguccugacgaucagagagccuggaauaucugggagguugaggacuauggauucggcauuuuuaccacgaacaucuggcugaagcugcgcgauuccuacacacaggugugcgaccaccggcuuaugagcgcugcgauuaaagauucuaaggccgugcaugcugacaugggcuauuggaucgaauccgagaaaaaugaaaccuggaagcucgccagagccagcuucaucgaggucaagacauguauuuggcccaaaucucacacccugugguccaacggggugcuggaaagcgagaugaucauuccgaagaucuacggaggcccuauuucucaacauaauuaucgccccggguacuucacacagaccgcuggaccuuggcaccucggcaaacuggagcuugauuuugaccugugcgaagggacgaccguuguggucgaugagcacugcggaaaccggggccccagccucagaacaaccacagugaccggcaagaucauccaugaaugguguugccgguccuguacgcugccuccccugcgcuucaaaggggaggacggaugcugguacggcauggagauuagaccgguuaaggaaaaggaggaaaaucuugugaaaagcauggucucugccggguccggagagguggacagcuuuucccucggccugcuguguaucucuauuaugaucgaagagguuaugcggagcagauggucccgcaagaugcucaugacagggacccuggcgguguuccuucugcucauuaugggacagcugacauggaacgaucugauccggcuuugcauuauggucggcgcuaaugccucugacagaaugggcauggggaccaccuaucuggcccucauggcuacauuuaaaaugcgcccuauguucgccgugggacugcucuuuagacggcugacgagccgcgaggugcuucugcucaccaucggccugucccuggucgcgucuguugaacuucccaacagccuggaggaacucggggauggacuggcuaugggcaucaugauucucaagcugcuuacagacuuccaaucccaccagcugugggccacccuccugagccugacauuuaucaaaaccacgcuuucucugcauuacgccuggaagacaauggcuauggugcucuccauugugagccuguucccccucugucugucuaccaccucccagaagacaaccuggcuuccuguccugcuggggagccucggaugcaaaccgcugacaauguuucuuaucgccgagaauaagauuuggggcagaaaaucuuggccccugaacgaaggcaucauggcuguggggguuguguccauccuccugagcucccuccugaagaacgaugucccucuugccggaccccugauugcgggcgggaugcugaucgccuguuaugugauuagcggaucuagcgcugaccucucccuggagaaagccgcugagguuucuugggaagaggaagccgagcacagcggcgccucccauaauauccuuguggaaguccaggaugacgggacgaugaagauuaaagaugaggagcgggacgauacccugacaauccuccugaaggcuacccuccuggcggugucuggagucuacccucuuagcauccccgccacacuguucgugugguauuuuuggcaaaagaaaaagcagcgcuccggcguucugugggacaccccuucucccccggaaguggagagagcuguccucgaugacggcauuuaccggaucaugcagcgcgggcugcuuggaagaagccaggugggcguugggguguuccaagaaaacgucuuccacacgauguggcacgugacccggggagccgugcugauguaucagggcaaacgccucgagccuuccugggccagcguuaagaaagaccugauuucuuacgggggaggcuggagacuccagggcuccuggaauacaggggaggaaguccaggugaucgcuguggagcccggaaagaacccuaagaauguccaaaccgcccccggcacauuuaaaaccccggaaggggaggugggagcgauugcucuggauuucaagccuggcacaagcgggucucccaucguuaaccgggaaggaaaaauugugggccuuuacggcaauggggucgugacgaccuccggaacauauguuagcgccaucgcccaggcuaaggccucccaggagggcccucugcccgagaucgaagacgagguguuuagaaaacgcaaccugaccauuauggaucuccaucccgggucuggaaagacccggagauaccugccugcgaucguccgcgaagcuauuaagcggaaacuuagaacacugauccucgccccgacgcgcgugguugccagcgagauggcugaagcccugaagggcaugcccauucgguaucaaaccacagcugugaaauccgagcacaccgggaaggagaucgucgaccugaugugccaugccacauucaccaugagacuccuuagcccugugcgcgugcccaauuacaacaugaucauuauggaugaagcgcacuuuacggacccuucuuccaucgccgcucggggcuauauuagcacaagagucggaaugggcgaggccgcugccaucuucaugaccgccacacccccugggucuguugaggcuuuuccgcagagcaaugcggugauucaggaugaggaacgggacauccccgagcgcuccuggaacucuggauacgaguggaucacagauuucccuggcaaaaccgugugguuuguccccagcauuaaguccgggaaugacaucgccaacugucugagaaagaauggaaaacgggugauucagcugucucgcaagacauucgauaccgaauaucagaagacgaagaacaacgacugggacuacguugugacaaccgauaucagcgagaugggcgcuaauuuuagagccgaccgggucauugauccuagacgcugccucaaacccgugauccugaaggacgggccggaacggguuauucuugccggcccuaugcccgugacagucgcuuccgccgcgcagagacgcggacggaucggcagaaaccauaauaaggagggggaucaguacaucuauaugggacagccccugaacaaugacgaggaucacgcucacuggaccgaagccaaaaugcuccuggacaacauuaauacgccugagggcaucauucccgcccuguucgaaccugagcgcgaaaagagcgcugccaucgauggggaguaccggcucagaggagaggcgcgcaaaaccuucguggaacuuaugagacggggcgaccugccggucuggcugucuuauaagguggccuccgagggguuucaauacagcgaucgcagauggugcuucgacggcgaacggaacaaucagguucucgaggaaaacauggauguggagauuuggacaaaagagggagaacgcaagaaacugagaccccgguggcuugacgcuagaaccuauuccgacccucuggcccuccgcgaguuuaaggaguucgcugccggccggagaucugugagcggggaucugauccuggagaucggaaagcucccccagcaucuuacacagcgcgcucaaaaugcccuggacaaccuggucaugcuccacaauuccgaacagggcgggcgggcguacagacaugccauggaggagcugccugauaccauugaaacacuuaugcugcucgcucugaucgccguucugaccggaggcgugacgcucuuuuuccuuucuggccgggggcugggaaaaacaagcauuggccugcucugugugauggcuuccagcguccugcuuuggauggccucuguggagccccacuggaucgccgcuuccauuauccuggaauuuuuccucaugguucugcugaucccggagccugaccgccagagaacaccccaggauaaccaacucgcguauguggucauugggcuucuguuuaugauccugaccguggccgcuaaugagaugggacuccuggaaacaaccaagaaagaccuuggcauugggcacgucgccguggagaaccaucaccaugccacaaugcuggauguugaccuccacccugcuagcgccuggacgcuguacgcgguggccaccacaaucauuacccccaugaugcggcauacaaucgaaaacaccacggcuaauauuucucugaccgccaucgcuaaccaggccgcgauccucaugggacuugauaagggcuggccuauuuccaaaauggacaucggcgucccccugcuggcccucgggugcuacagccaggugaauccgcugacacuuaccgcugccguucugaugcucguggcucacuaugccauuaucggaccuggccugcaagcuaaggccacacgcgaggcgcagaagagaaccgccgcugggauuaugaaaaaccccacggucgauggaaucguggccaucgaccuggaucccgugguuuacgacgcuaaguucgaaaaacagcucggccagauuaugcuucugauccuguguacaucucaaauucuccugaugcggaccacaugggcccuuugcgagagcaucacccuggccaccgggccucucacaacgcugugggagggauccccgggcaaguuuuggaauaccacaauugcggucucuauggcuaacaucuuccgcggcagcuaucuggccggggcuggacucgccuuuucccuuaugaaaagccugggcgggggaagacggggcaccggggcccagggagaaacacugggcgagaaguggaagcgccagcucaaucagcuguccaaaucugaguucaacaucuacaagagaagcggcauuauggagguggaccgguccgaagcuaaagaggggcuuaagagaggagagaccacgcgccacgccgugucucggggcacagcgaaacugagaugguucgucgaacgcaaucucguuaagcccgaggggaaggugaucgaucugggauguggcagagggggauggagcuauuacugcgccggccugaaaaaggugaccgaagucaaaggcuauaccaaagggggaccuggccaugaggaacccauuccuauggcuacauacggguggaaccucgugaaacuucacuccggaaaggacgucuuuuucacacccccugagaaaugugauacacugcugugcgacaucggcgagucuagcccgaaucccacgauugaagaggggagaacccuccgcgugcugaagauggucgaaccuuggcuucggggaaaccaauuuuguaucaagauucugaaucccuacaugccuuccgugguugagacacucgagcagaugcagagaaaacauggcggcaugcuggugcgcaacccccugagcagaaauucuacccacgaaauguauugggucuccugcgggacaggaaacaucgugagcgccgugaauaugaccucuagaaugcuccugaaccgcuucacgauggcucaccggaagccgaccuacgagagagaugucgaccuuggcgccgggacacgccauguugcgguggaaccugagguggccaaccuggauaucauuggacagagaaucgaaaauauuaaacacgagcauaaguccaccuggcacuaugacgaggauaaccccuacaaaacaugggcuuaucauggcagcuacgaagucaagcccucuggguccgccagcuccauggugaauggaguugugaagcuccugaccaaaccuugggacgucauccccauggugacacaaauugcuaugaccgauacgacaccuuuuggccagcagcggguuuucaaggagaaaguggacacccgcaccccgaaggccaaaagaggcacagcucaaaucauggaagucacggcccgguggcuuuggggguuucugagcagaaacaagaagccccggaucuguacccgcgaggaguucacaagaaaagugcggucuaaugcggccauuggagcuguuuuuguggacgagaaccaguggaauagcgccaaggaggcugucgaagaugagcgcuucugggaccucgugcagaaagaaagagagcugcacaagcagggcaaaugcgcgaccugcgucuauaacaugauggggaagcgggaaaagaaacugggagaguuuggcaaggccaaagggucccgcgcgaucugguacauguggcucggcgcuagauuccuggaguuugaagcccuuggauucaugaaugaggaucacugguucucucgggaaaacagccuguccggcguggagggggagggacuccauaagcugggcuacauucuucgcgacaucucuaaaauuccugggggaaauauguaugccgaugacacagcuggcugggauaccagaaucacagaagacgaucugcaaaacgaggccaagaucaccgacauuauggaacccgagcacgcucuccuggccacgagcaucuuuaaacugaccuaccagaauaagguugugcggguccagcgcccugcgaagaacgggacagugauggaugugauuuccagacgggaccagcgcggcucuggacaaguuggcaccuaugggcucaauacauucaccaacauggaagcccagcugaucagacagauggagagcgagggaauuuuucuucccuccgaacuggagacgccgaaccucgcugaacgggugcuggauuggcuugagaaacauggcgucgaaagacugaagcgcauggccaucagcggggacgacugugugguuaaaccuaucgaugaccgguucgcuacagcccucaccgcgcugaaugauaugggaaaggugagaaaagacauuccccagugggagccuucuaagggcuggaacgauuggcaacagguccccuuuugcucccaccacuuccaucagcugaucaugaaggacgggcgcgagauuguggucccuugucggaaucaggaugaacucgugggcagagcccgcguuagccaaggagcuggcuggucucugcgggagacagccugccuugggaaauccuacgcucagauguggcagcugauguauuuucacagacgcgaccuccggcuggccgcuaacgccaucuguagcgcggugcccgucgauugggugccgaccuccagaacgaccuggucuauucaugcccaccaucaauggaugacaaccgaagacaugcuuagcguuuggaaucgcguguggaucgaggaaaacccuuggauggaggauaagacacacgucuccagcuggggagacgugcccuaccugggcaaacgggaggaccaguggugcgggucucucauuggacugaccgcuagagccacaugggccuccaauauccagguggcuaucaaccagguucggagacugauuggcaaugaaaacuaucucgauuacaugaccagcaugaagcgcuucaaaaaugagggggaccccgaaggcgcccugugguga

SEQ ID NO: 19093 - RNA, 9879 nt, Artificial Sequence
  derived and/or modified CDS sequence (opt5) from DENV-1__FJ898391__SS-prME
agcgugaccaugcugcucaugcugaugcccaccgcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucucucacauuuauuaagaccacguucucccugcacuaugccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuacgugauuucuggaagcuccgcugaccuuucucuggagaaggccgccgaggucagcugggaagaggaagcugagcauuccggcgcgucucacaauauccugguggaaguucaggaugacgggacgaugaaaauuaaggaugaggagcgggacgauacccucacaauccugcuuaaggccacccugcucgcugugagcggagucuauccucuguccauccccgccacacucuucgugugguacuuuuggcagaaaaagaaacaacgcucuggcguccugugggacaccccuuccccucccgaaguggagagagccguucuugaugacggcauuuaucggaucaugcagcgcgggcugcugggaagaucccaggugggcgucgggguguuccaggaaaacguuuuucauacgauguggcacgugacccggggagcuguccucauguaccaaggcaagcgccuggagcccagcugggccucugugaaaaaggaccuuauuuccuacgggggaggcuggagacugcagggcagcuggaauacaggggaggaagugcagguuaucgcggucgagcccggaaagaacccuaaaaaugugcagaccgcucccggcacauucaagaccucugaaggggaggugggagccauugcccucgauuuuaaaccgggcacauccgggagcccuaucgucaaccgggaaggaaagauugugggccuguauggcaaugggguugugacgaccuccggaacauacgucucugcuaucgcccaagcgaaagcuagccaggagggcccccucccugagaucgaagacgagguguucagaaagcgcaaccugaccauuauggaucuucaccccggguccggaaagacccggagauaucugcccgccaucguucgcgaagccauuaaacggaagcugagaacacucauccuggcuccuacgcgcguggucgccagcgagauggcugaagcccuuaaaggcaugccgauucgguaccagaccacagcggugaagucugagcauaccgggaaagagaucguugaccugaugugccacgccacauuuaccaugagacuccugucccccgugcgcgucccuaauuauaacaugaucauuauggaugaagcucauuucacggaccccagcucuaucgccgcucggggcuacauuagcacaagagugggaaugggcgaggccgccgcuaucuuuaugaccgcgaccccucccggguccguggaagccuucccucaaucuaaugcugucauucaggaugaggaacgggacaucccggagcgcagcuggaacuccggauaugaguggaucacagauuuucccggcaagaccguuugguucgugccuucuauuaagagcgggaaugacaucgccaacugucugcgcaagaauggaaagcgggugauucagcucucccgcaaaacauucgauaccgaauaccagaagacgaaaaacaacgacugggacuacgucgugacaaccgauaucagcgagaugggcgccaauuuuagagcugaccggguuauugaucccagacgcugccuuaagccugugauccugaaggacgggcccgaacgggucauucuggccggcccgaugccugugacaguugcgucugcugcccaaagacgcggacggaucggcagaaaccacaauaaagagggggaucaguauaucuacaugggacagccccucaacaaugacgaggaucaugcccacuggaccgaagcuaagaugcugcuugacaacauuaauacgcccgagggcaucauuccugcccuguucgaacccgagcgcgaaaaauccgcggccaucgauggggaguaucggcucagaggagaggcucgcaagaccuuuguggaacugaugagacggggcgaccugccugucuggcucagcuacaaaguggccuccgagggguuccaguauucugaucgcagauggugcuuugacggcgaacggaacaaucaaguccuugaggaaaacauggauguggagauuuggacaaaggagggagaacgcaaaaagcugagaccgcgguggcuggacgcuagaaccuacagcgacccccucgcccugcgcgaguucaaggaauuugcugccggccggagauccguuucuggggaucuuauccuggagaucggaaaacucccucagcaccugacacagcgcgcgcagaaugcccuggacaaccucgugaugcuucauaauagcgaacaaggcgggcgggcuuauagacacgccauggaggagcugcccgauaccauugaaacacugaugcuccuggcucuuaucgccgugcugaccggaggcgucacgcuguucuuucuguccggccgggggcugggaaagacaagcauuggccuccuuuguguuauggccucuuccgugcugcuguggauggcuagcguggagccucauuggaucgcggccucuauuauccucgaguucuuucugaugguccuucugauccccgagccggaccgccagagaaccccucaggauaaccagcucgcuuacgugguuauugggcugcuguucaugauccucaccguggccgccaaugagaugggacuucuggaaacaaccaaaaaggaccugggcauugggcacgucgcuguggagaaccaccaucacgccgcgaugcucgaugucgaccugcaucccgccuccgcuuggacacuuuacgccguggcuacgaccaucauuacaccuaugaugcggcacaccaucgaaaacacaaccgccaauauuagccugacggcgaucgccaaccaagcugccauccucaugggacuggauaaaggcuggcccauuucuaagauggacaucggcguuccucugcucgcucuugggugcuauagccaggugaauccccugacccugacagccgcuguccucaugcugguggcccauuacgcgauuaucggaccgggccuucaggccaaggcuacccgcgaggcccagaagagaacagcugccgggauuaugaagaacccuaccguugauggaaucguggccaucgaccuggaucccgucguguaugacgcgaaauuugaaaagcagcucggccagauuaugcugcugauccucuguacgucccagauucuucugaugcggacaaccugggcucugugcgagucuaucacacucgccaccgggccccugaccacacuuugggagggaagcccuggcaaauucuggaauacgaccauugcuguguccauggccaacaucuuccgcggcagcuaccuggccggggcuggacucgccuuuucccugaugaagucucugggcgggggaagacggggcacaggggcgcaaggagaaacccucggcgagaaguggaaacgccagcuuaaucagcugagcaaguccgaguucaacacauauaaaagaucuggcaucauggagguugaccggagcgaagccaaggaggggcugaaaagaggagagaccacgaagcacgcugucucccgcggcacagccaagcuccggugguuuguggaaagaaaucuggugaaaccggaggggaaggucauugaucuuggauguggccgcgggggauggucuuacuauugcgcuggccugaaaaagguuaccgaagugaaaggcuacaccaaagggggacccggccacgaggaaccuauccccauggccacauacggguggaaccucgugaaacugcauagcggaaaggacgucuucuuuauuccucccgagaagugugauacccugcucugcgacaucggcgaguccagcccuaauccgacaauugaagaggggcggacgcuuagagugcugaaaaugguugaacccuggcugcgcggaaaccaguucuguaucaagauucucaauccuuauaugcccucuguggucgagacccuggagcaaaugcagcggaaacacggcggcaugcuugugagaaacccucugucccgcaauagcacacaugaaauguacuggguuucuugcgggaccggaaacaucguguccgcggucaauaugacaagccggaugcuccugaacagauuuaccauggcccaccgcaagcccacguaugagcgggauguggaccugggcgcugggaccagacacguggccgucgaaccggagguugcuaaccucgauaucauuggacagcgcaucgaaaauauuaaacaugagcacaagucuacauggcauuacgacgaggauaacccuuauaagaccugggccuaccacggcuccuaugaagugaaacccagcggguccgcuagcucuauggugaauggagucgugaagcugcuuacaaaacccugggacguuaucccuauggugacccagauugccaugacagauaccacgcccuucggccaacagagagucuuuaaggagaaaguggacacacggaccccuaaggcgaagcgcggcaccgcccagaucauggaaguuacagcuaaauggcuguggggguuccucagcagaaacaagaaaccgcggaucuguacgagagaggaauuuacccggaaggugcgcuccaaugccgcuauuggagccgucuucguggacgagaaccaauggaacucugccaaagaggcgguugaagaugagagauuuugggaccuggugcaucgggaacgcgagcuucacaagcagggcaagugcgcuacaugcgucuacaacaugauggggaaaagagaaaagaaacugggagaguucggcaaggccaaagggagccgggccaucugguacauguggcucggcgcucgcuuccuggaguuugaagcccugggauucaugaaugaggaucacugguuuuccagagaaaacucucucagcggcguggagggggagggacugcauaaacuuggcuauauucugcgggacaucuccaaaauucccgggggaaauauguacgcugaugacaccgccggcugggauacacgcaucaccgaagacgaucuccagaacgaggcgaagaucacagacauuauggaaccugagcacgcccugcuugcuaagucuaucuucaaacugaccuaucagaauaaggucgugagaguucaacggcccgccaaaaacgggacggugauggaugucauuagccgcagagaccagcggggcuccggacaggugggcaccuacgggcucaauacauuuaccaacauggaagcucagcugauccgccaaauggagagcgagggaauuuucucuccuuccgaacuggagacacccaaccucgccggcagagugcuggauuggcuugaaaagcaugggguugagcggcugaaaagaauggcgaucagcggagacgacuguguggucaagccgaucgaugaccgcuuugccaccgcucucacggcccugaaugauaugggcaaggugcggaaagacauuccucagugggaacccucuaagggguggaacgauuggcagcagguuccuuucugcucccaccacuuucaucaacuuaucaugaaagacggcagagagauugugguccccugucgcaaucaggaugagcuggugggacgggcuagagucagccagggcgccggguggucccuccgcgaaacagcuugccugggaaagucuuaugcccagauguggcaacugauguacuuccaccggagagaccuccgccuggcggccaacgcuaucuguagcgccgugccuguugauugggugcccaccucccggacaaccuggagcauucaugcccaccaucaguggaugacgaccgaggacaugcuuucugucuggaauagaguguggaucgaagagaacccguggauggaagauaaaacacacauuuccagcuggggcgacguuccuuaucuggggaagcgcgaggaccaguggugcggaucucucaucggccugaccgcucgggccacaugggcgaccaauauccaaguggcuauuaaccaggucagacggcuuaucgggaaugagaacuaccuggauuacaugacaagcaugaagagauuuaaaaaugaauccgaccccgagggcgcccucugguga

SEQ ID NO: 19094 - RNA, 9879 nt, Artificial Sequence
  derived and/or modified CDS sequence (opt5) from DENV-1__FJ898392__SS-prME
agcgugaccaugcugcugaugcugaugcccaccgcccuugcuuuccaccugacgacccggggaggggaaccucauaugaucgucacaaagcaggaacggggaaaaucccuccuguuuaagaccucugccggcguuaacaugugcacacuuauugcgauggaccugggggaacucugugaagauaccaugacauacaaaugcccccgcaucaccgaggcugaacccgacgauguggacuguuggugcaaugccacggauaccugggugacauauggaaccuguagccagacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacggaaugaaguucacagugguugugggcgacgucguggggauucucgcucagggcaaaaagaugauccggccgcaacccauggagcacaaauacucuuggaaaagcuggggcaaggccaagauuaucggggccgaugugcagaauaccaccuuuaucauugacggaccuaacacacccgaauguccugaugaccagagagcuuggaauaucugggaggucgaggauuauggcuucggcauuuuuaccacgaacaucuggcugaagcugcgcgacuccuacacacagguuugcgaucaccggcuuaugagcgcggccauuaaagacucuaaggcugugcaugccgauaugggguauuggaucgaauccgagaaaaaugaaaccuggaagcucgccagagcuagcuucaucgaggugaagacauguauuuggcccaaaucucacacccugugguccaacggaguccuggaaagcgagaugaucauuccgaagaucuacggcgggccuauuucucaacauaauuaucgccccggauacuucacacagaccgccggcccuuggcaccucgggaaacuggagcuugacuuugaucugugcgaaggaacgaccgugguuguggacgagcacugcggcaaccggggccccagccucagaacaaccacagucaccgggaagaucauccaugaaugguguugccgguccuguacgcugccuccccugcgcuucaaaggagaggauggcugcugguacgggauggagauuagaccggugaaggaaaaggaggaaaaucuuguuaaaagcauggugucugcgggauccggcgaggucgacagcuuuucccucgggcugcuguguacaucuaucaugauugaagaggugaugcggagcagauggucccgcaagaugcucaugaccggaacacuggcuguuuuccuucugcucaucaugggccagcugaccuggaacgaccugauucggcuuugcaucauggugggcgccaaugccucugauagaauggggaugggaaccacauaucuggcucucauggccacguuuaaaaugcgcccuauguucgcggucggccugcucuuuagacggcugaccagccgcgaggugcuucugcucacaauugggcugucccugguggcuucugucgaacuucccaacagccuggaggaacucggagacggccuggccauggggaucaugauccucaagcugcuuaccgauuuccaaucccaccagcugugggccacacuccugagccugaccuuuauuaaaacgacacuuucucugcauuacgcuuggaagaccauggccaugguucucuccaucgugagccuguucccccucugucugucuaccacaucccagaagaccacauggcuuccugugcugcugggaagccucggcugcaaaccgcugacgauguuucuuauugcugagaauaagaucuggggcagaaaaucuuggccccugaacgaagggauuauggccgucggagugguuuccauccuccugagcucccuccugaagaacgacgugccucuugcgggcccccugaucgccgggggaaugcugauugcuuguuaugucaucagcggcucuagcgccgaucucucccuggagaaagcugccgaggugucuugggaagaggaagccgagcacagcggggcuucccauaauauucuuguugaagugcaggacgauggaaccaugaagaucaaagacgaggagcgggaugacacacugaccauucuccugaaggcgacacuccuggccgucucuggcguguacccucuuagcauccccgcuacccuguucgucugguauuuuuggcaaaagaaaaagcagcgcuccggcgugcugugggauacgccuucucccccggaaguugagagagccgugcucgacgaugggaucuaccggauuaugcagcgcggacugcuuggcagaagccaggucggggugggaguuuuccaagaaaacguguuccacaccauguggcacgucacacggggcgccgugcugauguaucaggggaaacgccucgagccuuccugggcuagcgugaagaaagaccugaucucuuacggaggcggcuggagacuccagggguccuggaauaccggagaggaaguucaggucauugccguggagcccggcaagaacccuaagaaugugcaaacagcgcccgggaccuuuaaaacaccggaaggagaggucggcgcuaucgcccuggacuucaagccugggacgagcggaucucccauugugaaccgggaaggcaaaaucguuggccuuuacgggaauggaguggucaccacauccggcaccuaugugagcgccauugcucaggccaaggcgucccaggaggggccucugcccgagaucgaagaugagguuuuuagaaaacgcaaccugaccaucauggaccuccaucccggaucuggcaagacacggagauaccugccugcuauugugcgcgaagccaucaagcggaaacuuagaacgcugauucucgccccgacccgcgucguggcuagcgagauggccgaagcucugaaggggaugcccauccgguaucaaacaaccgccguuaaauccgagcacacaggcaaggagauuguggaucugaugugccaugcgaccuucacgaugagacuccuuagcccuguccgcgugcccaauuacaacaugaucaucauggacgaagcccacuuuacagauccuucuuccauugcugcccggggauauaucagcaccagagugggcaugggggaggcugccgccauuuucaugaccgcuacacccccuggaucugucgaagcguuuccgcagagcaaugccguuauccaggacgaggaacgggauauucccgagcgcuccuggaacucuggcuacgaguggaucaccgacuucccugggaaaacagugugguuugugcccagcaucaaguccggaaaugauauugcuaacugucugagaaagaauggcaaacgggucauccagcugucucgcaagaccuucgacacggaauaucagaaaaccaagaacaacgauugggacuacgugguuaccacagacauuagcgagaugggggccaauuuuagagccgaucgggugaucgacccuagacgcugccucaaacccgucauucugaaggauggcccggaacgggugauccuugcuggaccuaugcccguuaccguggccuccgcggcucagagacgcggccggauugggagaaaccauaauaaggagggagaccaguacaucuauaugggccagccccugaacaaugaugaggaccacgcccacuggacggaagccaaaaugcuccuggauaacaucaauaccccugaggggauuauccccgcucuguucgaaccugagcgcgaaaagagcgccgcgauugacggagaguaccggcucagaggcgaggcccgcaaaacauucgucgaacuuaugagaagaggggaucugccgguguggcugucuuauaaggucgcuuccgagggcuuucaauacagcgaccgcagauggugcuucgauggagaacggaacaaucaggugcucgaggaaaacauggacguugagaucuggaccaaagagggcgaacgcaagaaacugagaccccgguggcuugaugccagaacauauuccgacccucuggcucuccgcgaguuuaaggaguucgccgcugggcggagaucugugagcggagaccugauucuggagaucggcaagcucccccagcaucuuacccagcgcgcccaaaaugcgcuggauaaccuggugaugcuccacaauuccgaacaagggggacgggccuacagacaugcuauggaggagcugccugacacaaucgaaacccuuaugcugcucgcccugauugcuguccugacgggcggcguuacacucuuuuuccuuucugggcggggacugggcaaaaccagcaucgggcugcucugugugauggccuccagcgugcugcuuuggauggccucugucgagccccacuggauugcugcguccaucauucuggaauuuuuccucauggugcugcugaucccggagccugaucgccagagaacaccccaggacaaccaacucgccuauguugugaucggacuucuguuuauuauccugacagucgcugccaaugagaugggccuccuggaaaccacaaagaaagaucuugggauuggacacguggccgucgagaaccaucaccaugcuacgaugcuggacguggaucuccacccugccagcgcguggacccuguacgccguugcuacaaccaucauuacacccaugaugcggcauaccaucgaaaacacgaccgccaauauuucucugacagcuaucgccaaccaggcggccauccucaugggccuugacaagggcuggccuauuuccaaaauggauaucggggugccccugcuggcucucggaugcuacagccaggucaauccgcugacccuuacagccgcugugcugaugcucguugcccacuaugcuauuaucggcccugggcugcaagccaaggcgacccgcgaggcccagaagagaacggcugccggaauuaugaaaaaccccacaguggacggcaucgucgcuaucgaucuggaccccgugguguacgaugccaaguucgaaaaacagcucgggcagauuaugcuucugauccuguguaccucucaaauucuccugaugcggacaaccugggcccuuugcgagagcaucacccuggcgacaggaccucucacgacccugugggagggcuccccgggcaaguuuuggaauacaaccauugcuguuucuauggccaacaucuuccgcgggagcuaucuggcuggagccggccucgccuuuucccuuaugaaaagccucgggggaggcagacgggggacaggagcucagggcgaaacccugggcgagaaguggaagcgccagcucaaucagcuguccaaaucugaguucaacaucuacaagagaagcgggauuauggaggucgaccgguccgaagccaaagagggacuuaagagaggcgagacgacacgccacgcggugucucgggggaccgccaaacugagaugguucguggaacgcaaucucgucaagcccgagggaaagguuaucgaccugggcugugggcggggaggcuggagcuauuacugcgcuggccugaaaaaggugaccgaagugaaaggguauacaaagggaggcccugggcaugaggaacccauuccuauggccaccuacggauggaaccucgucaaacuucacuccggcaaggauguguuuuucacacccccugagaaaugugacacgcugcugugcgauaucggggagucuagcccgaaucccaccauugaagagggaagaacacuccgcguucugaagaugguggaaccuuggcuucggggcaaccaauuuuguaucaagauucugaaucccuacaugccuuccgucguggagacccucgagcagaugcagagaaaacauggcgggaugcugguucgcaacccccugagcagaaauucuacacacgaaauguauuggguguccugcggaaccggcaacaucgucagcgcugugaauaugacgucuagaaugcuccugaaccgcuucaccauggcccaccggaagccgacauacgagagagacguggaucuuggggcgggaacccgccaugucgccguugaaccugagguggcuaaccuggacaucauuggccagagaaucgaaaauauuaaacacgagcauaaguccacauggcacuaugaugaggacaaccccuacaaaaccugggccuaucaugggagcuacgaagugaagcccucuggauccgcuagcuccauggucaauggcgugguuaagcuccugacaaaaccuugggaugugauccccauggucacccaaauugccaugacggacacaaccccuuuuggccagcagcggguguucaaggagaaaguugauacccgcacaccgaaggcuaaaagagggacggcccaaaucauggaagugaccgcgcgguggcuuuggggauuucugagcagaaacaagaagccccggaucuguacacgcgaggaguucaccagaaaaguccggucuaaugccgcuauuggcgccguguuuguugacgagaaccaguggaauagcgcuaaggaggccguggaagacgagcgcuucugggaucucguccagaaagaaagagagcugcacaagcaggggaaaugcgccacaugcguguauaacaugaugggaaagcgggaaaagaaacugggcgaguuugggaaggcgaaaggcucccgcgcuaucugguacauguggcucggagccagauuccuggaguuugaagcccuuggcuucaugaaugaggaccacugguucucucgggaaaacagccuguccggggucgagggagagggccuccauaagcugggguacauucuucgcgauaucucuaaaauuccuggaggcaauauguaugcugacgauaccgccgggugggacacaagaaucaccgaagaugaccugcaaaacgaggcuaagaucacggauauuauggaacccgagcacgcccuccuggcgaccagcaucuuuaaacugacauaccagaauaaggugguucgggugcagcgcccugccaagaacggcaccgucauggacgugauuuccagacgggaucagcgcggaucuggccaaguggggacauauggacucaauaccuucacgaacauggaagcucagcugaucagacagauggagagcgagggcauuuuucuucccuccgaacuggagacaccgaaccucgccgaacggguucuggacuggcuugagaaauacgggguggaaagacugaagcgcauggcuaucagcggagaugacugugucgugaaaccuaucgacgaucgguucgccaccgcgcucacagcccugaaugacaugggcaagguuagaaaagauauuccccagugggagccuucuaagggguggaacgacuggcaacaggugcccuuuugcucccaucacuuccaccagcugaucaugaaggauggccgcgagauugucgugccuugucggaaucaggacgaacucgucggacgggcucgcgugagccaaggcgccggguggucucugcgggagaccgcuugccuuggaaaauccuaugcccagauguggcagcugauguacuuucauagacgcgaucuccggcuggcugccaacgcgaucuguagcgccguucccguggacugggucccgacguccagaaccacauggucuauucacgcucaucaccaauggaugaccacagaagauaugcuuagcguguggaaucgcguuuggaucgaggaaaacccuuggauggaggacaagacccauguguccagcuggggcgauguccccuaucuggggaaacgggaggaccaguggugcggaucucucauuggccugacagccagagccaccugggcuuccaauauccagguggccaucaaccaggugcggagacugauugggaaugaaaacuaccucgacuacaugacgagcaugaagcgcuucaaaaaugagggcgaucccgaaggagcgcugugguga

SEQ ID NO: 19095 - RNA, 9879 nt, Artificial Sequence
  derived and/or modified CDS sequence (opt5) from DENV-1__FJ898393__SS-prME
agcgugaccaugcugcucaugcugaugcccacagcccuugcuuuccaccugacgaccagaggcggggagccucauaugaucgucacaaagcaggaacggggaaaaucccuccuguuuaagaccucugccggcguuaacaugugcacacuuauugcgauggaccugggggagcucugugaagauaccaugacauacaaaugcccgcgcaucaccgaggcugaacccgacgauguggacuguuggugcaaugccacggauaccugggugacauauggaaccuguagccaaacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagagcaggacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuaccccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccccccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuguggggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcagagcuugggaggagggggugugcggcauucgcagcgccacgcggcucgaaaacaucauguggaagcagaucuccaacgagcugaaucauauucuucuggaaaacgacaugaaauucacaguuguggucggagauguggugggcauccucgcucaggggaagaaaaugauuagaccgcaacccauggagcacaaguacucuuggaaaagcuggggaaaggccaagaucauuggcgccgacguccagaauaccaccuuuaucaucgaugggccuaacacacccgaauguccugacgaucagcgcgcuuggaauauuugggagguugaggacuauggauucggcaucuuuaccacgaacauuuggcugaaacugcgggauuccuacacacaggugugcgaccacagacuuaugagcgcggccaucaaggauucuaaagcugugcaugccgacaugggcuauuggauugaauccgagaagaaugaaaccuggaaacucgcccgcgcuagcuucaucgaggucaagacauguaucuggcccaagucucacacccugugguccaacggggugcuggaaagcgagaugauuaucccgaaaauuuacggaggcccuaucucucaacauaauuaucggcccggguacuucacacagaccgccggaccuuggcaccucggcaagcuggagcuugauuuugaccugugcgaagggacgaccguuguggucgaugagcacugcggaaacagaggccccagccuccggacaaccacagugaccggcaaaauuauccaugaaugguguugccgcuccuguacgcugccuccccugagauucaagggggaggacggaugcugguacggcauggagauccggccgguuaaagaaaaggaggaaaaucuugugaagagcauggucucugcgggguccggagagguggacagcuuuucccucggccugcuguguauuucuaucaugauugaagagguuaugagaagccgcuggucccggaaaaugcucaugacagggacccuggcuguguuccuucugcucaucaugggacagcugacauggaacgaucugauuagacuuugcaucauggucggcgccaaugccucugaccgcaugggcauggggaccaccuaucuggcucucauggccacauuuaagaugagaccuauguucgcggugggacugcucuuucggcgccugacgagcagagaggugcuucugcucaccauuggccugucccuggucgcuucuguugaacuucccaacagccuggaggaacucggggauggacuggccaugggcaucaugauccucaaacugcuuacagacuuccaaucccaccagcugugggccacccuccugagccugacauuuauuaagaccacgcuuucucugcauuacgcuuggaaaacaauggccauggugcucuccaucgcuagccuguucccccucugucugucuaccaccucccagaagacaaccuggcuuccugugcugcuggggagccucggaugcaagccgcugacaauguuucuuauuacggagaccaaaaucuggggccggaagucuuggccccugaaugaaggcauuauggccgucggggugguuuccauccuccugagcucccuccugaaaaacgaugugccucuugcgggaccccugaucgccggcgggaugcugauugcuuguuaugucaucagcggaucuagcgccgaccucucccuggagaaggcugccgaggugucuugggaagaggaagccgagcacagcggcgcuucccauaacauucuuguugugguccaggaugacgggacaaugaaaaucaaggaugaagagcgcgacgauacccugacaauucuccugaaagcgacccuccuggccgugucuggagucuacccucuuagcauccccgcuacgcuguucgugugguauuuuuggcaaaagaagaaacagagauccggcguucugugggacaccccuucucccccggagguggaacgggccguccucgaugacggcaucuaccgcauuaugcagagagggcugcuuggacggagccaggugggcguugggguguuccaagagaaugucuuccacacaauguggcacgugacccgcggagccgugcugauguaucagggcaagagacucgaaccuuccugggcuagcguuaaaaaggaccugaucucuuacgggggaggcuggcggcuccagggcuccuggaacacaggggaggagguccaggugauugccguggaacccggaaaaaauccuaagaacguccaaaccgcgcccggcacauuuaagacgccggagggggaagugggagcuaucgcccuggauuucaaaccuggcaccagcgggucucccauuguuaauagagagggaaagaucgugggccuuuacggcaacggggucgugacaaccuccggaaccuauguuagcgccauugcucaggccaaagcgucccaggaaggcccucugcccgagaucgaggacgaaguguuucgcaagcggaaucugacaaucauggaucuccaucccgggucuggaaaaacgagacgcuaccugccugcuauuguccgggaggccaucaagagaaagcuucgcacccugauucucgccccgacacgggugguugcuagcgaaauggccgaggcucugaaaggcaugcccaucagauaucaaaccacagccgugaaguccgaacacaccgggaaagagauugucgaccugaugugccaugcgacguucacaaugcgccuccuuagcccugugcgggugcccaacuacaauaugaucaucauggaugaggcccacuuuaccgacccuucuuccauugcugccagaggcuauaucagcacccgggucggaaugggcgaagcugccgccauuuucaugacagcuacccccccugggucuguugaggcguuuccgcagagcaacgccgugauccaggaugaagagcgcgacauucccgaaagauccuggaauucuggauacgaguggaucacagauuucccuggcaagaccgugugguuuguccccagcaucaaauccgggaacgacauugcuaauugucugcggaagaacggaaagcgcgugauccagcugucuagaaaaacguucgauacagaguaucaaaagaccaaaaauaacgacugggacuacguugugacaaccgauauuagcgaaaugggcgccaacuuucgggccgacagagucaucgauccucgccggugccucaagcccgugauucugaaagacgggccggagagaguuauccuugcuggcccuaugcccgugacggucgccuccgcggcucagcgccggggaagaauuggccgcaaucauaacaaggaaggggaucaguacaucuauaugggacagccccugaauaacgacgaggaucacgcccacuggaccgaggccaagaugcuccuggacaauaucaacacaccugaaggcauuauccccgcucuguucgagccugaacgggagaaaagcgccgcgauugauggggaauacagacuccgcggagaggccagaaagaccuucguggagcuuaugcggcgcggcgaccugccggucuggcugucuuauaaaguggcuuccgaaggguuucaauacagcgauagacgguggugcuucgacggcgagcgcaauaaccagguucucgaagagaauauggauguggaaaucuggacaaaggagggagagagaaaaaagcugcggcccagauggcuugacgcccgcaccuauuccgacccucuggcucuccgggaauuuaaagaguucgccgcuggcagacgcucugugagcggggaucugauucuggaaaucggaaagcucccccagcaucuuacacagcgggcccaaaacgcgcuggacaaucuggucaugcuccacaacuccgagcagggcgggagagccuaccggcaugcuauggaagagcugccugauaccaucgagacgcuuaugcugcucgcccugauugcuguucugacaggaggcgugacccucuuuuuccuuucuggccgcgggcugggaaagaccagcaucggccugcucugugugauggccuccagcguccugcuuuggauggccucuguggaaccccacuggauugcugcguccaucauucuggaguuuuuccucaugguucugcugaucccggaaccugacagacagcggacaccccaggauaaucaacucgccuauguggucaucgggcuucuguuuaugauucugaccguggcugccaacgagaugggacuccuggagacaacgaaaaaggaccuuggcaucgggcacgucgccguggaaaaucaucaccaugcuaccaugcuggauguugaccuccacccugccagcgcguggacacuguacgccguggcuaccacaauuaucacccccaugaugcgccauacgauugagaacaccacagccaacaucucucugaccgcuauugccaaucaggcggccauccucaugggacuugauaaaggcuggccuaucuccaagauggacauuggcgucccccugcuggcucucgggugcuacagccaggugaacccgcugacacuuaccgccgcuguucugaugcucguggcccacuaugcuaucauuggaccuggccugcaagccaaagcgacgagagaagcccagaagcggacagcugccgggaucaugaagaaucccaccgucgauggaauuguggcuaucgaccuggaucccgugguuuacgacgccaaauucgagaagcagcucggccagaucaugcuucugauucuguguacaucucaaauccuccugaugcgcaccaccugggcccuuugcgaaagcauuacacuggcgacggggccucucaccacacugugggagggauccccgggcaaauuuuggaacaccacaaucgcugucucuauggccaauauuuucagaggcagcuaucuggcuggggccggacucgccuuuucccuuaugaagagccugggcgggggacggcgcggcaccggggcucagggagagacgcugggcgaaaaauggaagagacagcucaaccagcuguccaagucugaguucaauaucuacaaacggagcggcaucauggaaguggacagauccgaggccaaggaagggcuuaaacgcggagagacaacccggcacgcggugucuagaggcaccgccaagcugcgcugguucgucgagcggaaccucguuaaacccgaagggaaggugauugaucugggauguggcagagggggauggagcuauuacugcgcuggccugaagaaagugacagaggucaagggcuauaccaaagggggaccuggccaugaagagcccaucccuauggccacauacggguggaaucucgugaagcuucacuccggaaaagacguuuuuuucacgcccccugaaaagugugauacccugcugugcgacauuggcgagucuagcccgaaccccacaaucgaggaagggcgcacccuccgggugcugaaaauggucgagccuuggcuuagaggaaaucaauuuuguauuaagauccugaaccccuacaugccuuccgugguugaaacacucgagcagaugcagcgcaagcauggcggcaugcuggugcggaauccccugagcagaaacucuacccacgagauguauugggucuccugcgggacgggaaauauugugagcgcugugaacaugaccucucgcaugcuccugaaucgguucacaauggcccacagaaaaccgaccuacgaacgcgaugucgaccuuggcgcggggacaagacauguugccguggagccugaaguggcuaaccuggauaucaucggacagcggauugagaacaucaagcacgaacauaaauccaccuggcacuaugacgaggauaaucccuacaagacaugggccuaucauggcagcuacgaggucaaacccucuggguccgcuagcuccauggugaacggaguugugaagcuccugaccaagccuugggacgucauucccauggugacgcaaaucgccaugacagauaccaccccuuuuggccagcagcgcguuuucaaagaaaagguggacacaagaacgccgaaagcuaagcggggcaccgcccaaauuauggaggucacagcgagauggcuuuggggguuucugagccggaauaaaaagccccgcaucuguaccagagaagaguucacacggaaggugcgcucuaacgccgcuaucggagccguuuuuguggacgaaaaucaguggaacagcgcuaaagaggccgucgaggaugaaagauucugggaccucgugcagaaggagcgggaacugcacaaacagggcaagugcgccaccugcgucuauaauaugauggggaaacgcgagaagaagcugggagaauuuggcaaagcgaagggguccagagcuauuugguacauguggcucggcgcccgguuccuggaguuugaggcccuuggauucaugaacgaagaucacugguucucucgcgagaauagccuguccggcguggaaggggagggacuccauaaacugggcuacauccuuagagacauuucuaagaucccugggggaaacauguaugcugaugacacagccggcugggauacccggauuacggaggacgaucugcaaaaugaagcuaaaaucaccgacaucauggagcccgaacacgcccuccuggcgacaagcauuuuuaagcugaccuaccagaacaaaguugugcgcguccagagaccugccaagaaugggacagugauggaugugaucucccggcgcgaccagagaggcucuggacaaguuggcaccuaugggcucaacacguucacaaauauggaggcucagcugauucggcagauggaaagcgagggaaucuuucuucccuccgagcuggaaaccccgaaccucgccgagagagugcuggauuggcuugaaaaguacggcgucgagcgccugaaacggauggcuauuagcggggacgacugugugguuaagccuaucgaugacagauucgccacagcgcucaccgcccugaacgauaugggaaaagugcgcaaggacaucccccagugggaaccuucuaaaggcuggaaugauuggcaacagguccccuuuugcucccaucacuuccaccagcugauuaugaaggacgggcgggagaucguggucccuuguagaaaccaggaugagcucgugggccgcgcucggguuagccaaggagccggcuggucucugagagaaacggcuugccuugggaaguccuaugcccagauguggcagcugauguacuuucaucgccgggaccucagacuggcugccaaugcgauuuguagcgccgugcccgucgauugggugccgaccucccgcacaaccuggucuauccacgcucaucaccaauggaugacaaccgaggacaugcuuagcguuuggaaccggguguggauugaagagaauccuuggauggaagauaaaacacaugucuccagcuggggagacgugcccuaucugggcaagagagaggaccaguggugcgggucucucaucggacugaccgcccgggccacgugggcuuccaacauucagguggccaucaaucagguuagacgccugaucggcaacgagaauuaccucgauuacaugacaagcaugaaacgguucaagaacgaaggggaccccgagggcgcgcugugguga

SEQ ID NO: 19096 - RNA, 9879 nt, Artificial Sequence
  derived and/or modified CDS sequence (opt5) from DENV-1__FJ898394__SS-prME
agcgugaccaugcugcucaugcugaugcccacagcccuugcuuuccaccugacgaccagaggcggggagccucauaugaucgucacaaagcaggaacggggaaaaucccuccuguuuaagaccucugccggcguuaacaugugcacacuuauugcgauggaccugggggagcucugugaagauaccaugacauacaaaugcccgcgcaucaccgaggcugaacccgacgauguggacuguuggugcaaugccacggauaccugggugacauauggaaccuguagccaaacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagagcaggacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuaccccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccccgcaagagacauggaaucgccaggaccugcucgucaccuucaaaaccgcgcacgccaagaagcaggaaguggucgugcugggaucucaagagggcgcuaugcacacagcccugacgggggccaccgaaauucagacaagcggaaccacaaccaucuuugcuggccaucucaaaugcagacugaagauggauaaacuuacgcugaaggggauguccuauguuauguguacaggcagcuucaaacucgagaaggaaguggccgagacccagcacggaaccguccuggugcagauuaaguacgagggcacagacgcgccuugcaaaauccccuucucuacccaagaugaaaaggggguuacacagaacggacggcugaucacggcuaauccuauugugaccgacaaagagaagcccgucaacaucgaagccgagcccccuuuuggcgaguccuauauugugaucggggccggagaaaaagcucuuaagcucagcugguucaagaaaggcucuagcauugggaagauguuugaggccacagcuagaggcgcccgccggauggcgauccugggagauaccgccugggacuucggcuccaucgggggaguguuuacaucuguuggcaaacugguccaucagauuuucgggaccgcuuacggagugcucuuuagcggcguguccuggacgaugaagaucgggauuggcguccugcuuaccuggcugggacucaauagcagaucuacaucccugagcaugaccuguaucgccgugggccugguuacacuuuaccucggggugaugguccaggcugauucuggaugcgugauuaacuggaaaggccgcgaacugaaguguggguccggaaucuucguuaccaaugaggugcacacauggaccgaacaauauaaguuucaggccgacagcccgaaacggcuguccgcggccauuggcaaggcuugggaggagggggucugcggcaucagaucugccacgcgccucgaaaacaucauguggaaacagauuagcaacgagcugaaucauauccuucuggaaaacgacaugaaguucacagugguugugggagaugucgugggcauucucgcucaggggaaaaagaugauccggccccaaccuauggagcacaaauacuccuggaagucuuggggaaaggccaaaauuaucggcgccgacgugcagaauaccaccuuuaucauugaugggcccaacacaccugaaugucccgacgaucagagagcuuggaauaucugggaggucgaggacuauggauucggcauuuuuaccacgaacaucuggcugaagcugcgcgauagcuacacacagguuugcgaccaccggcuuauguccgcggccauuaaagauagcaaggcugugcaugccgacaugggcuauuggaucgaaucugagaaaaaugaaaccuggaagcucgccagagcuuccuucaucgaggugaagacauguauuuggccgaaaagccacacccuguggucuaacgggguccuggaauccgagaugaucauuccuaagaucuacggaggccccauuagccaacauaauuaucgcccuggguacuucacacagaccgccggacccuggcaccucggcaaacuggagcuugauuuugaccugugcgaagggacgaccgugguuguggaugagcacugcggaaaccggggcccuucucucagaacaaccacagucaccggcaagaucauccaugaaugguguugccggagcuguacgcugcccccgcugcgcuucaaaggggaggacggaugcugguacggcauggagauuagaccugugaaggaaaaggaggaaaaucuuguuaaauccauggugagcgcggggucuggagaggucgacuccuuuagccucggccugcuguguaucuccauuaugaucgaagaggugaugcggucuagauggagccgcaagaugcucaugacagggacccuggcuguuuuccuucugcucauuaugggacagcugacauggaacgaucugauccggcuuugcauuauggugggcgccaaugucuccgacagaaugggcauggggaccaccuaucuggcccucauggcuacauuuaaaaugcgccccauguucgccgugggacugcucuuuagacggcugacgucucgcgaggugcuucugcucaccaucggccugagccuggucgcguccguugaacuucccaacucucuggaggaacucggggauggacuggcuaugggcaucaugauucucaagcugcuuacagacuuccaaagccaccagcugugggccacccuccugucccugacauuuaucaaaaccacgcuuagccugcauuacgccuggaagacaauggcuauggugcucucuauugugucccuguucccucucugucugagcaccaccucucagaagacaaccuggcuuccgguccugcuggggucccucggaugcaaaccccugacaauguuucuuaucgccgagaauaagauuuggggcagaaaaagcuggccucugaacgaaggcaucauggcuguggggguugugucuauccuccuguccagccuccugaagaacgaugucccccuugccggaccucugauugcgggcgggaugcugaucgccuguuaugugauuuccggaagcucugcugaccucagccuggagaaagccgcugagguuuccugggaagaggaagccgagcacucuggcgccagccauaauauccuuguggaaguccaggaugacgggacgaugaagauuaaagaugaggagcgggacgauacccugacaauccuccugaaggcuacccuccuggcgguguccggagucuacccccuuucuaucccugccacacuguucgugugguauuuuuggcaaaagaaaaagcagcgcagcggcguucugugggacacccccuccccgccugaaguggagagagcuguccucgaugacggcauuuaccggaucaugcagcgcgggcugcuuggaagaucucaggugggcguugggguguuccaagaaaacgucuuccacacgauguggcacgugacccggggagccgugcugauguaucagggcaaacgccucgagcccagcugggccuccguuaagaaagaccugauuagcuacgggggaggcuggagacuccagggcucuuggaauacaggggaggaaguccaggugaucgcuguggagccuggaaagaaccccaagaauguccaaaccgccccgggcacauuuaaaaccccugaaggggaggugggagcgauugcucuggauuucaagcccggcacauccgggagcccuaucguuaaccgggaaggaaaaauugugggccuuuacggcaauggggucgugacgaccucuggaacauauguuuccgccaucgcccaggcuaaggccagccaggagggcccccugcccgagaucgaagacgagguguuuagaaaacgcaaccugaccauuauggaucuccauccuggguccggaaagacccggagauaccugccggcgaucguccgcgaagcuauuaagcggaaacuuagaacacugauccucgcccccacgcgcgugguugccucugagauggcugaagcccugaagggcaugccuauucgguaucaaaccacagcugugaaaagcgagcacaccgggaaggagaucgucgaccugaugugccaugccacauucaccaugagacuccuuucccccgugcgcgugccuaauuacaacaugaucauuauggaugaagcgcacuuuacggaccccagcucuaucgccgcucggggcuauauuuccacaagagucggaaugggcgaggccgcugccaucuucaugaccgccaccccuccggggagcguugaagcuuuuccccagucuaaugcggugauucaggaugaggaacgggacaucccugagcgcagcuggaacuccggauacgaguggaucacagauuuccccggcaaaaccgugugguuugucccuucuauuaagagcgggaaugacaucgccaacugucugagaaagaauggaaaacgggugauucagcugucccgcaagacauucgauaccgaauaucaaaaaacgaagaacaacgacugggacuacguugugacaaccgauaucucugagaugggcgcuaauuuuagagccgaccgggucauugaucccagacgcugccucaaaccggugauccugaaggacgggccugaacggguuauucuugccggccccaugcccgugacagucgcuagcgccgcgcagagacgcggacggaucggcagaaaccauaauaaggagggggaucaguacaucuauaugggacagccucugaacaaugacgaggaucacgcucacuggaccgaagccaaaaugcuccuggacaacauuaauacgcccgagggcaucauuccugcccuguucgaaccggagcgcgaaaaguccgcugccaucgauggggaguaccggcucagaggagaggcgcgcaaaaccuucguggaacuuaugagacggggcgaccugcccgucuggcugagcuauaagguggccucugagggguuucaauacuccgaucgcagauggugcuucgacggcgaacggaacaaucagguucucgaggaaaacauggauguggagauuuggacaaaagagggagaacgcaagaaacugagaccucgguggcuugacgcuagaaccuauagcgacccccuggcccuccgcgaguuuaaggaauucgcugccggccggagauccgugucuggggaucugauccuggagaucggaaagcucccucagcaucuuacacagcgcgcucaaaaugcccuggacaaccuggucaugcuccacaauagcgaacagggcgggcgggcguacagacaugccauggaggagcugcccgauaccauugaaacacuuaugcugcucgcucugaucgccguucugaccggaggcgugacgcucuuuuuccuuuccggccgggggcugggaaaaacaucuauuggccugcucugugugauggcuagcuccguccugcuuuggauggccagcguggagccgcacuggaucgccgcuucuauuauccuggaauuuuuccucaugguucugcugaucccugagcccgaccgccagagaaccccucaggauaaccaacucgcguauguggucauugggcuucuguuuaugauccugaccguggccgcuaaugagaugggacuccuggaaacaaccaagaaagaccuuggcauugggcacgucgccguggagaaccaucaccaugccacaaugcuggauguugaccuccaccccgcuuccgccuggacgcuguacgcgguggccaccacaaucauuaccccuaugaugcggcauacaaucgaaaacaccacggcuaauauuagccugaccgccaucgcuaaccaggccgcgauccucaugggacuugauaagggcuggcccauuucuaaaauggacaucggcgucccgcugcuggcccucgggugcuacucccaggugaauccucugacacuuaccgcugccguucugaugcucguggcucacuaugccauuaucggacccggccugcaagcuaaggccacacgcgaggcgcagaagagaaccgccgcugggauuaugaaaaaccccacggucgauggaaucguggccaucgaccuggauccugugguuuacgacgcuaaguucgaaaaacagcucggccagauuaugcuucugauccuguguacaagccaaauucuccugaugcggaccacaugggcccuuugcgagucuaucacccuggccaccgggccgcucacaacgcugugggagggaagccccggcaaguuuuggaauaccacaauugcggucuccauggcuaacaucuuccgcggcucuuaucuggccggggcuggacucgccuuuagccuuaugaaaucccugggcgggggaagacggggcaccggggcccagggagaaacacugggcgagaaguggaagcgccagcucaaucagcugagcaaauccgaauucaacaucuacaagagaucuggcauuauggagguggaccggagcgaagcuaaagaggggcuuaagagaggagagaccacgcgccacgccgugucccggggcacagcgaaacugagaugguucgucgaacgcaaucucguuaagccugaggggaaggugaucgaucugggauguggccgggggggauggucuuauuacugcgccggccugaaaaaggugaccgaagucaaaggcuauaccaaggggggacccggccaugaggaaccuauucccauggcuacauacggguggaaccucgugaaacuucacagcggaaaggacguuuuuuucaccccuccggagaaaugugauacacugcugugcgacaucggcgaguccucucccaauccuacgauugaagaggggagaacccuccgcgugcugaagauggucgaacccuggcuucggggaaaccaauuuuguaucaagauucugaauccuuacaugcccagcgugguugagacacucgagcagaugcagagaaaacauggcggcaugcuggugcgcaacccgcugucccggaauagcacccacgaaauguauugggucucuugcgggacaggaaacaucguguccgccgugaauaugaccagcagaaugcuccugaaccgcuucacgaugacccaccggaagccuacauacgagagagaugucgaccuuggcgcugggacccgccauguugccguggaacccgagguggcgaaccuggauaucauuggacagagaaucgaaaauauuaaacacgagcauaagucuacauggcacuaugacgaggauaaccccuacaaaaccugggccuaucauggcuccuacgaagucaagccuagcgggucugcuuccagcauggugaauggaguugugaagcuccugacaaaacccugggacgucaucccuauggugacccaaauugccaugacggauacaaccccguuuggccagcagcggguuuucaaggagaaaguggacacccgcacacccaaggcuaaaagaggcacggcccaaaucauggaagucaccgcucgguggcuuuggggguuucuguccagaaacaagaagccucggaucuguacacgcgaggaauucaccagaaaagugcggagcaaugccgcgauuggagccguuuuuguggacgagaaccaguggaauucugcuaaggaggccgucgaagaugagcgcuucugggaccucgugcagaaagaaagagagcugcacaagcagggcaaaugcgcuacaugcgucuauaacaugauggggaagcgggaaaagaaacugggagaguuuggcaaggccaaagggagccgcgccaucugguacauguggcucggcgcgagauuccuggaguuugaagcucuuggauucaugaaugaggaucacugguucucccgggaaaacucucugagcggcguggagggggagggacuccauaagcugggcuacauucuucgcgacaucuccaaaauucccgggggaaauauguaugccgaugacaccgccggcugggauacaagaaucaccgaagacgaucugcaaaacgaggcuaagaucacggacauuauggaaccugagcacgcccuccuggcuaccucuaucuuuaaacugacauaccagaauaagguugugcggguccagcgccccgccaagaacgggaccgugauggaugugauuagcagacgggaccagcgcggcuccggacaaguuggcacauaugggcucaauaccuucacgaacauggaagcgcagcugaucagacagauggagucugagggaauuuuucuuccgagcgaacuggagacaccuaaccucgccgaacgggugcuggauuggcuugagaaacauggcgucgaaagacugaagcgcauggcuaucuccggggacgacugugugguuaaacccaucgaugaccgguucgccaccgcucucacagcccugaaugauaugggaaaggugagaaaagacauuccucagugggagcccagcaagggcuggaacgauuggcaacaggucccuuuuugcucucaccacuuccaucagcugaucaugaaggacgggcgcgagauugugguccccugucggaaucaggaugaacucgugggcagagcgcgcguuucccaaggagccggcuggagccugcgggagaccgcuugccuugggaaaucuuacgcccagauguggcagcugauguauuuucacagacgcgaccuccggcuggcugccaacgcuaucuguuccgccgugccggucgauugggugccuacgagcagaaccacaugguccauucaugcgcaccaucaauggaugaccacagaagacaugcuuucuguuuggaaucgcguguggaucgaggaaaaccccuggauggaggauaagacccacgucagcuccuggggagacgugcccuaccugggcaaacgggaggaccaguggugcgggagccucauuggacugacagccagagcuaccugggccucuaauauccagguggccaucaaccagguucggagacugauuggcaaugaaaacuaucucgauuacaugacguccaugaagcgcuucaaaaaugagggggacccugaaggcgcucugugguga

SEQ ID NO: 19097 - RNA, 9879 nt, Artificial Sequence
  derived and/or modified CDS sequence (opt5) from DENV-1__GQ199838__SS-prME
agcgugaccaugcugcugaugcugaugcccaccgcccuugcuuuccaccugacgacccggggaggggagccucauaugaucgucacaaagcaggaacggggaaagucccugcuguuuaagaccucugccggcguuaacaugugcacacuuauugcgauggaccugggggagcucugugaagauaccaugacauacaagugcccccgcaucaccgaggcugaacccgacgauguggacuguuggugcaaugccacggauaccugggugacauauggaaccuguagccagacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcacccucguggauagaggcuggggcaauggguguggacuguuuggcaaagggagccuuauuacaugcgccaaguucaagugcgucacgaaacuggagggaaagaucgugcaguacgaaaaccucaaauauucuguuaucgugaccguccacacaggcgaccagcaucaaguggggaaugaguccaccgaacacggaacaaccgcuacgauuacaccccaggccccuacaagcgagauccagcugaccgacuacggcgcccugacacucgauuguucuccccggaccggccuggacuuuaacgaaaugguucuucugacgaugaaggagaaauccuggcucgugcauaagcagugguuccuggaucuuccucugcccuggacaagcggggcuuccaccucucaagagacauggaaucgccaggaccuccuggucaccuuuaaaaccgcgcacgccaagaagcaggaaguggucgugcugggaagccaagagggcgcuaugcacacagcccucacgggggccaccgaaauucagacauccggaaccacaaccaucuucgcuggccaucugaaaugcagacuuaagauggauaaacugacgcucaaggggaugagcuauguuauguguacaggcucuuuuaaacuggagaaggaaguggccgagacccagcacggaaccguccuggugcagauuaaguacgagggcacagacgcgccgugcaaaaucccuuucuccacccaagaugaaaaggggguuacacagaacggacggcuuaucacggcuaaucccauugugaccgacaaagagaagccugucaacaucgaagccgagccgcccuucggcgagagcuauauugugaucggggccggagaaaaagcucucaagcugucuugguuuaagaaaggcagcuccauugggaagauguucgaggccacagcuagaggcgcccgccggauggcgauccugggagauaccgccugggacuuuggcucuaucgggggaguguucacaagcguuggcaaacucguccaucagauuuuugggaccgcuuacggagugcuguucuccggcgugagcuggacgaugaagaucgggauuggcguccuucugaccuggcucggacucaauucuagauccacaagccugucuaugaccuguaucgccgugggccuuguuacacucuaccugggggugaugguccaggcugauuccggaugcgugauuaacuggaaaggccgcgaacugaagugugggagcggaaucuuuguuaccaaugaggugcacacauggaccgaacaauauaaguuccaggccgacuccccuaaacggcucucugcggccauuggcaaggcuugggaggagggggucugcggcaucagaagcgccacgcgccuggaaaacaucauguggaaacagauuuccaacgagcuuaaucauauccugcucgaaaacggaaugaaguuuacagugguugugggcgacgucguggggauucuggcucagggcaagaagaugauccggccgcaacccauggagcacaaauacucuuggaaaagcuggggcaaggccaagauuaucggggccgaugugcagaauaccaccuucaucauugacggaccuaacacacccgaauguccugaugaccagagagcuuggaauaucugggaggucgaggauuauggcuuuggcauuuucaccacgaacaucuggcugaaacuucgcgacuccuacacacagguuugcgaucaccggcucaugagcgcggccauuaaagacucuaaggcugugcaugccgauaugggguauuggaucgaauccgagaaaaaugaaaccuggaagcuggccagagcuagcuuuaucgaggugaagacauguauuuggcccaaaucucacacccugugguccaacggaguccucgaaagcgagaugaucauuccgaagaucuacggcgggccuauuucucaacauaauuaucgccccggauacuucacacagaccgccggcccuuggcaccuggggaaacuugagcuggacuucgaucucugcgaaggaacgaccgugguuguggacgagcacugcggcaaccggggccccagccugagaacaaccacagucaccgggaagaucauccaugaaugguguugccgguccuguacgcugccuccccuucgcuuuaaaggagaggauggcugcugguacgggauggagauuagaccggugaaggaaaaggaggaaaaucucguuaaaagcauggugucugcgggauccggcgaggucgacagcuucucccuggggcugcucuguacaucuaucaugauugaagaggugaugcggagcagauggucccgcaagaugcugaugaccggaacacuugcuguuuuucugcuccugaucaugggccagcugaccuggaacgaccuuauucggcugugcaucauggugggcgccaaugccucugauagaauggggaugggaaccacauaucucgcucugauggccacguucaaaaugcgcccuauguuugcggucggccuccuguucagacggcuuaccagccgcgaggugcugcuccugacaauugggcugucccuuguggcuucugucgaacugcccaacagccucgaggaacugggagacggccucgccauggggaucaugauccugaaacuucugaccgauuuucaaucccaccagcucugggccacacugcugagccuuaccuucauuaaaacgacacugucucuccauuacgcuuggaagaccauggccaugguucuguccaucgugagccucuuuccccugugucuuucuaccacaucccagaagaccacauggcugccugugcugcucggaagccugggcugcaaaccgcuuacgauguuccugauugcugagaauaagaucuggggcagaaaaucuuggccccucaacgaagggauuauggccgucggagugguuuccauccugcucagcucccugcuuaagaacgacgugccucuggcgggcccccugaucgccgggggaaugcucauugcuuguuaugucaucagcggcucuagcgccgaucugucccuugagaaagcugccgaggugucuugggaagaggaagccgagcacagcggggcuucccauaauauucugguugaagugcaggacgauggaaccaugaagaucaaagacgaggagcgggaugacacacucaccauucugcucaaggcgacacugcuugccgucucuggcguguacccucugagcauccccgcuacccuguuugucugguauuucuggcaaaagaaaaagcagcgcuccggcgugcucugggauacgccuucucccccggaaguugagagagccgugcuggacgaugggaucuaccggauuaugcagcgcggacuucugggcagaagccaggucggggugggaguuuuucaagaaaacguguuccacaccauguggcacgucacacggggcgccgugcucauguaucaggggaaacgccuggagccuuccugggcuagcgugaagaaagaccucaucucuuacggaggcggcuggagacugcagggguccuggaauaccggagaggaaguucaggucauugccguggagcccggcaagaacccuaagaaugugcaaacagcgcccgggaccuucaaaacaccggaaggagaggucggcgcuaucgcccuugacuuuaagccugggacgagcggaucucccauugugaaccgggaaggcaaaaucguuggccuguacgggaauggaguggucaccacauccggcaccuaugugagcgccauugcucaggccaaggcgucccaggaggggccucugcccgagaucgaagaugagguuuucagaaaacgcaaccucaccaucauggaccugcaucccggaucuggcaagacacggagauaccuuccugcuauugugcgcgaagccaucaagcggaaacugagaacgcucauucuggccccgacccgcgucguggcuagcgagauggccgaagcucugaaggggaugcccauccgguaucaaacaaccgccguuaaauccgagcacacaggcaaggagauuguggaucucaugugccaugcgaccuuuacgaugagacuucugagcccuguccgcgugcccaauuacaacaugaucaucauggacgaagcccacuucacagauccuucuuccauugcugcccggggauauaucagcaccagagugggcaugggggaggcugccgccauuuuuaugaccgcuacacccccuggaucugucgaagcguucccgcagagcaaugccguuauccaggacgaggaacgggauauucccgagcgcuccuggaacucuggcuacgaguggaucaccgacuuuccugggaaaacagugugguucgugcccagcaucaaguccggaaaugauauugcuaacugucugagaaagaauggcaaacgggucauccagcucucucgcaagaccuuugacacggaauaucagaagaccaagaacaacgauugggacuacgugguuaccacagacauuagcgagaugggggccaauuucagagccgaucgggugaucgacccuagacgcugccugaaacccgucauucuuaaggauggcccggaacgggugauccuggcuggaccuaugcccguuaccguggccuccgcggcucagagacgcggccggauugggagaaaccauaauaaggagggagaccaguacaucuauaugggccagccccucaacaaugaugaggaccacgcccacuggacggaagccaaaaugcugcuggauaacaucaauaccccugaggggauuauccccgcucucuuugaaccugagcgcgaaaagagcgccgcgauugacggagaguaccggcuuagaggcgaggcccgcaaaacauucgucgaacugaugagaagaggggaucugccgguguggcucucuuauaaggucgcuuccgagggcuuccaauacagcgaccgcagauggugcuuugauggagaacggaacaaucaggugcuggaggaaaacauggacguugagaucuggaccaaagagggcgaacgcaagaaacuuagaccccgguggcuggaugccagaacauauuccgacccucucgcucugcgcgaguucaaggaauuugccgcugggcggagaucugugagcggagaccugauucucgagaucggcaaacuuccccagcaucugacccagcgcgcccaaaaugcgcuggauaaccucgugaugcugcacaauuccgaacaagggggacgggccuacagacaugcuauggaggagcuuccugacacaaucgaaacccugaugcuccuggcccugauugcuguccucacgggcggcguuacacuuuucuuucugucugggcggggacugggcaaaaccagcaucgggcuccugugugugauggccuccagcgugcuucuguggauggccucugucgagccccacuggauugcugcguccaucauucucgaguucuuucugauggugcugcucaucccggagccugaucgccagagaacaccccaggacaaccaacuugccuauguugugaucggacugcuguucauuauccucacagucgcugccaaugagaugggccugcuugaaaccacaaagaaagaucuggggauuggacacguggccgucgagaaccaucaccaugcuacgaugcucgacguggaucugcacccugccagcgcguggacccuguacgccguugcuacaaccaucauuacacccaugaugcggcauaccaucgaaaacacgaccgccaauauuucucucacagcuaucgccaaccaggcggccauccuuaugggccuggacaagggcuggccuauuuccaaaauggauaucggggugccccugcucgcucugggaugcuacagccaggucaauccgcuuacccugacagccgcugugcucaugcugguugcccacuaugcuauuaucggcccugggcugcaagccaaggcgacccgcgaggcccagaagagaacggcugccggaauuaugaaaaaccccacaguggacggcaucgucgcuaucgaucucgaccccgugguguacgaugccaaguuugaaaaacagcuugggcagauuaugcugcugauccucuguaccucucaaauucugcuuaugcggacaaccugggcccugugcgagagcaucacccucgcgacaggaccucugacgacccugugggagggcuccccgggcaaguucuggaauacaaccauugcuguuucuauggccaacaucuuucgcgggagcuaucucgcuggagccggccuugccuucucccugaugaaaagccucgggggaggcagacgggggacaggagcucagggcgaaacccucggcgagaaguggaagcgccagcugaaucagcuuuccaaaucugaauuuaacaucuacaagagaagcgggauuauggaggucgaccgguccgaagccaaagagggacugaagagaggcgagacgacacgccacgcggugucucgggggaccgccaaacucagaugguucguggaacgcaaucuggucaagcccgagggaaagguuaucgaccugggcugugggcggggaggcuggagcuauuacugcgcuggccucaaaaaggugaccgaagugaaaggguauacaaagggaggcccugggcaugaggaacccauuccuauggccaccuacggauggaaccuugucaaacugcacuccggcaaggauguguucuuuacacccccugagaaaugugacacgcugcucugcgauaucggggagucuagcccgaaucccaccauugaagagggaagaacacugcgcguucuuaagaugguggaaccuuggcugcggggcaaccaauucuguaucaagauucucaaucccuacaugccuuccgucguggagacccuggagcagaugcagagaaaacauggcgggaugcugguucgcaacccccucagcagaaauucuacacacgaaauguauuggguguccugcggaaccggcaacaucgucagcgcugugaauaugacgucuagaaugcugcuuaaccgcuuuaccauggcccaccggaagccgacauacgagagagacguggaucugggggcgggaacccgccaugucgccguugaaccugagguggcuaaccucgacaucauuggccagagaaucgaaaauauuaaacacgagcauaaguccacauggcacuaugaugaggacaaccccuacaaaaccugggccuaucaugggagcuacgaagugaagcccucuggauccgcuagcuccauggucaauggcgugguuaagcugcuuacaaaaccuugggaugugauccccauggucacccaaauugccaugacggacacaaccccuuucggccagcagcggguguuuaaggagaaaguugauacccgcacaccgaaggcuaaaagagggacggcccaaaucauggaagugaccgcgcgguggcuguggggauuccucagcagaaacaagaagccccggaucuguacacgcgaggaauuuaccagaaaaguccggucuaaugccgcuauuggcgccguguucguugacgagaaccaguggaauagcgcuaaggaggccguggaagacgagcgcuuuugggaucugguccagaaagaaagagagcugcacaagcaggggaaaugcgccacaugcguguauaacaugaugggaaagcgggaaaagaaacucggcgaguucgggaaggcgaaaggcucccgcgcuaucugguacauguggcugggagccagauuucuugaguucgaagcccugggcuuuaugaaugaggaccacugguucucucgggaaaacagccucuccggggucgagggagagggccugcauaaacuuggguacauucugcgcgauaucucuaaaauuccuggaggcaauauguaugcugacgauaccgccgggugggacacaagaaucaccgaagaugaccuccaaaacgaggcuaagaucacggauauuauggaacccgagcacgcccugcuggcgaccagcaucuucaaacucacauaccagaauaaggugguucgggugcagcgcccugccaagaacggcaccgucauggacgugauuuccagacgggaucagcgcggaucuggccaaguggggacauauggacugaauaccuuuacgaacauggaagcucagcuuaucagacagauggagagcgagggcauuuuccugcccuccgaacucgagacaccgaaccuggccgaacggguucuugacuggcuggagaaauacgggguggaaagacucaagcgcauggcuaucagcggagaugacugugucgugaaaccuaucgacgaucgguuugccaccgcgcugacagcccugaaugacaugggcaagguuagaaaagauauuccccagugggagccuucuaagggguggaacgacuggcaacaggugcccuucugcucccaucacuuucaccagcucaucaugaaggauggccgcgagauugucgugccuugucggaaucaggacgaacuggucggacgggcucgcgugagccaaggcgccggguggucucuucgggagaccgcuugccugggaaaauccuaugcccagauguggcagcucauguacuuccauagacgcgaucugcggcuugcugccaacgcgaucuguagcgccguucccguggacugggucccgacguccagaaccacauggucuauucacgcucaucaccaauggaugaccacagaagauaugcugagcguguggaaucgcguuuggaucgaggaaaacccuuggauggaggacaagacccauguguccagcuggggcgauguccccuaucucgggaaacgggaggaccaguggugcggaucucugauuggccugacagccagagccaccugggcuuccaauauccagguggccaucaaccaggugcggagacucauugggaaugaaaacuaccuggacuacaugacgagcaugaagcgcuuuaaaaaugagggcgaucccgaaggagcgcuuugguga

SEQ ID NO: 19098 - RNA, 9879 nt, Artificial Sequence
  derived and/or modified CDS sequence (opt5) from DENV-1__FJ898396__SS-prME
agcgugaccaugcugcucaugcugaugcccaccgcccuugcuuuccaccugacgaccagaggcggggagccucauaugaucgugaccaagcaggaacggggaaaaucccuccuguuuaagaccucugccggcguuaauaugugcacccuuauugcgauggaccugggggagcucugugaagauaccaugacauacaaaugcccccgcaucaccgaggcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuuguuacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaggaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacguccagaauaccaccuuuaucaucgaugggccuaacacacccgaauguccugacgaucagagagcuuggaauauuugggagguugaggacuauggauucggcaucuuuaccacgaacauuuggcugaagcugcgcgauuccuacacacaggugugcgaccaccggcuuaugagcgcggccaucaaagauucuaaggcugugcaugccgacaugggcuauuggauugaauccgagaaaaaugaaaccuggaagcucgccagagcuagcuucaucgaggucaagacauguaucuggcccaaaucucacacccugugguccaacggggugcuggaaagcgagaugauuaucccgaagauuuacggaggcccuaucucucaacauaauuaucgccccggguacuucacacagaccgccggaccuuggcaccucggcaaacuggagcuugauuuugaccugugcgaagggacgaccguuguggucgaugagcacugcggaaaccggggccccagccucagaacaaccacagugaccggcaagauuauccaugaaugguguugccgguccuguacgcugccuccccugcgcuucaaaggggaggacggaugcugguacggcauggagaucagaccgguuaaggaaaaggaggaaaaucuugugaaaagcauggucucugcgggguccggagagguggacagcuuuucccucggccugcuguguauuucuaucaugauugaagagguuaugcggagcagauggucccgcaagaugcucaugacagggacccuggcuguguuccuucugcucaucaugggacagcugacauggaacgaucugauucggcuuugcaucauggucggcgccaaugccucugacagaaugggcauggggaccaccuaucuggcucucauggccacauuuaaaaugcgcccuauguucgcggugggacugcucuuuagacggcugacgagccgcgaggugcuucugcucaccauuggccugucccuggucgcuucuguugaacuucccaacagccuggaggaacucggggauggacuggccaugggcaucaugauccucaagcugcuuacagacuuccaaucccaccagcugugggccacccuccugagccugacauuuauuaaaaccacgcuuucucugcauuacgcuuggaagacaauggccauggugcucuccaucgcuagccuguucccccucugucugucuaccaccucccagaagacaaccuggcuuccugugcugcuggggagccucggaugcaaaccgcugacaauguuucuuauuacggagaccaagaucuggggcagaaaaucuuggccccugaaugaaggcauuauggccgucggggugguuuccauccuccugagcucccuccugaagaacgaugugccucuugcgggaccccugaucgccggcgggaugcugauugcuuguuaugucaucagcggaucuagcgccgaccucucccuggagaaagcugccgaggugucuugggaagaggaagccgagcacagcggcgcuucccauaacauucuuguugugguccaggaugacgggacaaugaagaucaaagaugaggaacgggacgauacccugacaauucuccugaaggcgacccuccuggccgugucuggagucuacccucuuagcauccccgcuacgcuguucgugugguauuuuuggcaaaagaaaaagcagcgcuccggcguucugugggacaccccuucucccccggagguggaaagagccguccucgaugacggcaucuaccggauuaugcagcgcgggcugcuuggaagaagccaggugggcguugggguguuccaagagaaugucuuccacacaauguggcacgugacccggggagccgugcugauguaucagggcaaacgccucgaaccuuccugggcuagcguuaagaaagaccugaucucuuacgggggaggcuggagacuccagggcuccuggaacacaggggaggagguccaggugauugccguggaacccggaaagaauccuaagaacguccaaaccgcgcccggcacauuuaaaacgccggagggggaagugggagcuaucgcccuggauuucaagccuggcaccagcgggucucccauuguuaaucgggagggaaaaaucgugggccuuuacggcaacggggucgugacaaccuccggaaccuauguuagcgccauugcucaggccaaggcgucccaggaaggcccucugcccgagaucgaggacgaaguguuuagaaaacgcaaucugacaaucauggaucuccaucccgggucuggaaagacgcggagauaccugccugcuauuguccgcgaggccaucaagcggaaacuuagaacccugauucucgccccgacacgcgugguugcuagcgaaauggccgaggcucugaagggcaugcccauccgguaucaaaccacagccgugaaauccgaacacaccgggaaggagauugucgaccugaugugccaugcgacguucacaaugagacuccuuagcccugugcgcgugcccaacuacaauaugaucaucauggaugaggcccacuuuaccgacccuucuuccauugcugcccggggcuauaucagcaccagagucggaaugggcgaagcugccgccauuuucaugacagcuacacccccugggucuguugaggcguuuccgcagagcaacgccgugauccaggaugaggaacgggacauucccgaacgcuccuggaacucuggauacgaguggaucacagauuucccuggcaaaaccgugugguuuguccccagcaucaaguccgggaacgacauugcuaauugucugagaaagaacggaaaacgggugauccagcugucucgcaagacguucgauacagaguaucagaagaccaagaauaacgacugggacuacguugugacaaccgauauuagcgaaaugggcgccaacuuuagagccgaccgggucaucgauccuagacgcugccucaaacccgugauucugaaggacgggccggagcggguuauccuugcuggcccuaugcccgugacggucgccuccgcggcucagagacgcggacggauuggcagaaaucauaacaaggaaggggaucaguacaucuauaugggacagccccugaauaacgacgaggaucacgcccacuggaccgaggccaaaaugcuccuggacaauaucaacacaccugaaggcauuauccccgcucuguucgagccugaacgcgaaaagagcgccgcgauugauggggaauaccggcucagaggagaggcccgcaaaaccuucguggagcuuaugagacggggcgaccugccggucuggcugucuuauaagguggcuuccgaaggguuucaauacagcgaucgcagauggugcuucgacggcgagcggaauaaccagguucucgaagagaauauggauguggaaaucuggacaaaagagggagagcgcaagaaacugagaccccgguggcuugacgccagaaccuauuccgacccucuggcucuccgcgaauuuaaggaguucgccgcuggccggagaucugugagcggggaucugauucuggaaaucggaaagcucccccagcaucuuacacagcgcgcccaaaacgcgcuggacaaucuggucaugcuccacaacuccgagcagggcgggcgggccuacagacaugcuauggaggaacugccugauaccaucgagacgcuuaugcugcucgcccugauugcuguucugacaggaggcgugacccucuuuuuccuuucuggccgggggcugggaaaaaccagcaucggccugcucugugugauggccuccagcguccugcuuuggauggccucuguggaaccccacuggauugcugcguccaucacacuggaguuuuuccucaugguucugcugauuccggaaccugaccgccagagaacaccccaggauaaucaacucgccuauguggucaucgggcuucuguuuaugauccugacaguggcugccaacgagaugggacuccuggagacgaccaagaaagaccuuggcauugggcacgucgccguggaaaaucaucaccaugcuacaaugcuggauguugaccuccacccugccagcgcguggacccuguacgccguggcuacaaccaucauuacgcccaugaugcggcauaccaucgagaacacaaccgccaacauuucucugacagcuaucgccaaucaggcggccauucucaugggacuugauaagggcuggccuaucuccaaaauggacaucggcgucccccugcuggcucucgggugcuacagccaggugaacccgcugacccuuacggccgcuguucugaugcucguggcccacuaugcuauuaucggaccuggccugcaagccaaggcgacacgcgaagcccagaagagaaccgcugccgggauuaugaaaaaucccacagucgauggaaucguggcuauugaccuggaucccgugguuuacgacgccaaguucgagaaacagcucggccagaucaugcuucugauccuguguaccucucaaauucuccugaugcggaccacaugggcccuuugcgaaagcaucacgcuggcgaccgggccucucacaacccugugggagggauccccgggcaaguuuuggaacacaaccauugcugucucuauggccaauaucuuccgcggcagcuaucuggcuggggccggacucgccuuuucccuuaugaaaagccugggcgggggaagacggggcacgggggcucagggagagacacugggcgaaaaguggaagcgccagcucaaccagcuguccaaaucugaguucaauauuuacaagagaagcggcaucauggaaguggaccgguccgaggccaaagaagggcuuaagagaggagagaccacccgccacgcggugucucggggcacagccaaacugagaugguucgucgagcgcaaccucguuaagcccgaagggaaggugaucgaucugggauguggcagagggggauggagcuauuacugcgcuggccugaaaaaggugaccgaggucaaaggcuauacaaaagggggaccuggccaugaggagcccauuccuauggccacguacggguggaaucucgugaaacuucacuccggaaaggacgucuuuuucacacccccugaaaaaugugauacacugcugugcgacaucggcgagucuagcccgaaccccaccauugaggaagggagaacacuccgcgugcugaagauggucgagccuuggcuucggggaaaucaauuuuguaucaagauucugaaccccuacaugccuuccgugguugaaacccucgagcagaugcagagaaaacauggcggcaugcuggugcgcaauccccugagccggaacucuacgcacgagauguauugggucuccugcgggaccggaaauaucgugagcgcugugaacaugacaucuagaaugcuccugaaucgcuucaccauggcccaccggaagccgacauacgaaagagaugucgaccuuggcgcggggacccgccauguugccguggagccugaaguggcuaaccuggauauuaucggacagagaaucgagaacauuaaacacgaacauaaguccacauggcacuaugacgaggauaaucccuacaaaaccugggccuaucauggcagcuacgaggucaagcccucuggguccgcuagcuccauggugaacggaguugugaagcuccugacgaaaccuugggacgucauccccauggugacacaaauugccaugaccgauaccacaccuuuuggccagcagcggguuuucaaggaaaaaguggacacgcgcaccccgaaggcuaaaagaggcacagcccaaaucauggaggucaccgcgcgguggcuuuggggguuucugagcagaaauaagaagccccggauuuguacacgcgaagaguucaccagaaaagugcggucuaacgccgcuaucggagccguuuuuguggacgaaaaucaguggaacagcgcuaaggaggccgucgaggaugaacgcuucugggaccucgugcagaaagagagagaacugcacaagcagggcaaaugcgccacaugcgucuauaauaugauggggaagcgggagaagaaacugggagaauuuggcaaggcgaaagggucccgcgcuaucugguacauguggcucggcgccagauuccuggaguuugaggcccuuggauucaugaacgaagaucacugguucucucgggagaauagccuguccggcguggaaggggagggacuccauaagcugggcuacauucuucgcgacaucucuaaaauuccugggggaaacauguaugcugaugacaccgccggcugggauacgagaaucaccgaggacgaucugcaaaaugaagcuaagauuacagacaucauggagcccgaacacgcccuccuggcgaccagcaucuuuaaacugacauaccagaacaagguugugcggguccagcgcccugccaagaaugggaccgugauggaugugauuuccagacgggaccagcgcggcucuggacaaguuggcacguaugggcucaacacauucaccaauauggaggcucagcugaucagacagauggaaagcgagggaauuuuucuucccuccgagcuggaaacaccgaaccucgccgagcgggugcuggauuggcuugaaaaauacggcgucgagagacugaagcgcauggcuaucagcggggacgacugugugguuaaaccuauugaugaccgguucgccaccgcgcucacggcccugaacgauaugggaaaggugagaaaagacaucccccagugggaaccuucuaagggcuggaaugauuggcaacagguccccuuuugcucccaucacuuccaccagcugaucaugaaggacgggcgcgagauuguggucccuugucggaaccaggaugagcucgugggcagagcucgcguuagccaaggagccggcuggucucugcgggaaaccgcuugccuugggaaauccuaugcccagauguggcagcugauguacuuucauagacgcgaccuccggcuggcugccaaugcgaucuguagcgccgugcccgucgauugggugccgacauccagaaccacauggucuauucacgcucaucaccaauggaugaccacagaggacaugcuuagcguuuggaaccgcguguggaucgaagagaauccuuggauggaagauaagacccaugucuccagcuggggagacgugcccuaucugggcaaacgggaggaccaguggugcgggucucucauuggacugacggccagagccacaugggcuuccaacauccagguggccauuaaucagguucggagacugaucggcaacgagaauuaccucgauuacaugaccagcaugaagcgcuucaaaaacgaaggggaccccgagggcgcgcugugguga

SEQ ID NO: 19099 - RNA, 9879 nt, Artificial Sequence
  derived and/or modified CDS sequence (opt5) from DENV-1__GQ199839__SS-prME
agcgugaccaugcugcugaugcugaugcccaccgcccuugcuuuccaccugacgaccagaggaggggaaccucauaugaucgucacaaagcaggaacggggaaagucccuccuguuuaagaccucugccggaguuaacaugugcacccuuauugccauggaccugggggagcucugugaagauaccaugacauacaaaugcccccgcaucaccgaggcugaacccgacgauguggacuguuggugcaaugccacggauaccugggugacauauggaaccuguagcagaacaggcgagcaccggcgcgacaagagauccgucgcccuggcuccucauguggggcugggacucgagacccggacggaaacauggaugucuagcgagggcgccuggaaacaaauucagcgcguugaaaccugggcucugagacaccccggcuucacagugaucgcccuuuuucuggcgcaugccauugggaccuccaucacccagaagggaaucauuuucauccuccugaugcuugucacaccuucuauggcuaugcggugcgugggcauugggagccgcgauuuuguugagggacuguccggcgccacguggguggacgucgugcucgagcacgggagcugugugaccacaauggcuaaggauaaacccacccuggacaucgaacugcucaagacagaggucaccaacccugccguucugagaaaacuuugcauugaagcgaagaucucuaauacgacaaccgauucccgguguccgacccagggagaggccacacugauggaagaacaagacgcuaacuucgugugccgcagaaccuuuguggaucggggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucagguggggaaugaguccaccgaacacggaacaaccgcuacgauuacaccccaagccccuacaagcgagauccagcucaccgacuacggcgcccugacacuggauuguucuccccgcaccggccucgacuucaacgaaaugguucugcuuacgaugaaggagaaauccuggcuggugcauaagcagugguuucucgaucugccucuucccuggacaagcggggcuuccaccucucaggagacauggaauagacaagaccugcucgucaccuucaaaaccgcgcacgccaagaagcaggaaguggucgugcugggaagccaggagggcgcuaugcacacagcccugacgggggccaccgaaauucaaacauccggaaccacaaccaucuuugcuggccaucucaaaugccggcugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaggaugaaaaggggguuacacaaaacggaagacugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcucgcggcgcccggagaauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucucgcuccacaagccugucuaugaccuguaucgccgugggccugguuacacuuuaccucggggugaugguccaggcugauuccggaugcgugauuaacuggaaaggccgggaacugaagugugggagcggaaucuucguuaccaaugaggugcacacauggaccgaacaguauaaguuucaagccgacuccccuaaaagacugucugcggccauuggcaaggcuugggaggagggggucugcggcauccgcagcgccacgcggcucgaaaacaucauguggaaacagauuuccaacgagcugaaucauauccuucuggaaaacggacucaaguucacagugguugugggcgacgucguggggauucuggcucagggcaagaagaugaucagaccgcagcccauggagcacaaauacucuuggaaaagcuggggcaaggccaagauuaucggggccgaugugcaaaauaccaccuuuaucauugacggaccuaacacacccgaauguccugaugaccagcgcgcuuggaauaucugggaggucgaggauuauggcuucggcauuuuuaccacgaacaucuggcugaaacuucgggacuccuacacacagguuugcgaucacagacucaugagcgcggccauuaaagacucuaaggcugugcaugccgauaugggguauuggaucgaauccgagaaaaaugaaaccuggaagcuggcccgcgcuagcuucaucgaggugaagacauguauuuggcccaaaucucacacccugugguccaacggaguccucgaaagcgagaugaucauuccgaagaucuacggcgggccuauuucucagcauaauuaucggcccggauacuucacacaaaccgccggcccuuggcaccuggggaaacuugagcuggacuuugaucucugcgaaggaacgaccgugguuguggacgagcacugcggcaacagaggccccagccugcggacaaccacagucaccgggaagaucauccaugaaugguguugccgcuccuguacgcugccuccccuuagauucaaaggagaggauggcugcugguacgggauggagauucggccggugaaggaaaaggaggaaaaucucguuaaaagcauggugucugcgggauccggcgaggucgacagcuuuucccuggggcugcucuguacaucuaucaugauugaagaggugaugagaagccgcuggucccggaagaugcugaugaccggaacacuugcuguuuuccugcuccugaucaugggccagcugaccuggaacgaccuuauuagacugugcaucauggugggcgccaaugccucugaucgcauggggaugggaaccacauaucucgcucugauggccacguuuaaaaugagaccuauguucgcggucggccuccuguuucggcgccuuaccagcagagaggugcugcuccugacaauugggcugucccuuguggcuucugucgaacugcccaacagccucgaggaacugggagacggccucgccauggggaucaugauccugaaacuucugaccgauuuccagucccaccaacucugggccacacugcugagccuuaccuuuauuaaaacgacacugucucuccauuacgcuuggaagaccauggccaugguucuguccaucgugagccucuucccccugugucuuucuaccacaucccagaagaccacauggcugccugugcugcucggaagccugggcugcaaaccgcuuacgauguuucugauugcugagaauaagaucuggggccggaaaucuuggccccucaacgaagggauuauggccgucggagugguuuccauccugcucagcucccugcuuaagaacgacgugccucuggcgggcccccugaucgccgggggaaugcucauugcuuguuaugucaucagcggcucuagcgccgaucugucccuugagaaagcugccgaggugucuugggaagaggaagccgagcacagcggggcuucccauaauauuuucguugaagugcaggacgauggaaccaugaagaucaaagacgaggagcgcgaugacacacugaccauucuccugaaggcgacacuccuggccgucucuggcguguacccucuuagcauccccgcuacccuguuugucugguauuucuggcagaagaaaaagcaaagauccggcgugcugugggauacgccuucucccccggaaguugagcgggccgcccucgacgaugggaucuaccgcauuaugcagagaggacugcuuggccggagccaggugggggucggaguguuccaggaaaacguuuuucacaccauguggcacgugacacgcggcgcuguccugauguaucaagggaaaagacucgagccuuccugggccagcgugaagaaagaccugaucucuuacggaggcggcuggcggcuccagggguccuggaauaccggagaggaagugcagguuauugcggucgagcccggcaagaacccuaagaaugugcagacagcucccgggaccuucaaaacaccggaaggagaggugggcgccaucgcccuggacuuuaagccugggacgagcggaucucccauugucaacagagaaggcaaaaucgugggccuuuacgggaauggaguugugaccacauccggcaccuaugucagcgcuauugcccaaaccaaggcgucccaggaggggccucugcccgagaucgaagaugagguguuccgcaaacggaaccugacaaucauggaccuccaucccggaucuggcaagacgagacgcuaccugccugcuauuguucgggaagccaucaagagaaaacuucgcacccugauucucgccccgacacggguggucgcuagcgagauggccgaagcucugaaggggaugcccaucagauaucagaccacagccgugaaauccgagcacaccggcaaggagauuguugaucugaugugccaugcgacguuuacaaugcgccuccuuagcccugugcggguccccaauuacaacaugaucaucauggacgaagcccacuucaccgauccuucuuccauugcugccagaggauauaucagcacccgggugggcaugggggaggcugccgccauuuuuaugacagcuacacccccuggaucuguggaagcguucccgcaaagcaaugccgucauccaggacgaggaacgcgauauucccgagagauccuggaacucuggcuacgaguggaucacagacuuuccugggaaaaccguuugguucgugcccagcaucaaguccggaaaugauauugcuaacugucugcggaagaauggcaaacgcgugauccagcugucuagaaagacguuugacacagaauaucagaaaaccaagaacaacgauugggacuacgucgugacaaccgacauuagcgagaugggggccaauuuccgggccgauagaguuaucgacccucgccggugccucaaacccgugauucugaaggauggcccggaaagagucauccuugcuggaccuaugcccgugacgguugccuccgcggcucaacgccggggcagaauugggcgcaaccauaauaaggagggagaccaguacaucuauaugggccagccccugaacaaugaugaggaccacgcccacuggaccgaagccaaaaugcuccuggauaacaucaauacaccugaggggauuauccccgcucuguucgaaccugagcgggaaaagagcgccgcgauugacggagaguacagacuccgcggcgaggccagaaaaaccuuuguggaacuuaugcggcgcggggaucugccggucuggcugucuuauaagguggcuuccgagggcuuccaguacagcgacagacgguggugcuuugauggagaacgcaacaaucaaguccucgaggaaaacauggacguggagaucuggacaaaagagggcgaaagaaagaaacugcggcccagauggcuugaugcccgcaccuauuccgacccucuggcucuccgggaguucaaggaauuugccgcugggagacgcucuguuagcggagaccugauucuggagaucggcaagcucccccagcaucuuacacagcgggcccagaaugcgcuggauaaccuggugaugcuccacaauuccgaacaagggggcagagccuaccggcaugcuauggaggagcugccugacaccaucgaaacgcuuaugcugcucgcccugauugcugugcugacaggcggcgucacccucuucuuucuuucugggcgcggacugggcaaaaccagcaucgggcugcucuguguuauggccuccagcgugcugcuuuggauggccucuguggagccccacuggauugcugcguccaucauucuggaguucuuucucaugguccugcugaucccggagccugauagacagcggacaccccaggacaaccagcucgccuaugugguuaucggacuucuguucauuauccugaccguggcugccaaugagaugggccuccuggaaacaacgaagaaagaucuugggauuggacacgucgccguggagaaccaucaccaugcuaccaugcuggacgucgaucuccacccugccagcgcguggacacuguacgccguggcuaccacaaucauuacccccaugaugcgccauacgaucgaaaacaccacagccaauauuucucugaccgcuaucgccaaccaagcggccauccucaugggccuugacaagggcuggccuauuuccaaaauggauaucgggguuccccugcuggcucucggaugcuacagccaggugaauccgcugacacuuaccgccgcuguccugaugcucguggcccacuaugcuauuaucggcccugggcugcaggccaaggcgacgagagaggcccaaaagcggacagcugccggaauuaugaaaaaccccaccguugacggcaucguggcuaucgaucuggaccccgucguguacgaugccaaguuugaaaaacagcucgggcagauuaugcuucugauccuguguacaucucagauucuccugaugcgcaccaccugggcccuuugcgagagcaucacacuggcgacgggaccucucaccacacugugggagggcuccccgggcaaguucuggaauaccacaauugcugugucuauggccaacaucuuuagagggagcuaucuggcuggagccggccucgccuucucccuuaugaaaagccucgggggaggccggcgcgggaccggagcucaaggcgaaacgcugggcgagaaguggaagagacagcucaaucagcuguccaaaucugaguucaacaucuacaagcggagcgggauuauggagguugacagauccgaagccaaagagggacuuaagcgcggcgagacaacccggcacgcggucucuagagggaccgccaaacugcgcugguuuguggaacggaaucucgugaagcccgagggaaaggucaucgaccugggcugugggagaggaggcuggagcuauuacugcgcuggccugaaaaagguuacagaagugaaaggguauaccaagggaggcccugggcaugaggaacccauuccuauggccacauacggauggaaccucgugaaacuucacuccggcaaggaugucuucuuuacgcccccugagaaaugugacacccugcugugcgauaucggggagucuagcccgaaucccacaauugaagagggacgcacccuccgggugcugaagaugguugaaccuuggcuuagaggcaaccaguucuguaucaagauucugaaucccuacaugccuuccguggucgagacacucgagcaaaugcagcgcaaacauggcgggaugcuggugcggaacccccugagcagaaauucuacccacgaaauguauuggguuuccugcggaacgggcaacaucgugagcgcugucaauaugaccucucgcaugcuccugaaccgguuuacaauggcccacagaaagccgaccuacgagcgcgacguggaucuuggggcgggaacaagacauguggccgucgaaccugagguugcuaaccuggacaucauuggccagcggaucgaaaauauuaaacacgagcauaaguccaccuggcacuaugaugaggacaaccccuacaaaacaugggccuaucaugggagcuacgaagugaagcccucuggauccgcuagcuccauggugaauggcgucgugaagcuccugaccaaaccuugggauguuauccccauggugacgcagauugccaugacagacaccaccccuuucggccaacagcgcgucuuuaaggagaaaguggauacaagaacgccgaaggcuaaacgggggaccgcccagaucauggaaguuacagcgagauggcuuuggggauuccugagccggaacaagaagccccgcaucuguaccagagaggaauuuacacggaaagugcgcucuaaugccgcuauuggcgccgucuucguggacgagaaccaauggaauagcgcuaaggaggccguugaagacgagagauuuugggaucucgugcagaaagaacgggagcugcacaagcaggggaaaugcgcgaccugcgucuauaacaugaugggaaagcgcgaaaagaaacugggcgaguucgggaaggcgaaaggcuccagagcuaucugguacauguggcucggagcccgguuucuggaguucgaagcccuuggcuucaugaaugaggaccacugguuuucucgcgaaaacagccuguccgggguggagggagagggccuccauaagcugggguacauucuuagagauaucucuaaaauuccuggaggcaauauguaugcugacgauacagccgggugggacacccggaucacggaagaugaccugcagaacgaggcuaagaucaccgauauuauggaacccgagcacgcccuccuggcgacaagcaucuucaaacugaccuaccaaaauaaggucgugcgcguucagagaccugccaagaacggcacagugauggacgucauuucccggcgcgaucagagaggaucuggccagguggggaccuauggacucaauacguuuacaaacauggaagcucaacugauccggcagauggagagcgagggcauuuuccuucccuccgaacuggagaccccgaaccucgccgaaagagugcuggacuggcuugagaaauacgggguugaacgccugaagcggauggcuaucagcggagaugacuguguggucaaaccuaucgacgauagauuugccacagcgcucaccgcccugaaugacaugggcaaggugcgcaaagauauuccccagugggagccuucuaagggguggaacgacuggcagcaaguucccuucugcucccaucacuuucaccagcugaucaugaaggauggccgggagauuguggucccuuguagaaaucaggacgaacucgugggacgcgcucgggucagccagggcgccggguggucucugagagagacggcuugccuuggaaaauccuaugcccaaauguggcagcugauguacuuccaucgccgggaucucagacuggcugccaacgcgaucuguagcgccgugcccguugacugggugccgaccucccgcacaaccuggucuauucacgcucaucaccaguggaugacaaccgaagauaugcuuagcgucuggaaucggguguggaucgaggaaaacccuuggauggaggacaagacacauguuuccagcuggggcgaugugcccuaucuggggaaaagagaggaccaauggugcggaucucucauuggccugaccgcccgggccacgugggcuuccaauauccaggucgccaucaaccaggugagacgccugauugggaaugaaaacuaccucgacuacaugacaagcaugaagcgguuuaaaaaugagggcgaucccgaaggagcgcugugguga

SEQ ID NO: 19100 - RNA, 9879 nt, Artificial Sequence
  derived and/or modified CDS sequence (opt5) from DENV-1__FJ898397__SS-prME
agcgugaccaugcugcugaugcugaugcccacagcccuugcuuuccaccugacgaucagaggcggggaaccucauaugauugucuccaagcaggaacggggaaaaucucuccuguuuaagaccagcgccggcguuaacaugugcacacuuaucgcgauggaccugggggaguucugugaagauaccaugacauacaaaugcccgagaauuaccgaggcugaacccgacgauguggacuguuggugcaaugccacagauaccugggugacguauggaaccuguucccaaacaggcgagcacagacgggacaagcgcucuguugcccucgcuccucauguggggcugggacuggagaccagaacagaaaccuggaugagcuccgagggcgccuggaaacagauccagcggguugaaacgugggcucuccgccaccccggcuuuacagugauugcccuguuccuugcgcaugccaucgggaccucuaucacacagaagggaauuaucuuuauucugcucaugcuggucaccccuagcauggcuaugagaugcgugggcaucgggucccgggauuucguugagggacuuagcggcgccaccuggguggacgucgugcuggagcacgggucuugugugacaacgauggcuaaggauaaacccacccucgacauugaacugcugaagacagaggucaccaacccugccguucuccgcaaacugugcaucgaagcgaagauuuccaauacaaccacggauagcagauguccgacacaaggagaggccacccuuguggaagaacaagacgcuaacuuugugugccggcgcaccuucgucgauagaggcuggggcaauggguguggacuguuuggcaaagggucucucaucacaugcgccaaguucaagugcgugaccaaacuggagggaaagaucguucaguacgaaaaccuuaaauauuccgugauugucacagugcacacgggcgaccagcaucaaguugggaaugagagcaccgaacacggaacaaccgcuacaaucacaccccaggccccuucuacggagauucagcugaccgacuacggcgcccucacacuggauuguagcccccggaccggccuggacuuuaacgaaauggugcuccugacaaugaaggagaaaagcuggcuuguccauaagcagugguuccuggaucucccucugcccuggaccuccggggcuucuacgagccaagagacauggaaucgcaaagaccuucuggugaccuuuaagacagcgcacgccaagaaacaggaagucgugguucucggaucccaggagggcgcuaugcacaccgcccugaccggggccacagaaauccaaacgagcggaaccacaaccauuuucgcuggccaucugaagugcagacucaaaauggauaagcugacacuuaaagggaugucuuaugugauguguaccggcuccuucaagcuggagaaggaagucgccgagacgcagcacggaacagugcucguucagaucaaauacgagggcaccgacgcgccgugcaagaucccuuuuagcacccaggaugaaaaaggggugacacaaaacggacggcugauuaccgcuaaucccaucgucacagacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacggcuagaggcgcccgccggauggcgauccucggagauaccgccugggacuuuggcagcauugggggaguuuucacauccgucggcaagcuggugcaucagaucuuugggaccgcuuacggagugcuguucagcggcgucucuuggacaaugaaaauugggaucggcgugcuccugaccuggcuuggacucaauuccagaagcacgucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcaucagauccgccacacgccuggaaaacauuauguggaagcagaucucuaacgagcucaaucauauucugcuugaaaacgacaugaaauuuaccguuguggucggagauguggcuggcauccuggcccaggggaagaaaaugauucggccgcagcccauggaguacaaguauagcuggaaguccuggggaaaagccaagaucaucggcgcugacgugcaaaauacgacauucauuaucgaugggccuaacacccccgaauguccugacgaucagagagcguggaauauuugggaggucgaggacuacggauuuggcaucuucaccacaaacauuuggcucaaacugcgcgauagcuauacccagguuugcgaccaccggcugaugucugccgcuaucaaggauuccaaagccgugcacgccgacaugggcuacuggaucgaaagcgagaagaaugaaacguggaaacuugcuagagccucuuucauugaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacaaccgugguuguggaugagcacugcggaaaccggggccccucccugagaacgaccacagucaccggcaaaaucauucacgaaugguguugccggagcuguacacucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugaccgggacgcucgccgucuuuuuccugcuuaucaugggacagcugacauggaacgaucucauucggcugugcaucauggugggcgccaaugcuagcgacagaaugggcauggggaccacauaccuggcccuuauggcgaccuuuaagaugcgcccuauguucgcugucggacugcucuuuagacggcugaccucccgcgaggugcuccugcuuacaaucggccugucucucguggccagcgucgaacugcccaacucccuggaggaacuuggggauggacuggccaugggcauuaugauccucaaacugcucacggacuuccagagccaucaacugugggcuacccuucugucucucacauuuauuaagaccacauucucccugcacuaugccuggaagaccauggcuaugguucugagcaucgugucucuuuuuccccugugucucuccacgacaagccagaaaaccaccuggcugccugugcuccuggggucucuuggaugcaagccgcugacaauguuccugauugccgagaauaaaaucuggggcagaaaguccuggccccucaacgaaggcaucauggcggucgggauugugagcauccugcuuuccagccugcucaaaaacgauguuccucuggccggaccccucauugcuggcgggaugcugaucgccuguuacgugauuucuggaagcuccgcugaccuuucucuggagaaggccgccgaggucagcugggaagaggaagcugagcauuccggcgcgucucacaauauccugguggaaguucaggaugacgggaccaugaaaaucaaggaugaggagcgggacgauacacucacgauucugcuuaaggccacccugcucgcugugagcggagucuauccucuguccauccccgccacacucuucgugugguacuuuuggcagaaaaagaaacaacgcucuggcguccugugggacaccccuuccccucccgaaguggagagagccguucuugaugacggcauuuaucggaucaugcagcgcgggcugcugggaagaucccaggugggcgucgggguguuccaggaaaacguuuuucauacaauguggcacgugacccggggagcuguccucauguaccaaggcaagcgccuggagcccagcugggccucugugaaaaaggaccuuauuuccuacgggggaggcuggagacugcagggcagcuggaauacgggggaggaagugcagguuaucgcggucgagcccggaaagaacccuaaaaaugugcagaccgcucccggcacauucaagaccucugaaggggaggugggagccauugcccucgauuuuaaaccgggcacauccgggagcccuaucgucaaccgggaaggaaagaucgugggccuguauggcaaugggguugugaccacauccggaacguacgucucugcuauugcccaagcgaaagcuagccaggagggcccccucccugagaucgaagacgagguguucagaaagcgcaaccugaccauuauggaucuucaccccggguccggaaagacacggagauaucugcccgccaucguucgcgaagccauuaaacggaagcugagaacccucauccuggcuccuacccgcguggucgccagcgagauggcugaagcccuuaaaggcaugccgauccgguaccagacaacggcggugaagucugagcauaccgggaaagagauuguugaccugaugugccacgccacauuuaccaugagacuccugucccccgugcgcgucccuaauuauaacaugaucauuauggaugaagcucauuucacagaccccagcucuaucgccgcucggggcuacauuagcaccagagugggaaugggcgaggccgccgcuaucuuuaugacggcgacaccucccggguccguggaagccuucccucaaucuaaugcugucauccaggaugaggaacgggacauuccggagcgcagcuggaacuccggauaugaguggaucaccgauuuucccggcaagaccguuugguucgugccuucuauuaagagcgggaaugacaucgccaacugucugcgcaagaauggaaagcgggugauucagcucucccgcaaaacauucgauaccgaauaccagaagaccaagaauaacgacugggacuacgucgugaccacggauaucagcgagaugggcgccaauuuuagagcugaccggguuauugaucccagacgcugccuuaagccugugauccugaaggacgggcccgaacgggucauccuggccggcccgaugccugugacaguugcgucugcugcccaaagacgcggacggauuggcagaaaccacaauaaagagggggaucaguauaucuacaugggacagccccucaacaaugacgaggaucaugcccacuggaccgaagcuaagaugcugcuugacaacauuaauacacccgagggcaucauuccugcccuguucgaacccgagcgcgaaaaauccgcggccaucgauggggaguaucggcucagaggagaggcucgcaagaccuuuguggaacugaugagacggggcgaccugccugucuggcucagcuacaaaguggccuccgagggguuccaguauucugaucgcagauggugcuuugacggcgaacggaacaaucaaguccuugaggaaaacauggauguggagaucuggacgaaggagggagaacgcaaaaagcugagaccgcgguggcuggacgcuagaaccuacagcgacccccucgcccugcgcgaguucaaggaauuugcugccggccggagauccguuucuggggaucuuauucuggagaucggaaaacucccucagcaccugacacagcgcgcgcagaaugcccuggacaaccucgugaugcuucauaauagcgaacaaggcgggcgggcuuauagacacgccauggaggagcugcccgauaccauugaaacacugaugcuccuggcucuuaucgccgugcugaccggaggcgucacacucuucuuucuguccggccgggggcugggaaagaccagcauuggccuccuuuguguuauggccucuuccgugcugcuguggauggcuagcguggagccucauuggaucgcggccucuaucauucucgaguucuuucugaugguccuucugauccccgagccggaccgccagagaacgccucaggauaaccagcucgcuuacgugguuauugggcugcuguucaugauccucacaguggccgccaaugagaugggacuucuggaaaccaccaaaaaggaccugggcauugggcacgucgcuguggagaaccaccaucacgccgcgaugcucgaugucgaccugcaucccgccuccgcuuggacacuuuacgccguggcuaccacaaucauuacgccuaugaugcggcacaccaucgaaaacacaaccgccaauaucagccugacagcgauugccaaccaagcugccauccucaugggacuggauaaaggcuggcccauuucuaagauggacaucggcguuccucugcucgcucuugggugcuauagccaggugaauccccugacccugacggccgcuguccucaugcugguggcccauuacgcgauuaucggaccgggccuucaggccaaggcuacccgcgaggcccagaagagaacagcugccgggaucaugaagaacccuaccguugauggaauuguggccaucgaccuggaucccgucguguaugacgcgaaauuugaaaagcagcucggccagauuaugcugcugauccucuguacaucccagauucuucugaugcggaccacgugggcucugugcgagucuaucacacucgccaccgggccccugacaacccuuugggagggaagcccuggcaaauucuggaauaccacaaucgcuguguccauggccaacauuuuccgcggcagcuaccuggccggggcuggacucgccuuuucccugaugaagucucugggcgggggaagacggggcacgggggcgcaaggagaaacccucggcgagaaguggaaacgccagcuuaaucagcugagcaaguccgaguucaacacauauaaaagaucuggcaucauggagguugaccggagcgaagccaaggaggggcugaaaagaggagagaccacaaagcacgcugucucccgcggcaccgccaagcuccggugguuuguggaaagaaaucuggugaaaccggaggggaaggucauugaucuuggauguggccgcgggggauggucuuacuauugcgcuggccugaaaaagguuacggaagugaaaggcuacacaaaagggggacccggccacgaggaaccuauccccauggccaccuacggguggaaccucgugaaacugcauagcggaaaggacgucuucuuuauuccucccgagaagugugauacccugcucugcgacaucggcgaguccagcccuaauccgacaauugaagaggggcggacccuuagagugcugaaaaugguugaacccuggcugcgcggaaaccaguucuguaucaagauccucaauccuuauaugcccucuguggucgagacacuggagcaaaugcagcggaaacacggcggcaugcuugugagaaacccucugucccgcaauagcacgcaugaaauguacuggguuucuugcgggaccggaaacauuguguccgcggucaauaugacaagccggaugcuccugaacagauuuaccauggcccaccgcaagcccacauaugagcgggauguggaccugggcgcugggaccagacacguggccgucgaaccggagguugcuaaccucgauaucauuggacagcgcaucgaaaauauuaaacaugagcacaagucuacguggcauuacgacgaggauaacccuuauaagaccugggccuaccacggcuccuaugaagugaaacccagcggguccgcuagcucuauggugaauggagucgugaagcugcuuacaaaacccugggacguuaucccuauggugacccagaucgccaugacagauaccacacccuucggccaacagagagucuuuaaggagaaaguggacacccggacgccuaaggcgaagcgcggcacagcccagauuauggaaguuaccgcuaaauggcuguggggguuccucagcagaaacaagaaaccgcggaucuguaccagagaggaauuuacacggaaggugcgcuccaaugccgcuauuggagccgucuucguggacgagaaccaauggaacucugccaaagaggcgguugaagaugagagauuuugggaccuggugcaucgggaacgcgagcuucacaagcagggcaagugcgcuacgugcgucuacaacaugauggggaaaagagaaaagaaacugggagaguucggcaaggccaaagggagccgggccaucugguacauguggcucggcgcucgcuuccuggaguuugaagcccugggauucaugaaugaggaucacugguuuuccagagaaaacucucucagcggcguggagggggagggacugcauaaacuuggcuauauucugcgggacaucuccaaaauccccgggggaaauauguacgcugaugacaccgccggcugggauacacgcauuaccgaagacgaucuccagaacgaggcgaagaucacagacauuauggaaccugagcacgcccugcuugcuaccucuaucuucaagcugacauaucagaauaaagucgugagaguucaacggcccgccaagaacgggaccgugauggaugucauuagccgcagagaccagcggggcuccggacaggugggcacguacgggcucaauaccuuuacaaacauggaagcucagcugauccgccaaauggagagcgagggaaucuucucuccuuccgaacuggagacccccaaccucgccggcagagugcuggauuggcuugaaaaacaugggguugagcggcugaagagaauggcgauuagcggagacgacuguguggucaaaccgaucgaugaccgcuuugccacagcucucaccgcccugaaugauaugggcaaggugcggaaggacauuccucagugggaacccucuaaaggguggaacgauuggcagcagguuccuuucugcucccaccacuuucaucaacuuaucaugaaggacggcagagagauugugguccccugucgcaaucaggaugagcuggugggacgggcuagagucagccagggcgccggguggucccuccgcgaaacggcuugccugggaaaaucuuaugcccagauguggcaacugauguacuuccaccggagagaccuccgccuggcggccaacgcuaucuguagcgccgugccuguugauugggugcccacaucccggaccacauggagcauucaugcccaccaucaguggaugaccacggaggacaugcuuucugucuggaauagaguguggaucgaagagaacccguggauggaagauaagacccacaucuccagcuggggcgacguuccuuaucuggggaaacgcgaggaccaguggugcggaucucucauuggccugacagcucgggccaccugggcgacaaauauccaaguggcuauuaaccaggucagacggcuuaucgggaaugagaacuaccuggauuacaugaccagcaugaagagauuuaagaaugaauccgaccccgagggcgcccucugguga

SEQ ID NO: 19101 - RNA, 9879 nt, Artificial Sequence
  derived and/or modified CDS sequence (opt5) from DENV-1__FJ898398__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagagcaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguuccccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccccccuucggcgagucuuauauugugaucggggccggagaaaaagcucugaagcuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacugaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaagcugacgguuguggucggagauguggcuggcauucucgcccaggggaaaaagaugauccggccgcaacccauggaguacaaauauagcuggaagauuuggggaaaggccaaaaucaucggcgcugacgugcagaauacaaccuuuauuaucgaugggccuaacacccccgaauguccugacgaucagagagcguggaauauuugggaggucgaggacuacggauucggcaucuuuacaaccaacauuuggcugaagcugcgcgauuccuauacgcagguuugcgaccaccggcuuaugagcgccgcuaucaaagauucuaaggccgugcacgccgacaugggcuacuggaucgaauccgagaaaaaugaaacauggaagcucgcuagagccagcuucauugaggugaagaccuguaucuggcccaaaucucauacacugugguccaacgggguccuggaaagcgagaugauuaucccgaagauuuauggaggcccuaucucucaacacaauuaccgccccggguacuucacccagacagcgggaccuuggcaucucggcaaacuggagcuugauuuugaccugugcgaagggaccacggugguuguggaugagcacugcggaaaccggggccccagccucagaaccacaaccgucacaggcaagaucauucacgaaugguguugccgguccuguacccugccuccccugcgcuucaaaggggaggacggaugcugguauggcauggagaucagaccggugaaggaaaaggaggaaaaucuuguuaaaagcauggugucugcuggguccggagaggucgacagcuuuucccucggccugcuguguauuucuaucaugauugaagaggugaugcggagcagauggucccgcaagaugcucaugacggggacacuggccguuuucuuucuucugaucaugggacagcucaccuggaacgaucugauucggcugugcaucauggugggcgccaaugcuucugacagaaugggcauggggacaaccuaccuugcccugauggcgaccuucaaaaugcgcccuauguuugcugucggacuccuguucagacggcucacaagccgcgaggugcugcuucugacgaucggccucucccugguggccucugucgaacugcccaacagccuugaggaacugggggauggacucgccaugggcauuaugauccugaagcuccugaccgacuuucaaucccaucagcuuugggcuacacugcucagccugaccuucauuagaacaaccuuuucucugcacuaugccuggaaaacgauggcuaugguucuuuccaucgugagccuguucccccucugucugucuacaaccucccagaagaccacauggcucccugugcugcuugggagccugggaugcaagccgcugaccauguuucucauugccgagaauaaaaucuggggccggaagucuuggccccugaacgaaggcaucauggcggucgggauuguguccauccuucugagcucccuccugaaaaacgauguuccucucgccggaccccugauugcuggcgggaugcuuaucgccuguuacgugauuagcggaucuagcgcugaccugucccuggagaaggccgccgaggucucuugggaagaggaagcugagcauagcggcgcgucccacaauauccucguggaaguucaggaugacgggacaaugaaaaucaaggaugaggagcgcgacgauacgcugaccauucuucugaaagccacacuccuggcugugucuggagucuauccucucagcauccccgccacccuguucgugugguacuucuggcaaaagaagaaacagagauccggcguccuuugggacacaccuucucccccggaaguggagcgggccguucuggaugacggcauuuaucgcaucaugcagagagggcugcucggacggagccaggugggcgucgggguguuucaagaaaacguuuuccauaccauguggcacgugacgcgcggagcuguccugauguaccagggcaagagacuugagccuuccugggccagcgugaaaaaggaccugauuucuuacgggggaggcuggcggcuccagggcuccuggaauaccggggaggaagugcagguuaucgcggucgagcccggaaaaaacccuaagaaugugcaaacagcucccggcaccuuuaagacaagcgaaggggaggugggagccauugcccuggauuucaaaccgggcaccucuggguccccuaucgucaacagagaaggaaagaucgugggccucuauggcaaugggguugugacaacgagcggaaccuacgucuccgcuauugcccaggcgaaagcuucucaggagggcccccugccugagaucgaagacgagguguuucgcaagcggaaccuuacaauuauggaucugcaccccgggagcggaaaaaccagacgcuaucugcccgccaucguucgggaagccauuaagagacgccuccggacccugauccuugcuccuacaagaguggucgccuccgagauggcugaagcccugaagggcaugccgauccgcuaccaaacgaccgcggugaaaagcgagcauacagggaaggagauuguugaccucaugugccacgccaccuucacaaugcggcugcugucucccgugagagucccuaauuauaacaugaucauuauggaugaagcucauuuuaccgaccccuccagcaucgccgcucggggcuacauuucuacgcgcgugggaaugggcgaggccgccgcuaucuucaugacagcgaccccucccgggagcguggaagccuuuccucaguccaaugcugucauccaggaugaggaaagagacauuccggagcggucuuggaacagcggauaugaguggaucaccgauuuccccggcaaaacaguuugguuugugccuuccauuaagucugggaaugacaucgccaacugucuccgcaaaaauggaaagagagugauucagcuuagccggaagaccuucgauacagaauaccaaaaaaccaagaacaacgacugggacuacgucgugacgacagauaucuccgagaugggcgccaauuucagagcugaccgcguuauugauccccggagaugccugaaaccugugauccugaaggacgggcccgaacgcgucauccucgccggcccgaugccugugaccguugcgagcgcugcccagcggagaggacgcauuggccggaaccacaauaaagagggggaucaguauaucuacaugggacagccccugaacaaugacgaggaucaugcccacuggacagaagcuaagaugcuucuggacaacauuaauacccccgagggcaucauuccugcccucuuugaacccgagagagaaaagucugcggccaucgauggggaguaucgccugagaggagaggcucggaaaacguucguggaacugaugcgcagaggcgaccucccugucuggcuuuccuacaagguggccagcgagggguuucaauauuccgaucggcgcuggugcuucgacggcgaaagaaacaaucagguccuggaggaaucuauggauguggagaucuggaccaaagagggagaacggaagaaacugagaccgcgcuggcucgacgcucggacauacagcgacccccuggcccuuagagaguuuaaggaauucgcugccggccgccgguccguuucuggggaucugauucucgagaucggaaaacugccucagcaccugacccagagagcgcaaaacgcccucgacaaucuugugaugcugcauaacagcgaacagggcgggcgggcuuaucgccacgccauggaggagcugcccgauacaauugaaacccucaugcugcuugcucugaucgccgugcucacaggaggcgucacccuguuuuuccuguccggcagagggcucggaaagacgagcauuggccuucuguguguuauggccucuuccgugcugcucuggauggcuagcguggagccucauuggaucgcggccucuaucauucuggaauuuuuccuuaugguccugcucauccccgagccggaccggcagcgcacaccucaggauaaucaacuggcuuacgugguuauugggcugcucuuuaugauccuuaccguggccgccaacgagaugggacugcuggaaaccacaaagaaagaccucggcauugggcacgucgcuguggagaaucaccaucacgccgcgaugcuggaugucgaccuucaucccgccuccgcuuggacccuguacgccguggcuacaacgaucauuaccccuaugaugagacacacaaucgaaaacaccacagccaacaucagccucaccgcgauugccaaucaggcugccauccugaugggacuggauaagggcuggcccauuucuaaaauggacaucggcguuccucuccuugcucuggggugcuauagccaggugaacccccugacgcucaccgccgcuguccugaugcuuguggcccauuacgcgauuaucggaccgggccugcaagccaaggcuacacgggaggcccagaaacgcaccgcugccgggaucaugaagaauccuacaguugauggaauuguggccaucgaccucgaucccgucguguaugacgcgaaguucgaaaaacagcugggccagauuaugcugcucauccuuuguaccucccaaauucugcugaugagaacgacaugggcucucugcgagucuaucacccuggccacagggccccuuaccacccugugggagggaagcccuggcaaguuuuggaacacaacgaucgcuguguccauggccaauauuuuccggggcagcuaccucgccggggcuggacuggccuucucccugaugaaaucucucggcgggggacgcagaggcaccggggcgcagggagaaacacuuggcgagaaguggaaacggcagcugaaccagcugagcaaguccgaauuuaauaccuauaagagaucuggcaucauggagguugaccgcagcgaagccaaagaggggcucaagcggggagagacaaccaaacacgcugucuccagaggcacggccaagcugcgcugguucguggaacggaaccuugugaaaccggaggggaaggucauugaucugggauguggcagagggggauggucuuacuauugcgcuggccucaagaaaguuacagaagugaagggcuacaccaaagggggacccggccacgaggaaccuauccccauggccaccuacggguggaaucuggugaagcugcauagcggaaaagacgucuuuuucauuccucccgagaagugugauacacuccuuugcgacaucggcgaguccagcccuaacccgaccauugaagaggggcgcacacugcgggugcugaaaaugguugaacccuggcucagaggaaaucaauuuuguaucaagauccugaacccuuauaugcccucuguggucgagacgcuugagcagaugcagcgcaagcacggcggcaugcuggugcggaauccucucuccagaaacagcacccaugaaauguacuggguuucuugcgggacaggaaauauuguguccgcggucaacaugaccagccgcaugcugcugaaucgguucacaauggcccacagaaaacccaccuaugagcgcgauguggaccucggcgcugggacgagacacguggccgucgaaccggagguugcuaaccuggauaucauuggacagcggaucgaaaacauuaagcaugagcacaaaucuaccuggcauuacgacgaggauaauccuuauaagacaugggccuaccacggcuccuaugaagugaaacccagcggguccgcuagcucuauggugaacggagucgugaagcuucugaccaagcccugggacguuaucccuauggugacacaaaucgccaugaccgauacaacccccuuuggccagcagcgcgucuucaaagagaagguggacacgagaacaccuaaagcgaagcggggcaccgcccaaauuauggaaguuaccgcuaaauggcucuggggguuucugagcagaaauaagaagccgcggaucuguacacgcgaggaauucacgagaaaagugcgguccaacgccgcuauuggagccgucuuuguggacgagaaucaguggaacucugccaaggaggcgguugaagaugagcgcuucugggaccuugugcauagagaacgggagcugcacaaacagggcaagugcgcuaccugcgucuacaauaugauggggaaacgcgaaaagaagcucggagaguuuggcaaagccaaggggagcagagccaucugguacauguggcugggcgcucgguuccuggaguucgaagcccucggauuuaugaacgaggaucacugguucucccgcgaaaauucucugagcggcguggagggggagggacuucauaaacugggcuauauucucagagacaucuccaagauccccgggggaaacauguacgcugaugacacagccggcugggauacccggauuacagaagacgaucugcagaaugaggcgaaaaucaccgacauuauggaaccugagcacgcccuucuggcuaagucuaucuuuaaacucacauaucaaaacaaggucgugcgcguucagagacccgccaagaaugggaccgugauggaugucauuagccggcgcgaccagagaggcuccggacaggugggcacguacgggcugaacaccuucacaaauauggaagcucaacugauccggcagauggagagcgagggaaucuuuucuccuuccgaacucgagacccccaaccuggccggcagagugcuuaacuggcuggaaaaacaugggguugagcgccucaagcggauggcgauuagcggagaugacuguguggucaaaccgaucgacgauagauucgccacagcucugaccgcccuuaaugacaugggcaaggugcgcaaagauauuccucagugggaacccucuaagggguggaacgacuggcagcaaguuccuuuuugcucccaccacuuccaucagcugaucaugaaggauggccgggagauugugguccccuguagaaaucaggacgagcucgugggacgcgcucgggucagccagggcgccggguggucccugagagaaacggcuugccugggaaaaucuuaugcccaaauguggcagcucauguacuuucaccgccgggaucugagacuugcggccaacgcuaucuguagcgccgugccuguugacugggugcccacaucccgcaccacauggagcauucaugcccaccaucaguggaugaccacggaggauaugcugucugucuggaaucggguguggaucgaagagaacccguggauggaagacaagacccacguuuccagcuggggcgaugugccuuaucucgggaaaagagaggaccaauggugcggaucucugaucggccuuacagcucgggccaccugggcgacaaauauucaggucgcuaucaaccaggugagacgccugcucgggaaugagaacuaccuggacuacaugaccagcaugaagcgguucaaaaaugaauccgaucccgagggcgcccugugguga

SEQ ID NO: 19102 - RNA, 9879 nt, Artificial Sequence
  derived and/or modified CDS sequence (opt5) from DENV-1__FJ898399__SS-prME
agcgugacaaugcugcugaugcugaugcccacagcccuugcuuuccaccugacgaccagaggcggggaaccucauaugaucguguccaagcaggaacgggggaaaucucuccuguuuaagacaagcgccggcguuaauaugugcacccuuauugcgauggaccugggggaguucugugaagauacaaugaccuacaaaugcccgagaaucacagaagcugaacccgacgauguggacuguuggugcaaugccaccgauacgugggugaccuauggaacauguucccagaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacagaacaguauaaauuccaagccgacucuccuaagcggcugagcgcggccauuggcaaggcuugggaggagggggugugcggcaucagauccgccacccgccuggaaaacaucauguggaagcagauuucuaacgagcucaaucauauccugcuugaaaacgacaugaaacugacgguuguggucggagauguggcuggcauucucgggcagggaaagaaaaugauccggccgcagcccauggaguacaaguauagcuggaaguccuggggcaaagccaagauuaucggggccgacgcucaaaauacaaccuuuaucauugauggaccuaacacccccgaauguccugacgaucagagagcguggaauaucugggagguggaggacuacggcuucggcauuuuuacaaccaacaucuggcugaaacugcgcgauagcuauacgcaggucugcgaccaccggcuuaugucugccgcuauuaaggauuccaaagccguucacgccgacaugggguacuggaucgaaagcgagaagaaugaaacauggaagcucgcuagagccucuuucaucgaggugaaaaccuguauuuggcccaagucccauacacuguggagcaacggagugcuggaaucugagaugaucauuccgaaaaucuauggcgggccuauuagccagcacaauuaccgccccggauacuucacccaaacagcgggcccuuggcaucucgggaagcuggagcuugauuuugaccugugcgaaggaaccacggucgugguugaugagcacugcggcaaccggggccccucccucagaaccacaaccgugacagggaaaaucauccacgaaugguguugccggagcuguacccugccuccccugcgcuucaagggagaggacggcugcugguaugggauggagauuagaccggucaaggaaaaagaggaaaaucuugugaagucuaugguuuccgcuggaagcggcgagguggacuccuuuucucucgggcugcuguguaucagcauuaugaucgaagaggucaugcgguccagauggucucgcaaaaugcucaugacgggaacacuggccguguucuuucuucugauuaugggccagcucaccuggaacgaucugauccggcugugcauuaugguuggcgccaaugcuagcgacagaauggggaugggaacaaccuaccuugcccugauggcgaccuucaagaugcgcccuauguuugcugugggccuccuguucagacggcucacaucccgcgagguccugcuucugacgaucgggcucucucugguggccagcguggaacugcccaacucccuugaggaacugggagauggccucgccauggggaucaugauucugaaacuccugaccgacuuucagagccaucaacuuugggcuacacugcucucucugaccuucaucaagacaaccuuuucccugcacuaugccuggaagacgauggcuaugguccuuagcauuguuucucuguucccccucugucuguccacaaccagccagaaaaccacauggcucccugugcugcuuggaucucugggcugcaagccgcugaccauguuucucaucgccgagaauaaaauuuggggcagaaaguccuggccccugaacgaagggaucauggcggugggaaucgucagcauucuucuguccagccuccugaaaaacgaugugccucucgccggcccccugaucgcugggggaaugcuuauugccuguuacguuaucucuggcagcuccgcugaccugucucuggagaaggccgccgaggugagcugggaagaggaagcugagcauuccggggcgucucacaauauucucgucgaagugcaggaugacggaacaaugaaaaucaaggaugaggagcgggacgauacgcugaccauccuucugaaggccacacuccuggcuguuagcggcguguauccucucuccauucccgccacccuguucgucugguacuucuggcagaaaaagaaacaacgcucuggcgugcuuugggacacaccuuccccucccgaagucgagagagccgugcuggaugacgggaucuaucggauuaugcagcgcggacugcucggcagaucccagguuggggugggagucuuucaggaaaacguguuccauaccauguggcacguuacgcggggcgcugugcugauguaccaagggaagcgccuugagcccagcugggccucugucaaaaaggaccugaucuccuacggaggcggcuggagacuccaggggagcuggaauaccggagaggaaguccaggugauugcgguugagcccggcaagaacccuaaaaauguccagacagcucccgggaccuuuaagacaucugaaggagaggugggcgccaucgcccuggauuucaaaccggggaccuccggaagcccuauugugaaccgggaaggcaagaucgucggccucuaugggaauggagugguuacaacguccggcaccuacgugucugcuaucgcccaagcgaaagcuagccaggaggggccccugccugagauugaagacgaggucuuuagaaagcgcaaccuuacaaucauggaucugcaccccggauccggcaagacccggagauaucugcccgccauugugcgcgaagccaucaaacggaagcucagaacccugauucuugcuccuacacgcguuguggccagcgagauggcugaagcccugaaagggaugccgauccgguaccagacgaccgcggucaagucugagcauacaggcaaagagaucguggaccucaugugccacgccaccuucacaaugagacugcugucccccguucgcgugccuaauuauaacaugauuaucauggaugaagcucauuuuaccgaccccagcucuauugccgcucggggauacaucagcacgagagucggcaugggggaggccgccgcuauuuucaugacagcgaccccucccggauccguggaagccuuuccucaaucuaaugcugugauccaggaugaggaacgggacaucccggagcgcagcuggaacuccggcuaugaguggauuaccgauuuccccgggaagacagucugguuuguuccuucuaucaagagcggaaaugacauugccaacugucuccgcaaaaauggcaagcgggugauccagcuuucccgcaaaaccuucgauacagaauaccagaagaccaaaaacaacgacugggacuacguggucacgacagauauuagcgagaugggggccaauuucagagcugaccgggugaucgaucccagacgcugccugaagccuguuauucugaaggacggccccgaacgggugauccucgccggaccgaugccugucaccguggcgucugcugcccaaagacgcggccggaucgggagaaaccacaauaaagagggagaucaguauauuuacaugggccagccccugaacaaugacgaggaucaugcccacuggacagaagcuaagaugcuucuggacaacaucaauacccccgaggggauuaucccugcccucuuugaacccgagcgcgaaaaauccgcggccauugauggagaguaucggcugagaggcgaggcucgcaagacguucguugaacugaugagaagaggggaccucccuguguggcuuagcuacaaagucgccuccgagggcuuucaguauucugaucgcagauggugcuucgacggagaacggaacaaucaagugcuggaggaaaacauggaugucgagaucuggaccaaggagggcgaacgcaaaaagcugagaccgcgguggcucgacgcuagaacauacagcgacccccuggcccuucgcgaguuuaaggaguucgcugccgggcggagauccgugucuggagaucugauccucgagauuggcaaacugccucagcaccugacccagcgcgcgcagaaugcccucgacaaccuuguuaugcugcauaauagcgaacaagggggacgggcuuauagacacgccauggaggagcugcccgauacaaucgaaacccucaugcugcuugcucugauugccgugcucacaggcggcgugacccuguuuuuccuguccgggcggggacucggcaagacgagcaucgggcuucugugugucauggccucuuccguucugcucuggauggcuagcguggagccucauuggauugcggccucuaucauccuggaauuuuuccuuauggugcugcucauucccgagccggaccgccagagaacaccucaggauaaccagcuggcuuacgucgugaucggacugcucuuuaugauucuuaccguugccgccaaugagaugggccugcuggaaaccaccaaaaaggaccucgggaucggacacguggcugucgagaaccaccaucacgccgcgaugcuggauguggaccuucaucccgccuccgcuuggacccuguacgccgucgcuacaacgauuaucaccccuaugaugcggcacacaauugaaaacaccacagccaauaucagccucaccgcgaucgccaaccaagcugccauucugaugggccuggauaaaggcuggcccaucucuaagauggacauuggggugccucuccuugcucugggaugcuauagccagguuaauccccugacgcucaccgccgcugugcugaugcuugucgcccauuacgcgaucauuggcccggggcugcaggccaaggcuacacgcgaggcccagaaacggaccgcugccggaaucaugaagaacccuacaguggauggcaucguugccauugaccucgaucccguggucuaugacgcgaaauucgaaaagcagcuggggcagaucaugcugcucauucuuuguaccucccagauccugcugaugcggacgacaugggcucucugcgagucuauuacccuggccacaggaccccuuaccacccugugggagggcagcccuggcaaauuuuggaauacaacgaucgcuguguccauggccaacaucuuccgcgggagcuaccucgccggagcuggccuggccuucucccugaugaagucucucgggggaggcagacgggggaccggagcgcaaggcgaaacacuuggcgagaaguggaaacgccagcugaaucagcugagcaaguccgaauuuaacaccuauaaaagaucugggauuauggagguggaccggagcgaagccaaggagggacucaaaagaggcgagacaaccaagcacgcuguuucccgcgggacggccaagcugcggugguucgucgaaagaaaucuugugaaaccggagggaaaggugaucgaucugggcugugggcgcggaggcuggucuuacuauugcgcuggccucaaaaaggucacagaaguuaaaggguacaccaagggaggccccgggcacgaggaaccuauucccauggccaccuacggauggaaccuggugaaacugcauagcggcaaggacguguuuuucaucccucccgagaagugugauacacuccuuugcgacauuggggaguccagcccuaauccgaccaucgaagagggacggacacugagaguccugaaaaugguggaacccuggcuccgcggcaaccaguuuuguauuaagauccugaauccuuauaugcccucuguuguggagacgcuugagcaaaugcagcggagacacggcgggaugcugguccgcaacccucucucccggaauagcacccaugaaauguacugggugucuugcggaacaggcaacaucguuuccgcggugaauaugaccagcagaaugcugcugaaccgcuucacaauggcccaccggaaacccaccuaugagagagaugucgaccucggggcuggaacgcgccacguggccguggaaccggaggucgcuaaccuggauauuaucggccagagaauugaaaauaucaagcaugagcacaaaucuaccuggcauuacgacgaggauaacccuuauaagacaugggccuaccacggguccuaugaaguuaagcccagcggauccgcuagcucuauggugaauggcguggucaaacuucugaccaagcccugggacgugauuccuaugguuacacagaucgccaugaccgauacaacccccuuuggccaacagcggguguucaaagagaaggucgacacgcgcacaccuaaagcgaagagagggaccgcccagaucauggaagugaccgcuaaguggcucuggggauuucugagccggaacaaaaagccgagaauuuguacacgggaggaguucacgcgcaaaguuagauccaaugccgcuaucggcgccguguuugucgacgagaaccaauggaacucugccaaggaggcgguggaagaugagcgguucugggaccuuguucaucgcgaaagagagcugcacaaacaggggaagugcgcuaccugcguguacaacaugaugggaaagcgggagaaaaagcucggcgaguuugggaaagccaagggcagccgcgccauuugguacauguggcugggagcuagauuccuggaguucgaagcccucggcuuuaugaaugaggaucacugguucucccgggaaaacucucugagcggggucgagggagagggccuucauaaacugggguauauccuccgcgacauuuccaagauccccggaggcaauauguacgcugaugacacagccgggugggauaccagaaucacagaagacgaucugcagaacgaggcgaaaauuaccgacaucauggaaccugagcacgcccuucuggcuaagucuauuuuuaagcucacauaucagaauaaagugguccgggugcaacgccccgccaagaacggcaccguuauggaugugaucagcagacgggaccagcgcggauccggccaggucgggacguacggacugaauaccuucacaaacauggaagcucagcugauuagacaaauggagagcgagggcaucuuuucuccuuccgaacucgagacccccaaccuggccgggcgggugcuugauuggcuggaaaaacauggaguggagagacucaagcgcauggcgaucagcggcgacgacuguguugugaaaccgauugaugaccgguucgccacagcucugaccgcccuuaaugauauggggaaggucagaaaggacaucccucagugggaacccucuaaaggcuggaacgauuggcaacaggugccuuuuugcucccaccacuuccaucaacugauuaugaaggacggacgcgagaucguugugcccugucggaaucaggaugagcucgucggcagagcucgcgugagccagggggccggauggucccugcgggaaacggcuugccugggcaaaucuuaugcccagauguggcaacucauguacuuucacagacgcgaccugcggcuugcggccaacgcuauuuguagcgccgucccuguggauuggguucccacauccagaaccacauggagcauccaugcccaccaucaguggaugaccacggaggacaugcugucuguguggaaucgcgucuggauugaagagaacccguggauggaagauaagacccacaucuccagcuggggagacgugccuuaucucggaaaacgggaggaccaguggugcggcucucugaucgggcuuacagcuagagccaccugggcgacaaauauucaaguugcuaucaaccaggugcggagacugauuggcaaugagaacuaccucgauuacaugaccagcaugaagcgcuucaagaaugaauccgaccccgagggagcccugugguga

SEQ ID NO: 19103 - RNA, 9879 nt, Artificial Sequence
  derived and/or modified CDS sequence (opt5) from DENV-1__FJ898401__SS-prME
agcgugaccaugcugcugaugcugaugcccacagcccuugcuuuccaccugacgacccggggcggggaaccucauaugaucgucuccaagcaggaacggggaaaaucucugcuguuuaagacaagcgccggcguuaauaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacagaacaguauaaauuccaagccgacucuccuaagcggcugagcgcggccauuggcaaggcuugggaggagggggugugcggcaucagauccgccacccgccuggaaaacaucauguggaagcagauuucuaacgagcucaaucauauccugcuugaaaacgacaugaaauuuacgguuguggucggagauguggcuggcauucuggcccaggggaagaaaaugauccggccgcagcccauggaguacaaguauagcuggaaguccuggggaaaagccaagauuaucggcgcugacgugcaaaauacaaccuucaucauugaugggccuaacacccccgaauguccugacgaucagagagcguggaauaucugggaggucgaggacuacggauuuggcauuuucacaaccaacaucuggcucaaacugcgcgauagcuauacgcagguuugcgaccaccggcugaugucugccgcuauuaaggauuccaaagccgugcacgccgacaugggcuacuggaucgaaagcgagaagaaugaaacauggaaacuugcuagagccucuuucaucgaggugaaaaccuguauuuggcccaagucccauacacucuggagcaacgggguccuggaaucugagaugaucauuccgaaaaucuauggaggcccuauuagccagcacaauuaccgccccggguacuuuacccaaacagcgggaccuuggcaucugggcaagcucgagcuggauuucgaccuuugcgaagggaccacggugguuguggauggacacugcggcaaccggggccccucccugagaaccacaaccgucacagggaaaaucauccacgagugguguugccggagcuguacccucccuccccugcgcuuuaagggagaagacggcugcugguaugggauggagauuagaccggugaaggagaaagaagagaaucugguuaagucuaugguguccgcuggaagcggcgaagucgacuccuucucucuugggcuccuguguaucagcauuaugaucgaggaagugaugcgguccagauggucucgcaaaaugcugaugacgggaacacucgccgucuuuuuccugcuuauuaugggccagcugaccuggaacgaucucauccggcugugcauuauggugggcgccaaugcuagcgacagaauggggaugggaacaaccuaccuggcccuuauggcgaccuuuaagaugcgcccuauguucgcugucggccugcucuuuagacggcugacaucccgcgaggugcuccugcuuacgaucgggcugucucucguggccagcgucgagcugcccaacucccuggaagaacuuggagauggccuggccauggggaucaugauucucaaacugcucaccgacuuccagagccaucaacugugggcuacacuucugucucucaccuuuaucaagacaaccuucucccugcacuaugccuggaagacgauggcuaugguucugagcauugugucucuuuuuccccugugucucuccacaaccagccagaaaaccacauggcugccugugcuccugggaucucuuggcugcaagccgcugaccauguuccugaucgccgaaaauaaaauuuggggcagaaaguccuggccccucaacgaggggaucauggcggucggaaucgugagcauucugcuuuccagccugcucaaaaacgauguuccucuggccggcccccucaucgcugggggaaugcugauugccuguuacgugaucucuggcagcuccgcugaccuuucucuggaaaaggccgccgaggucagcugggagaaagaagcugagcauuccggggcgucucacaauauucugguggaaguucaggaugacggaacaaugaagaucaaggaugaggaacgggacgauacgcucaccauccugcuuaaagccacacugcucgcugugagcggcgucuauccucuguccauucccgccacccucuucguguggcauuuuuggcagaagaaaaagcaacgcucuggcguccugugggacacaccuuccccucccgagguggagagagccguucuugaugacgggaucuaccggauuaugcagcgcggacugcugggcagaucccaggugggggucggaguguuccaggaaaacguuuuucacaccauguggcacgugacgcggggcgcuguccucauguaucaagggaaacgccuggagcccagcugggccucugugaagaaggaccuuaucuccuacggaggcggcuggagacugcaggggagcuggaauaccggagaagaggugcagguuauugcggucgagcccggcaaaaacccuaagaaugugcagacagcucccgggaccuucaaaacaucugaaggagaggugggcgccaucgcccucgauuuuaagccggggaccuccggaagcccuauugucaaccgggaaggcaaaaucgugggccuguacgggaauggaguugugacaacguccggcaccuaugucucugcuaucgcccaagcgaaggcuagccaggaggggccccucccugaaauugaggacgagguguucagaaagcgcaaccugacaaucauggaucuucaucccggauccggcaaaacccggagauaccugcccgccauuguucgcgaagccaucaagcggaaacugagaacccucauucuggcuccuacacgcguggucgccagcgagauggcugaagcccuuaaggggaugccgauccgguaucagacgaccgcggugaaaucugagcacacaggcaaggaaaucguugaccugaugugccaugccaccuuuacaaugagacuccugucccccgugcgcgucccuaauuacaacaugauuaucauggaugaggcucacuucaccgaccccagcucuauugccgcucggggauauaucagcacgagagugggcaugggggaggccgccgcuauuuuuaugacagcgaccccucccggauccguggaagccuucccucaaucuaaugcugucauccaggaugaggaacgggacaucccggagcgcagcuggaacuccggcuacgaauggauuaccgauuuucccgggaagacaguuugguucgugccuucuaucaaaagcggaaaugacauugccaacugucugagaaagaauggcaaacgggugauccagcucucccgcaagaccuucgauacagaguaucagaaaaccaagaacaacgacugggacuacgucgugacgacagauauuagcgagaugggggccaauuuuagagcugaccggguuaucgaucccagacgcugccuuaagccugugauucugaaagacggccccgaacgggucauccuggccggaccgaugccugugaccguugcgucugcugcccaaagacgcggccggaucgggagaaaccauaauaaggagggagaucaguacauuuauaugggccagccccucaacaaugacgaagaucacgcccacuggacagaggcuaaaaugcugcuugacaacaucaauacccccgaggggauuaucccugcccuguucgaacccgagcgcgaaaaguccgcggccauugauggagaguaccggcucagaggcgaagcucgcaaaacguuuguggagcugaugagaagaggggaccugccugucuggcucagcuauaagguggccuccgagggcuuccaguacucugaucgcagauggugcuuugacggagaacggaacaaucaaguccuugaggaaaacauggauguggagaucuggaccaaagaaggcgagcgcaagaagcugagaccgcgguggcuggacgcuagaacauauagcgacccccucgcccugcgcgaguucaaagaauuugcugccgggcggagauccguuucuggagaucuuauccuggagauuggcaagcucccucagcaucugacccagcgcgcgcagaaugcccuggacaaccucgugaugcuucacaauagcgaacaagggggacgggcuuacagacaugccauggaggaacugcccgauacaaucgagacccugaugcuccuggcucuuauugccgugcugacaggcggcgucacccucuucuuucuguccgggcggggacugggcaaaacgagcaucgggcuccuuuguguuauggccucuuccgugcugcuguggauggcuagcguggagccucacuggauugcggccucuaucauccucgaguucuuucugaugguccuucugauucccgagccggaccgccagagaacaccucaggauaaccagcucgcuuaugugguuaucggacugcuguucaugauucucaccguggccgccaaugaaaugggccuucuggagaccacaaagaaagaccuggggaucggacacgucgcuguggagaaccaucaccaugccgcgaugcucgaugucgaccugcaccccgccuccgcuuggacccuuuacgccguggcuacaacgauuaucaccccuaugaugcggcauacaauugaaaacaccacagccaauaucagccugaccgcgaucgccaaccaagcugccauucucaugggccuggauaagggcuggcccaucucuaagauggacauugggguuccucugcucgcucuuggaugcuacagccaggugaauccccugacgcugaccgccgcuguccucaugcugguggcccacuaugcgaucauuggcccggggcuucaggccaaagcuacacgcgaggcccaaaagagaaccgcugccggaaucaugaaaaacccuacaguugauggcaucguggccauugaccuggaucccgucguguacgacgcgaaguuugaaaaacagcucgggcagaucaugcugcugauucucuguaccucccagauccuucugaugcggacgacaugggcucugugcgagucuauuacccucgccacaggaccccugaccacccuuugggaaggcagcccuggcaaguucuggaauacaacgaucgcuguguccauggccaacaucuuccgcgggagcuaucuggccggagcuggccucgccuuuucccugaugaagucucucgggggcgggagacgggggaccggagcgcacggcgagacacucggcgagaaauggaagcgccaacuuaaucagcugagcaaauccgaguucaacaccuacaagagaucugggauuauggagguugaccggagcgaagccaaagagggacugaagagaggcgaaacaaccaagcaugcugucucccgcgggacggccaaacuccggugguuuguggagagaaaucuggugaagccggagggaaaagucaucgaucuuggcugugggcgcggaggcuggucuuauuacugcgcuggccugaagaaaguuacagaagugaagggguauaccaaaggaggccccgggcacgaggaaccuauucccauggccaccuacggauggaaccucgugaagcugcauagcggcaaggacgucuucuuuaucccucccgagaaaugugauacacugcucugcgacauuggggaauccagcccuaauccgaccaucgaggagggacggacacuuagagugcugaagaugguugaacccuggcugcgcggcaaccaguucuguauuaaaauccucaauccuuacaugcccucuguggucgagacgcuggaacagaugcaacggaagcacggcgggaugcuugugagaaacccucugucccgcaauagcacccacgagauguauuggguuucuugcggaacaggcaacaucguguccgcggucaauaugaccagccggaugcuccugaacagauuuacaauggcccaucgcaaacccaccuacgagcgggauguggaccugggggcuggaacgagacacguggccgucgaaccggagguugcuaaccucgauauuaucggccagcgcauugaaaauaucaagcaugagcacaagucuaccuggcauuaugacgaagauaacccuuacaaaacaugggccuaucacggguccuacgaggugaagcccagcggauccgcuagcucuauggugaauggcgucgugaaacugcuuaccaagcccugggacguuauuccuauggugacacagaucgccaugaccgauacaacccccuucggccagcaaagagucuuuaaagagaagguggacacgcggacaccuaaggcgaaacgcgggaccgcccagaucauggaaguuaccgcuaaguggcuguggggauuccucagcagaaacaaaaagccgcggauuuguacaagagaggaauuuacgcggaaagugcgcuccaaugccgcuaucggcgccgucuucguggacgagaaccaguggaacucugccaaggaagcgguugaggaugagagauuuugggaccuggugcaccgggaacgcgagcuucauaagcaagggaaaugcgcuaccugcgucuauaacaugaugggaaagagagagaagaagcugggcgaguucgggaaagccaagggcagccgggccauuugguacauguggcucggagcucgcuuccuggaauuugaggcccugggcuucaugaaugaggaucacugguuuuccagagaaaacucucucagcgggguggagggagaaggccugcauaaacuuggguacauccugcgggacauuuccaagauccccggaggcaauauguaugcugaugacacagccgggugggauacccgcaucacagaggacgaucuccagaacgaggcgaagauuaccgacaucauggaaccugagcacgcccugcuugcuaaaucuauuuucaagcugacauaccagaauaaagucgugagaguucagcggcccgccaagaacggcaccgugauggaugucaucagccgcagagaccaacggggauccggccagguggggacguauggacucaauaccuuuacaaacauggaagcucagcugauucgccagauggagagcgaaggcaucuucucuccuuccgagcuggagacccccaaccucgccgggagagugcuggauuggcuugaaaaacacggaguugagcggcugaagagaauggcgaucagcggcgacgacuguguggucaagccgauugaugaccgcuuugccacagcucucaccgcccugaaugauauggggaaagugcggaaggacaucccucaaugggaacccucuaaaggcuggaacgauuggcagcagguuccuuucugcucccaucacuuucaucagcuuauuaugaaggacggaagagagaucgugguccccugucgcaaucaagaugaacuggugggccgggcuagagucagccagggggccggauggucccuccgcgagacggcuugccugggcaaaucuuacgcccagauguggcagcugauguauuuccaccggagagaccuccgccuggcggccaacgcuauuuguagcgccgugccuguugauugggugcccacaucccggaccacauggagcauccaugcccaccaccaauggaugaccacggaggacaugcuuucugucuggaauagaguguggauugaagagaacccguggauggaagauaagacccauaucuccagcuggggagacguuccuuaccugggaaagcgcgaggaccaguggugcggcucucucaucgggcugacagcucgggccaccugggcgacaaauauucagguggcuaucaaccaagucagacggcuuauuggcaaugaaaacuaucuggauuacaugaccagcaugaaaagauuuaagaaugaguccgaccccgagggagcccucugguga

SEQ ID NO: 19104 - RNA, 9879 nt, Artificial Sequence
  derived and/or modified CDS sequence (opt5) from DENV-1__FJ898402__SS-prME
agcgugaccaugcugcugaugcugaugcccacagcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacagaacaguauaaauuccaagccgacucuccuaagcggcugagcgcggccauuggcaaggcuugggaggagggggugugcggcaucagauccgccacccgccuggaaaacaucauguggaagcagauuucuaacgagcucaauuacauccugcuugaaaacgacaugaaauuuacgguuguggucggagauguggcuggcauucuggcccaggggaagaaaaugauccggccgcagcccauggaguauaaguacagcuggaaguccuggggaaaagccaagauuaucggcgcugacgugcaaaauacaaccuucaucauugaugggccuaacacccccgaauguccugacgaucagagagcguggaauaucugggaggucgaggacuauggauuuggcauuuucacaaccaacaucuggcucaaacugcgcgauagcuacacgcagguuugcgaccaucggcugaugucugccgcuauuaaggauuccaaagccgugcacgccgacaugggcuauuggaucgaaagcgagaagaaugaaacauggaaacuugcuagagccucuuucaucgaggugaaaaccuguauuuggcccaagucccacacacucuggagcaacgggguccuggaaucugagaugaucauuccgaaaaucuacggaggcccuauuagccagcauaauuaccgccccggguauuuuacccaaacagcgggaccuuggcaccugggcaagcucgagcuggauuucgaccuuugcgaagggaccacggugguuguggaugagcauugcggaaaccggggccccucccugagaaccacaaccgucacaggcaaaaucauccacgaaugguguugccggagcuguacccucccuccccugcgcuuuaagggggaggacggaugcugguacggcauggagauuagaccggugaaggaaaaagaggaaaaucugguuaagucuaugguguccgcugggagcggagaggucgacuccuucucucuuggccuccuguguaucagcauuaugaucgaagaggugaugcgguccagauggucucgcaaaaugcugaugacggggacacucgccgucuuuuuccugcuuauuaugggacagcugaccuggaacgaucucauccggcugugcauuauggugggcgccaaugcuagcgacagaaugggcauggggacaaccuaucuggcccuuauggcgaccuuuaagaugcgcccuauguucgcugucggacugcucuuuagacggcugacaucccgcgaggugcuccugcuuacgaucggccugucucucguggccagcgucgaacugcccaacucccuggaggaacuuggggauggacuggccaugggcaucaugauucucaaacugcucaccgacuuccagagccaccaacugugggcuacacuucugucucucaccuuuaucaagacaaccuucucccugcauuacgccuggaagacgauggcuaugguucugagcauugugucucuuuuuccccugugucucuccacaaccagccagaaaaccacauggcugccugugcuccuggggucucuuggaugcaagccgcugaccauguuccugaucgccgagaauaaaauuuggggcagaaaguccuggccccucaacgaaggcaucauggcggucgggaucgugagcauucugcuuuccagccugcucaaaaacgauguuccucuggccggaccccucaucgcuggcgggaugcugauugccuguuaugugaucucuggaagcuccgcugaccuuucucuggagaaggccgccgaggucagcugggaagaggaagcugagcacuccggcgcgucucauaauauucugguggaaguucaggaugacgggacaaugaaaaucaaggaugaggagcgggacgauacgcucaccauccugcuuaaggccacacugcucgcugugagcggagucuacccucuguccauucccgccacccucuucgugugguauuuuuggcagaaaaagaaacaacgcucuggcguccugugggacacaccuuccccucccgaaguggagagagccguucuugaugacggcaucuaccggauuaugcagcgcgggcugcugggaagaucccaggugggcgucgggguguuccaggaaaacguuuuucacaccauguggcaugugacgcggggagcuguccucauguaccaaggcaagcgccuggagcccagcugggccucugugaaaaaggaccuuaucuccuaugggggaggcuggagacugcagggcagcuggaauaccggggaggaagugcagguuauugcggucgagcccggaaagaacccuaaaaaugugcagacagcucccggcaccuucaagacaucugaaggggaggugggagccaucgcccucgauuuuaaaccgggcaccuccgggagcccuauugucaaccgggaaggaaagaucgugggccuguacggcaaugggguugugacaacguccggaaccuaugucucugcuaucgcccaagcgaaagcuagccaggagggcccccucccugagauugaagacgagguguucagaaagcgcaaccugacaaucauggaucuucaccccggguccggaaagacccggagauaccugcccgccauuguucgcgaagccaucaaacggaagcugagaacccucauucuggcuccuacacgcguggucgccagcgagauggcugaagcccuuaaaggcaugccgauccgguaucagacgaccgcggugaagucugagcacacagggaaagagaucguugaccugaugugccaugccaccuuuacaaugagacuccugucccccgugcgcgucccuaauuacaacaugauuaucauggaugaagcucacuucaccgaccccagcucuauugccgcucggggcuauaucagcacgagagugggaaugggcgaggccgccgcuauuuuuaugacagcgaccccucccggguccguggaagccuucccucaaucuaaugcugucauccaggaugaggaacgggacaucccggagcgcagcuggaacuccggauacgaguggauuaccgauuuucccggcaagacaguuugguucgugccuucuaucaagagcgggaaugacauugccaacugucugcgcaagaauggaaagcgggugauccagcucucccgcaaaaccuucgauacagaauaccagaagaccaaaaacaacgacugggacuaugucgugacgacagauauuagcgagaugggcgccaauuuuagagcugaccggguuaucgaucccagacgcugccuuaagccugugauucugaaggacgggcccgaacgggucauccuggccggcccgaugccugugaccguugcgucugcugcccaaagacgcggacggaucggcagaaaccauaauaaagagggggaucaguacauuuauaugggacagccccucaacaaugacgaggaucacgcccauuggacagaagcuaagaugcugcuugacaacaucaauacccccgagggcauuaucccugcccuguucgaacccgagcgcgaaaaauccgcggccauugauggggaguaccggcucagaggagaggcucgcaagacguuuguggaacugaugagacggggcgaccugccugucuggcucagcuauaaaguggccuccgagggguuccaguacucugaucgcagauggugcuuugacggcgaacggaacaaucaaguccuugaggaaaacauggauguggagaucuggaccaaggagggagaacgcaaaaagcugagaccgcgguggcuggacgcuagaacauauagcgacccccucgcccugcgcgaguucaaggaauuugcugccggccggagauccguuucuggggaucuuauccuggagauuggaaaacucccucagcaccugacccagcgcgcgcagaaugcccuggacaaccucgugaugcuucacaauagcgaacaaggcgggcgggcuuacagacaugccauggaggagcugcccgauacaaucgaaacccugaugcuccuggcucuuauugccgugcugacaggaggcgucacccucuucuuucuguccggccgggggcugggaaagacgagcaucggccuccuuuguguuauggccucuuccgugcugcuguggacagcuagcguggagccucacuggauugcggccucuaucauccucgaguucuuucugaugguccuucugauucccgagccggaccgccagagaaccccucaggauaaccagcucgcuuacgugguuaucgggcugcuguucaugauucucaccguggccgccaaugagaugggacuucuggaaacaaccaaaaaggaccugggcaucgggcaugucgcuguggagaaccaccaccaugccgcgaugcucgaugucgaccugcaccccgccuccgcuuggacacuuuaugccguggcuacgaccauuaucacaccuaugaugcggcauaccauugaaaacacaaccgccaauaucagccugacggcgaucgccaaccaagcugccauucucaugggacuggauaaaggcuggcccaucucuaagauggacauuggcguuccucugcucgcucuugggugcuacagccaggugaauccccugacccugacagccgcuguccucaugcugguggcccacuaugcgaucauuggaccgggccuucaggccaaggcuacccgcgaggcccagaagagaacagcugccgggaucaugaagaacccuaccguugauggaaucguggccauugaccuggaucccgucguguacgacgcgaaauuugaaaagcagcucggccagaucaugcugcugauucucuguacgucccagauccuucugaugcggacaaccugggcucugugcgagucuauuacacucgccaccgggccccugaccacacuuugggagggaagcccuggcaaauucuggaauacgaccaucgcuguguccauggccaacaucuuccgcggcagcuaucuggccggggcuggacucgccuuuucccugaugaagucucugggcgggggaagacggggcacaggggcgcaaggagaaacccucggcgagaaguggaaacgccagcuuaaucagcugagcaaguccgaguucaacacauacaaaagaucuggcauuauggagguugaccggagcgaagccaaggaggggcugaaaagaggagagaccacgaagcaugcugucucccgcggcacagccaagcuccggugguuuguggaaagaaaucuggugaaaccggaggggaaggucaucgaucuuggauguggccgcgggggauggucuuauuacugcgcuggccugaaaaagguuaccgaagugaaaggcuacaccaaagggggacccggccacgaggaaccuauucccauggccacauauggguggaaccucgugaaacugcacagcggaaaggacgucuucuuuaucccucccgagaagugugauacccugcucugcgacauuggcgaguccagcccuaauccgacaaucgaagaggggcggacgcuuagagugcugaaaaugguugaacccuggcugcgcggaaaccaguucuguauuaagauccucaauccuuacaugcccucuguggucgagacccuggagcaaaugcagcggaaacauggcggcaugcuugugagaaacccucugucccgcaauagcacacacgaaauguauuggguuucuugcgggaccggaaacaucguguccgcggucaauaugacaagccggaugcuccugaacagauuuaccauggcccaucgcaagcccacguacgagcgggauguggaccugggcgcugggaccagacacguggccgucgaaccggagguugcuaaccucgauauuaucggacagcgcauugaaaauaucaaacacgagcauaagucuacauggcacuaugacgaggauaacccuuacaagaccugggccuaucauggcuccuacgaagugaaacccagcggguccgcuagcucuauggugaauggagucgugaagcugcuuacaaaacccugggacguuauuccuauggugacccagaucgccaugacagauaccacgcccuucggccaacagagagucuuuaaggagaaaguggacacacggaccccuaaggcgaagcgcggcaccgcccagaucauggaaguuacagcuaaauggcuguggggguuccucagcagaaacaagaaaccgcggauuuguacgagagaggaauuuacccggaaggugcgcuccaaugccgcuaucggagccgucuucguggacgagaaccaauggaacucugccaaagaggcgguugaagaugagagauuuugggaccuggugcaccgggaacgcgagcuucauaagcagggcaagugcgcuacaugcgucuacaacaugauggggaaaagagaaaagaaacugggagaguucggcaaggccaaagggagccgggccauuugguauauguggcucggcgcucgcuuccuggaguuugaagcccugggauucaugaaugaggaucacugguuuuccagagaaaacucucucagcggcguggagggggagggacugcacaaacuuggcuacauccugcgggacauuuccaaaauccccgggggaaauauguaugcugaugacaccgccggcugggauacacgcaucaccgaagacgaucuccagaacgaggcgaagauuacagacaucauggaaccugagcaugcccugcuugcuaagucuauuuucaaacugaccuaccagaauaaggucgugagaguucaacggcccgccaaaaacgggacggugauggaugucaucagccgcagagaccagcggggcuccggacaggugggcaccuaugggcucaauacauuuaccaacauggaagcucagcugauucgccaaauggagagcgagggaaucuucucuccuuccgaacuggagacacccaaccucgccggcagagugcuggauuggcuugaaaagcacgggguugagcggcugaaaagaauggcgaucagcggagacgacuguguggucaagccgauugaugaccgcuuugccaccgcucucacggcccugaaugauaugggcaaggugcggaaagacaucccucagugggaacccucuaagggguggaacgauuggcagcagguuccuuucugcucccaucacuuucaccaacuuauuaugaaagacggcagagagaucgugguccccugucgcaaucaggaugagcuggugggacgggcuagagucagccagggcgccggguggucccuccgcgaaacagcuugccugggaaagucuuacgcccagauguggcaacugauguauuuccaucggagagaccuccgccuggcggccaacgcuauuuguagcgccgugccuguugauugggugcccaccucccggacaaccuggagcauccacgcccaucaccaguggaugacgaccgaggacaugcuuucugucuggaauagaguguggauugaagagaacccguggauggaagauaaaacacauaucuccagcuggggcgacguuccuuaccuggggaagcgcgaggaccaguggugcggaucucucaucggccugaccgcucgggccacaugggcgaccaauauucaaguggcuaucaaccaggucagacggcuuauugggaaugagaacuaccuggauuauaugacaagcaugaagagauuuaaaaaugaauccgaccccgagggcgcccucugguga

SEQ ID NO: 19105 - RNA, 9879 nt, Artificial Sequence
  derived and/or modified CDS sequence (opt5) from DENV-1__FJ898403__SS-prME
agcgugacaaugcugcugaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacagaacaguauaaauuccaagccgacucuccuaagcggcugagcgcggccauuggcaaggcuugggaggagggggugugcggcaucagauccgccacccgccuggaaaacaucauguggaagcagauuucuaacgagcucaaucauauccugcuugaaaacgacaugaaauuuacgguuguggucggagauguggcuggcauucuggcccaggggaagaaaaugauccggccgcagcccauggaguacaaguauagcuggaaguccuggggaaaagccaagauuaucggcgcugacgugcaaaauacaaccuucaucauugaugggccuaacacccccgaauguccugacgaucagagagcguggaauaucugggaggucgaggacuacggauuuggcauuuucacaaccaacaucuggcucaaacugcgcgauagcuauacgcagguuugcgaccaccggcugaugucugccgcuauuaaggauuccaaagccgugcacgccgacaugggcuacuggaucgaaagcgagaagaaugaaacauggaaacuugcuagagccucuuucaucgaggugaaaaccuguauuuggcccaagucccauacacucuggagcaacgggguccuggaaucugagaugaucauuccgaaaaucuauggaggcccuauuagccagcacaauuaccgccccggguacuuuacccaaacagcgggaccuuggcaucugggcaagcucgagcuggauuucgaccuuugcgaagggaccacggugguuguggaugagcacugcggaaaccggggccccucccugagaaccacaaccgucacaggcaaaaucauccacgaaugguguugccggagcuguacccucccuccccugcgcuuuaagggggaggacggaugcugguauggcauggagauuagaccggugaaggaaaaagaggaaaaucugguuaagucuaugguguccgcugggagcggagaggucgacuccuucucucuuggccuccuguguaucagcauuaugaucgaagaggugaugcgguccagauggucucgcaaaaugcugaugacggggacacucgccgucuuuuuccugcuuauuaugggacagcugaccuggaacgaucucauccggcugugcauuauggugggcgccaaugcuagcgacagaaugggcauggggacaaccuaccuggcccuuauggcgaccuuuaagaugcgcccuauguucgcugucggacugcucuuuagacggcugacaucccgcgaggugcuccugcuuacgaucggccugucucucguggccagcgucgaacugcccaacucccuggaggaacuuggggauggacuggccaugggcaucaugauucucaaacugcucaccgacuuccagagccaucaacugugggcuacacuucugucucucaccuuuaucaagacaaccuucucccugcacuaugccuggaagacgauggcuaugguucugagcauugugucucuuuuuccccugugucucuccacaaccagccagaaaaccacauggcugccugugcuccuggggucucuuggaugcaagccgcugaccauguuccugaucgccgagaauaaaauuuggggcagaaaguccuggccccucaacgaaggcaucauggcggucgggaucgugagcauucugcuuuccagccugcucaaaaacgauguuccucuggccggaccccucaucgcuggcgggaugcugauugccuguuacgugaucucuggaagcuccgcugaccuuucucuggagaaggccgccgaggucagcugggaagaggaagcugagcauuccggcgcgucucacaauauucugguggaaguucaggaugacgggacaaugaaaaucaaggaugaggagcgggacgauacgcucaccauccugcuuaaggccacacugcucgcugugagcggagucuauccucuguccauucccgccacccucuucgugugguacuuuuggcagaaaaagaaacaacgcucuggcguccugugggacacaccuuccccucccgaaguggagagagccguucuugaugacggcaucuaucggauuaugcagcgcgggcugcugggaagaucccaggugggcgucgggguguuccaggaaaacguuuuucauaccauguggcacgugacgcggggagcuguccucauguaccaaggcaagcgccuggagcccagcugggccucugugaaaaaggaccuuaucuccuacgggggaggcuggagacugcagggcagcuggaauaccggggaggaagugcagguuauugcggucgagcccggaaagaacccuaaaaaugugcagacagcucccggcaccuucaagacaucugaaggggaggugggagccaucgcccucgauuuuaaaccgggcaccuccgggagcccuauugucaaccgggaaggaaagaucgugggccuguauggcaaugggguugugacaacguccggaaccuacgucucugcuaucgcccaagcgaaagcuagccaggagggcccccucccugagauugaagacgagguguucagaaagcgcaaccugacaaucauggaucuucaccccggguccggaaagacccggagauaucugcccgccauuguucgcgaagccaucaaacggaagcugagaacccucauucuggcuccuacacgcguggucgccagcgagauggcugaagcccuuaaaggcaugccgauccgguaccagacgaccgcggugaagucugagcauacagggaaagagaucguugaccugaugugccacgccaccuuuacaaugagacuccugucccccgugcgcgucccuaauuauaacaugauuaucauggaugaagcucauuucaccgaccccagcucuauugccgcucggggcuacaucagcacgagagugggaaugggcgaggccgccgcuauuuuuaugacagcgaccccucccggguccguggaagccuucccucaaucuaaugcugucauccaggaugaggaacgggacaucccggagcgcagcuggaacuccggauaugaguggauuaccgauuuucccggcaagacaguuugguucgugccuucuaucaagagcgggaaugacauugccaacugucugcgcaagaauggaaagcgggugauccagcucucccgcaaaaccuucgauacagaauaccagaagaccaaaaacaacgacugggacuacgucgugacgacagauauuagcgagaugggcgccaauuuuagagcugaccggguuaucgaucccagacgcugccuuaagccugugauucugaaggacgggcccgaacgggucauccuggccggcccgaugccugugaccguugcgucugcugcccaaagacgcggacggaucggcagaaaccacaauaaagagggggaucaguauauuuacaugggacagccccucaacaaugacgaggaucaugcccacuggacagaagcuaagaugcugcuugacaacaucaauacccccgagggcauuaucccugcccuguucgaacccgagcgcgaaaaauccgcggccauugauggggaguaucggcucagaggagaggcucgcaagacguuuguggaacugaugagacggggcgaccugccugucuggcucagcuacaaaguggccuccgagggguuccaguauucugaucgcagauggugcuuugacggcgaacggaacaaucaaguccuugaggaaaacauggauguggagaucuggaccaaggagggagaacgcaaaaagcugagaccgcgguggcuggacgcuagaacauacagcgacccccucgcccugcgcgaguucaaggaauuugcugccggccggagauccguuucuggggaucuuauccuggagauuggaaaacucccucagcaccugacccagcgcgcgcagaaugcccuggacaaccucgugaugcuucauaauagcgaacaaggcgggcgggcuuauagacacgccauggaggagcugcccgauacaaucgaaacccugaugcuccuggcucuuauugccgugcugacaggaggcgucacccucuucuuucuguccggccgggggcugggaaagacgagcaucggccuccuuuguguuauggccucuuccgugcugcuguggauggcuagcguggagccucauuggauugcggccucuaucauccucgaguucuuucugaugguccuucugauucccgagccggaccgccagagaacaccucaggauaaccagcucgcuuacgugguuaucgggcugcuguucaugauucucaccguggccgccaaugagaugggacuucuggaaaccaccaagaaggaccugggcaucgggcacgucgcuguggagaaccaccaucacgccgcgaugcucgaugucgaccugcaucccgccuccgcuuggacccuuuacgccguggcuacaacgauuaucaccccuaugaugcggcacacaauugaaaacaccacagccaauaucagccugaccgcgaucgccaaccaagcugccauucucaugggacuggauaaaggcuggcccaucucuaagauggacauuggcguuccucugcucgcucuugggugcuauagccaggugaauccccugacgcugaccgccgcuguccucaugcugguggcccauuacgcgaucauuggaccgggccuucaggccaaggcuacacgcgaggcccagaagagaaccgcugccgggaucaugaagaacccuacaguugauggaaucguggccauugaccuggaucccgucguguaugacgcgaaauuugaaaagcagcucggccagaucaugcugcugauucucuguaccucccagauccuucugaugcggacgacaugggcucugugcgagucuauuacccucgccacagggccccugaccacccuuugggagggaagcccuggcaaauucuggaauacaacgaucgcuguguccauggccaacaucuuccgcggcagcuaccuggccggggcuggacucgccuuuucccugaugaagucucugggcgggggaagacggggcaccggggcgcaaggagaaacacucggcgagaaguggaaacgccagcuuaaucagcugagcaaguccgaguucaacaccuauaaaagaucuggcauuauggagguugaccggagcgaagccaaggaggggcugaaaagaggagagacaaccaagcacgcugucucccgcggcacggccaagcuccggugguuuguggaaagaaaucuggugaaaccggaggggaaggucaucgaucuuggauguggccgcgggggauggucuuacuauugcgcuggccugaaaaagguuacagaagugaaaggcuacaccaaagggggacccggccacgaggaaccuauucccauggccaccuacggguggaaccucgugaaacugcauagcggaaaggacgucuucuuuaucccucccgagaagugugauacacugcucugcgacauuggcgaguccagcccuaauccgaccaucgaagaggggcggacacuuagagugcugaaaaugguugaacccuggcugcgcggaaaccaguucuguauuaagauccucaauccuuauaugcccucuguggucgagacgcuggagcaaaugcagcggaaacacggcggcaugcuugugagaaacccucugucccgcaauagcacccaugaaauguacuggguuucuugcgggacaggaaacaucguguccgcggucaauaugaccagccggaugcuccugaacagauuuacaauggcccaccgcaagcccaccuaugagcgggauguggaccugggcgcugggacgagacacguggccgucgaaccggagguugcuaaccucgauauuaucggacagcgcauugaaaauaucaaacaugagcacaagucuaccuggcauuacgacgaggauaacccuuauaagacaugggccuaccacggcuccuaugaagugaaacccagcggguccgcuagcucuauggugaauggagucgugaagcugcuuaccaaacccugggacguuauuccuauggugacacagaucgccaugaccgauacaacccccuucggccaacagagagucuuuaaggagaaaguggacacgcggacaccuaaggcgaagcgcggcaccgcccagaucauggaaguuaccgcuaaauggcuguggggguuccucagcagaaacaagaaaccgcggauuuguacaagagaggaauuuacgcggaaggugcgcuccaaugccgcuaucggagccgucuucguggacgagaaccaauggaacucugccaaagaggcgguugaagaugagagauuuugggaccuggugcaucgggaacgcgagcuucacaagcagggcaagugcgcuaccugcgucuacaacaugauggggaaaagagaaaagaaacugggagaguucggcaaggccaaagggagccgggccauuugguacauguggcucggcgcucgcuuccuggaguuugaagcccugggauucaugaaugaggaucacugguuuuccagagaaaacucucucagcggcguggagggggagggacugcauaaacuuggcuauauccugcgggacauuuccaaaauccccgggggaaauauguacgcugaugacacagccggcugggauacccgcaucacagaagacgaucuccagaacgaggcgaagauuaccgacaucauggaaccugagcacgcccugcuugcuaagucuauuuucaaacugacauaucagaauaaggucgugagaguucaacggcccgccaaaaacgggaccgugauggaugucaucagccgcagagaccagcggggcuccggacaggugggcacguacgggcucaauaccuuuacaaacauggaagcucagcugauucgccaaauggagagcgagggaaucuucucuccuuccgaacuggagacccccaaccucgccggcagagugcuggauuggcuugaaaagcaugggguugagcggcugaaaagaauggcgaucagcggagacgacuguguggucaagccgauugaugaccgcuuugccacagcucucaccgcccugaaugauaugggcaaggugcggaaagacguuccucagugggaacccucuaagggguggaacgauuggcaacaggugccuuucugcucccaccacuuucaucaacuuaucaugaaagacggcagagagauugucgugcccugucgcaaucaggaugagcuggucggacgggcuagagugagccagggcgccggguggucccuccgcgaaacggcuugccugggaaagucuuaugcccagauguggcaacugauguacuuccaccggagagaccuccgccuggcggccaacgcuaucuguagcgccguuccuguggauuggguccccacaucccggaccacauggagcauucaugcccaccaucaguggaugaccacggaggacaugcuuucuguguggaauagaguuuggaucgaagagaacccguggauggaagauaaaacccacauuuccagcuggggcgacgugccuuaucuggggaagcgcgaggaccaguggugcggaucucucaucggccugacagcucgggccaccugggcgacaaauauccaagucgcuauuaaccaggugagacggcuuaucgggaaugagaacuaccuggauuacaugaccagcaugaagagauuuaaaaaugaauccgaccccgagggcgcccucugguga

SEQ ID NO: 19106 - RNA, 9879 nt, Artificial Sequence
  derived and/or modified CDS sequence (opt5) from DENV-1__FJ898404__SS-prME
agcgugaccaugcugcucaugcugaugcccaccgcccuugcuuuccaccugacgaccagaggcggggagccucauaugaucgugacaaagcaggaacggggaaaaucccuccuguuuaagaccucugccggcguuaauaugugcacccuuauugccauggaccugggggagcucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuuguuacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaggaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacguccagaauaccaccuuuaucaucgaugggccuaacacacccgaauguccugacgaucagagagcuuggaauauuugggagguugaggacuauggauucggcaucuuuaccacgaacauuuggcugaagcugcgcgauuccuacacacaggugugcgaccaccggcuuaugagcgcggccaucaaagauucuaaggcugugcaugccgacaugggcuauuggauugaauccgagaaaaaugaaaccuggaagcucgccagagcuagcuucaucgaggucaagacauguaucuggcccaaaucucacacccugugguccaacggggugcuggaaagcgagaugauuaucccgaagauuuacggaggcccuaucucucaacauaauuaucgccccggguacuucacacagaccgccggaccuuggcaccucggcaaacuggagcuugauuuugaccugugcgaagggacgaccguuguggucgaugagcacugcggaaaccggggccccagccucagaacaaccacagugaccggcaagauuauccaugaaugguguugccgguccuguacgcugccuccccugcgcuucaaaggggaggacggaugcugguacggcauggagaucagaccgguuaaggaaaaggaggaaaaucuugugaaaagcauggucucugcgggguccggagagguggacagcuuuucccucggccugcuguguauuucuaucaugauugaagagguuaugcggagcagauggucccgcaagaugcucaugacagggacccuggcuguguuccuucugcucaucaugggacagcugacauggaacgaucugauucggcuuugcaucauggucggcgccaaugccucugacagaaugggcauggggaccaccuaucuggcucucauggccacauuuaaaaugcgcccuauguucgcggugggacugcucuuuagacggcugacgagccgcgaggugcuucugcucaccauuggccugucccuggucgcuucuguugaacuucccaacagccuggaggaacucggggauggacuggccaugggcaucaugauccucaagcugcuuacagacuuccaaucccaccagcugugggccacccuccugagccugacauuuauuaaaaccacgcuuucucugcauuacgcuuggaagacaauggccauggugcucuccaucgcuagccuguucccccucugucugucuaccaccucccagaagacaaccuggcuuccugugcugcuggggagccucggaugcaaaccgcugacaauguuucuuauuacggagaccaagaucuggggcagaaaaucuuggccccugaaugaaggcauuauggccgucggggugguuuccauccuccugagcucccuccugaagaacgaugugccucuugcgggaccccugaucgccggcgggaugcugauugcuuguuaugucaucagcggaucuagcgccgaccucucccuggagaaagcugccgaggugucuugggaagaggaagccgagcacagcggcgcuucccauaacauucuuguugugguccaggaugacgggacaaugaagaucaaagaugaggaacgggacgauacccugacaauucuccugaaggcgacccuccuggccgugucuggagucuacccucuuagcauccccgcuacgcuguucgugugguauuuuuggcaaaagaaaaagcagcgcuccggcguucugugggacaccccuucucccccggagguggaaagagccguccucgaugacggcaucuaccggauuaugcagcgcgggcugcuuggaagaagccaggugggcguugggguguuccaagagaaugucuuccacacaauguggcacgugacccggggagccgugcugauguaucagggcaaacgccucgaaccuuccugggcuagcguuaagaaagaccugaucucuuacgggggaggcuggagacuccagggcuccuggaacacaggggaggagguccaggugauugccguggaacccggaaagaauccuaagaacguccaaaccgcgcccggcacauuuaaaacgccggagggggaagugggagcuaucgcccuggauuucaagccuggcaccagcgggucucccauuguuaaucgggagggaaaaaucgugggccuuuacggcaacggggucgugacaaccuccggaaccuauguuagcgccauugcucaggccaaggcgucccaggaaggcccucugcccgagaucgaggacgaaguguuuagaaaacgcaaucugacaaucauggaucuccaucccgggucuggaaagacgcggagauaccugccugcuauuguccgcgaggccaucaagcggaaacuuagaacccugauucucgccccgacacgcgugguugcuagcgaaauggccgaggcucugaagggcaugcccauccgguaucaaaccacagccgugaaauccgaacacaccgggaaggagauugucgaccugaugugccaugcgacguucacaaugagacuccuuagcccugugcgcgugcccaacuacaauaugaucaucauggaugaggcccacuuuaccgacccuucuuccauugcugcccggggcuauaucagcaccagagucggaaugggcgaagcugccgccauuuucaugacagcuacacccccugggucuguugaggcguuuccgcagagcaacgccgugauccaggaugaggaacgggacauucccgaacgcuccuggaacucuggauacgaguggaucacagauuucccuggcaaaaccgugugguuuguccccagcaucaaguccgggaacgacauugcuaauugucugagaaagaacggaaaacgggugauccagcugucucgcaagacguucgauacagaguaucagaagaccaagaauaacgacugggacuacguugugacaaccgauauuagcgaaaugggcgccaacuuuagagccgaccgggucaucgauccuagacgcugccucaaacccgugauucugaaggacgggccggagcggguuauccuugcuggcccuaugcccgugacggucgccuccgcggcucagagacgcggacggauuggcagaaaucauaacaaggaaggggaucaguacaucuauaugggacagccccugaauaacgacgaggaucacgcccacuggaccgaggccaaaaugcuccuggacaauaucaacacaccugaaggcauuauccccgcucuguucgagccugaacgcgaaaagagcgccgcgauugauggggaauaccggcucagaggagaggcccgcaaaaccuucguggagcuuaugagacggggcgaccugccggucuggcugucuuauaagguggcuuccgaaggguuucaauacagcgaucgcagauggugcuucgacggcgagcggaauaaccagguucucgaagagaauauggauguggaaaucuggacaaaagagggagagcgcaagaaacugagaccccgguggcuugacgccagaaccuauuccgacccucuggcucuccgcgaauuuaaggaguucgccgcuggccggagaucugugagcggggaucugauucuggaaaucggaaagcucccccagcaucuuacacagcgcgcccaaaacgcgcuggacaaucuggucaugcuccacaacuccgagcagggcgggcgggccuacagacaugcuauggaggaacugccugauaccaucgagacgcuuaugcugcucgcccugauugcuguucugacaggaggcgugacccucuuuuuccuuucuggccgggggcugggaaaaaccagcaucggccugcucugugugauggccuccagcguccugcuuuggauggccucuguggaaccccacuggauugcugcguccaucauucuggaguuuuuccucaugguucugcugaucccggaaccugaccgccagagaacaccccaggauaaucaacucgccuauguggucaucgggcuucuguuuaugauucugaccguggcugccaacgagaugggacuccuggagacaacgaagaaagaccuuggcaucgggcacgucgccguggaaaaucaucaccaugcuaccaugcuggauguugaccuccacccugccagcgcguggacacuguacgccguggcuaccacaauuaucacccccaugaugcggcauacgauugagaacaccacagccaacaucucucugaccgcuauugccaaucaggcggccauccucaugggacuugauaagggcuggccuaucuccaaaauggacauuggcgucccccugcuggcucucgggugcuacagccaggugaacccgcugacacuuaccgccgcuguucugaugcucguggcccacuaugcuaucauuggaccuggccugcaagccaaggcgacgcgcgaagcccagaagagaacagcugccgggaucaugaaaaaucccaccgucgauggaauuguggcuaucgaccuggaucccgugguuuacgacgccaaguucgagaaacagcucggccagaucaugcuucugauucuguguacaucucaaauccuccugaugcggaccaccugggcccuuugcgaaagcauuacacuggcgacggggccucucaccacacugugggagggauccccgggcaaguuuuggaacaccacaaucgcugucucuauggccaauauuuuccgcggcagcuaucuggcuggggccggacucgccuuuucccuuaugaaaagccugggcgggggaagacggggcaccggggcucagggagagacgcugggcgaaaaguggaagcgccagcucaaccagcuguccaaaucugaguucaauaucuacaagagaagcggcaucauggaaguggaccgguccgaggccaaagaagggcuuaagagaggagagacaacccgccacgcggugucucggggcaccgccaaacugagaugguucgucgagcgcaaccucguuaagcccgaagggaaggugauugaucugggauguggcagagggggauggagcuauuacugcgcuggccugaaaaaggugacagaggucaaaggcuauaccaaagggggaccuggccaugaggagcccaucccuauggccacauacggguggaaucucgugaaacuucacuccggaaaggacgucuuuuucacgcccccugaaaaaugugauacccugcugugcgacauuggcgagucuagcccgaaccccacaaucgaggaagggagaacccuccgcgugcugaagauggucgagccuuggcuucggggaaaucaauuuuguauuaagauccugaaccccuacaugccuuccgugguugaaacacucgagcagaugcagagaaaacauggcggcaugcuggugcgcaauccccugagccggaacucuacccacgagauguauugggucuccugcgggacgggaaauauugugagcgcugugaacaugaccucuagaaugcuccugaaucgcuucacaauggcccaccggaagccgaccuacgaaagagaugucgaccuuggcgcggggacacgccauguugccguggagccugaaguggcuaaccuggauaucaucggacagagaauugagaacaucaaacacgaacauaaguccaccuggcacuaugacgaggauaaucccuacaaaacaugggccuaucauggcagcuacgaggucaagcccucuggguccgcuagcuccauggugaacggaguugugaagcuccugaccaaaccuugggacgucauucccauggugacgcaaaucgccaugacagauaccaccccuuuuggccagcagcggguuuucaaggaaaaaguggacacacgcacgccgaaggcuaaaagaggcaccgcccaaauuauggaggucacagcgcgguggcuuuggggguuucugagcagaaauaagaagccccggaucuguacccgcgaagaguucacaagaaaagugcggucuaacgccgcuaucggagccguuuuuguggacgaaaaucaguggaacagcgcuaaggaggccgucgaggaugaacgcuucugggaccucgugcagaaagagagagaacugcacaagcagggcaaaugcgcgaccugcgucuauaauaugauggggaagcgggagaagaaacugggagaauuuggcaaggcgaaagggucccgcgcuauuugguacauguggcucggcgccagauuccuggaguuugaggcccuuggauucaugaacgaagaucacugguucucucgggagaauagccuguccggcguggaaggggagggacuccauaagcugggcuacauccuucgcgacauuucuaaaaucccugggggaaacauguaugcugaugacacagccggcugggauaccagaauuacggaggacgaucugcaaaaugaagcuaagaucaccgacaucauggagcccgaacacgcccuccuggcgacaagcauuuuuaaacugaccuaccagaacaagguugugcggguccagcgcccugccaagaaugggacagugauggaugugaucuccagacgggaccagcgcggcucuggacaaguuggcaccuaugggcucaacacguucacaaauauggaggcucagcugauuagacagauggaaagcgagggaaucuuucuucccuccgagcuggaaaccccgaaccucgccgagcgggugcuggauuggcuugaaaaauacggcgucgagagacugaagcgcauggcuauuagcggggacgacugugugguuaaaccuaucgaugaccgguucgccacagcgcucaccgcccugaacgauaugggaaaggugagaaaagacaucccccagugggaaccuucuaagggcuggaaugauuggcaacagguccccuuuugcucccaucacuuccaccagcugauuaugaaggacgggcgcgagaucguggucccuugucggaaccaggaugagcucgugggcagagcucgcguuagccaaggagccggcuggucucugcgggaaacggcuugccuugggaaauccuaugcccagauguggcagcugauguacuuucauagacgcgaccuccggcuggcugccaaugcgauuuguagcgccgugcccgucgauugggugccgaccuccagaacaaccuggucuauccacgcucaucaccaauggaugacaaccgaggacaugcuuagcguuuggaaccgcguguggauugaagagaauccuuggauggaagauaagacacaugucuccagcuggggagacgugcccuaucugggcaaacgggaggaccaguggugcgggucucucaucggacugaccgccagagccacgugggcuuccaacauucagguggccaucaaucagguucggagacugaucggcaacgagaauuaccucgauuacaugacaagcaugaagcgcuucaaaaacgaaggggaccccgagggcgcgcugugguga

SEQ ID NO: 19107 - RNA, 9879 nt, Artificial Sequence
  derived and/or modified CDS sequence (opt5) from DENV-1__GQ199840__SS-prME
agcgugaccaugcugcugaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugccauggaccugggggaguucugugaagauacaaugaccuacaaaugcccgcgcaucacagaagcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaaguuuacgguuguggucggagauguggcuggcauucuggcccaggggaaaaagaugauccggccgcaacccauggaguacaaauauagcuggaaguccuggggaaaggccaaaauuaucggcgcugacgugcagaauacaaccuucaucauugaugggccuaacacccccgaauguccugacgaucagagagcguggaauaucugggaggucgaggacuacggauuuggcauuuucacaaccaacaucuggcucaagcugcgcgauagcuauacgcagguuugcgaccaccggcugaugucugccgcuauuaaagauuccaaggccgugcacgccgacaugggcuacuggaucgaaagcgagaaaaaugaaacauggaaacuugcuagagccucuuucaucgaggugaagaccuguauuuggcccaaaucccauacacucuggagcaacgggguccuggaaucugagaugaucauuccgaagaucuauggaggcccuauuagccaacacaauuaccgccccggguacuuuacccagacagcgggaccuuggcaucugggcaaacucgagcuggauuucgaccuuugcgaagggaccacggugguuguggaugagcacugcggaaaccggggccccucccugagaaccacaaccgucacaggcaagaucauccacgaaugguguugccggagcuguacccucccuccccugcgcuuuaaaggggaggacggaugcugguauggcauggagauuagaccggugaaggaaaaggaggaaaaucugguuaaaucuaugguguccgcugggagcggagaggucgacuccuucucucuuggccuccuguguaucagcauuaugaucgaagaggugaugcgguccagauggucucgcaagaugcugaugacggggacacucgccgucuuuuuccugcuuauuaccggacagcugacauggaacgaucucauccggcugugcauuauggugggcgccaaugcuagcgacagaaugggcauggggaccaccuaccuggcccuuauggcgacauuuaaaaugcgcccuauguucgcugucggacugcucuuuagacggcugacgucccgcgaggugcuccugcuuaccaucggccugucucucguggccagcgucgaacugcccaacucccuggaggaacuuggggauggacuggccaugggcaucaugauucucaagcugcucacagacuuccaaagccaucagcugugggcuacccuucugucucucacauuuaucaaaaccacguucucccugcacuaugccuggaagacaauggcuaugguucugagcauugugucucuuuuuccccugugucucuccaccaccagccagaagacaaccuggcugccugugcuccuggggucucuuggaugcaaaccgcugacaauguuccugaucgccgagaauaagauuuggggcagaaaauccuggccccucaacgaaggcaucauggcggucgggaucgugagcauucugcuuuccagccugcucaagaacgauguuccucuggccggaccccucaucgcuggcgggaugcugauugccuguuacgugaucucuggaagcuccgcugaccuuucucuggagaaagccgccgaggucagcugggaagaggaagcugagcauuccggcgcgucucacaauauucugguggaaguucaggaugacgggacgaugaagaucaaagaugaggagcgggacgauacccucacaauccugcuuaaggccacccugcucgcugugagcggagucuauccucuguccauucccgccacacucuucgugugguacuuuuggcaaaagaaaaagcagcgcucuggcguccugugggacaucccuuccccucccgaaguggagagagccguucuugaugacggcauuuaucggaucaugcagcgcgggcugcugggaagaucccaggugggcgucgggguguuccaagaaaacguuuuucauaccauguggcacgugacgcggggagcuguccucauguaccagggcaaacgccuggagcccagcugggccucugugaagaaagaccuuauuuccuacgggggaggcuggagacugcagggcagcuggaauaccggggaggaagugcagguuaucgcggucgagcccggaaagaacccuaagaaugugcaaacagcucccggcaccuucaaaacaucugaaggggaggugggagccauugcccucgauuuuaagccgggcaccuccgggagcccuaucgucaaccgggaaggaaaaaucgugggccuguauggcaaugggguugugacaacguccggaaccuacgucucugcuauugcccaggcgaaggcuagccaggagggcccccucccugagaucgaagacgagguguucagaaaacgcaaccugacaauuauggaucuucaccccggguccggaaagacccggagauaucugcccgccaucguucgcgaagccauuaagcggaaacugagaacccucauccuggcuccuacacgcguggucgccagcgagauggcugaagcccuuaagggcaugccgauccgguaccaaacgaccgcggugaaaucugagcauacagggaaggagauuguugaccugaugugccacgccaccuuuacaaugagacuccugucccccgugcgcgucccuaauuauaacaugaucauuauggaugaagcucauuucaccgaccccagcucuaucgccgcucggggcuacauuagcacgagagugggaaugggcgaggccgccgcuaucuuuaugacagcgaccccucccggguccguggaagccuucccucagucuaaugcugucauccaggaugaggaacgggacauuccggagcgcagcuggaacuccggauaugaguggaucaccgauuuucccggcaaaacaguuugguucgugccuucuauuaagagcgggaaugacaucgccaacugucugagaaagaauggaaaacgggugauucagcucucccgcaagaccuucgauacagaauaccagaagaccaagaacaacgacugggacuacgucgugacgacagauaucagcgagaugggcgccaauuuuagagcugaccggguuauugaucccagacgcugccuuaaaccugugauccugaaggacgggcccgaacgggucauccuggccggcccgaugccugugaccguugcgucugcugcccagagacgcggacggauuggcagaaaccacaauaaggagggggaucaguauaucuacaugggacagccccucaacaaugacgaggaucaugcccacuggacagaagcuaaaaugcugcuugacaacauuaauacccccgagggcaucauuccugcccuguucgaacccgagcgcgaaaaguccgcggccaucgauggggaguaucggcucagaggagaggcucgcaaaacguuuguggaacugaugagacggggcgaccugccugucuggcucagcuacaagguggccuccgagggguuccaauauucugaucgcagauggugcuuugacggcgaacggaacaaucagguccuugaggaaaacauggauguggagaucuggaccaaagagggagaacgcaagaaacugagaccgcgguggcuggacgcuagaacauacagcgacccccucgcccugcgcgaguucaaggaauuugcugccggccggagauccguuucuggggaucuuauucuggagaucggaaagcucccucagcaccugacccagcgcgcgcaaaaugcccuggacaaccucgugaugcuucauaauagcgaacagggcgggcgggcuuauagacacgccauggaggagcugcccgauacaauugaaacccugaugcuccuggcucuuaucgccgugcugacaggaggcgucacccucuucuuucuguccggccgggggcugggaaaaacgagcauuggccuccuuuguguuauggccucuuccgugcugcuguggauggcuagcguggagccucauuggaucgcggccucuaucauucucgaguucuuucugaugguccuucugauccccgagccggaccgccagagaacaccucaggauaaccaacucgcuuacgugguuauugggcugcuguucaugauccucaccguggccgccaaugagaugggacuucuggaaaccacaaagaaagaccugggcauugggcacgucgcugccgagaaccaccaucacgcggccaugcucgauguggaccugcaucccgcuuccgccuggacccuuuacgcugucgccacaacgaucauuaccccuaugaugcggcacacaaucgaaaacaccacagcgaauaucagccugaccgccauugcuaaccaggccgcuauccucaugggacuggauaagggcuggcccauuucuaaaauggacaucggcgugccucugcucgcccuugggugcuauagccagguuaauccccugacgcugaccgcugccgugcucaugcuggucgcgcauuacgccauuaucggaccgggccuucaagcuaaggccacacgcgaggcucagaagagaaccgccgccgggaucaugaaaaacccuacaguggauggaauuguugcgaucgaccuggaucccguggucuaugacgcuaaguuugaaaaacagcucggccagauuaugcugcugauccucuguaccucccaaauucuucugaugcggacgacaugggcccugugcgagucuaucacccucgcuacagggccccugaccacccuuugggagggaagcccuggcaaguucuggaauacaacgaucgccguguccauggccaacauuuuccgcggcagcuaccuggcuggggccggacucgcguuuucccugaugaaaucucugggcgggggaagacggggcaccggggcccagggagaaacacucggcgagaaguggaagcgccagcuuaaucagcugagcaaauccgaguucaacaccuauaagagaucuggcaucauggagguggaccggagcgaagcuaaagaggggcugaagagaggagagacaaccaaacacgccguuucccgcggcacggcuaagcuccggugguuugucgaaagaaaucuggugaagccggaggggaaagugauugaucuuggauguggccgcgggggauggucuuacuauugcgccggccugaagaaagucacagaaguuaagggcuacaccaaagggggacccggccacgaggaaccuauccccauggcgaccuacggguggaaccucgugaagcugcauagcggaaaagacguguucuuuauuccucccgagaagugugauacacugcucugcgacaucggcgaguccagcccuaauccgaccauugaagaggggcggacacuuagaguccugaagaugguggaacccuggcugcgcggaaaccaauucuguaucaaaauccucaauccuuauaugcccucuguuguggagacgcuggagcagaugcagcggaagcacggcggcaugcuugucagaaacccucugucccgcaauagcacccaugaaauguacugggugucuugcgggacaggaaacauuguuuccgccgugaauaugaccagccggaugcuccugaacagauuuacaauggcucaccgcaaacccaccuaugagcgggaugucgaccugggcgccgggacgagacacguggcuguggaaccggaggucgccaaccucgauaucauuggacagcgcaucgaaaauauuaagcaugagcacaaaucuaccuggcauuacgacgaggauaacccuuauaagacaugggcuuaccacggcuccuaugaaguuaagcccagcggguccgccagcucuauggugaauggaguggucaaacugcuuaccaagcccugggacgugaucccuaugguuacacaaaucgcgaugaccgauacaacccccuucggccagcagagaguguuuaaagagaaggucgacacgcggacaccuaaagccaagcgcggcaccgcucaaauuauggaagugaccgccaaguggcuguggggguuccucagcagaaacaaaaagccgcggaucuguacaagagaggaauuuacgcggaaaguucgcuccaaugcugccauuggagccguguucgucgacgagaaccaguggaacucugcgaaggaggcuguggaagaugagagauuuugggaccugguucaucgggaacgcgagcuucacaaacagggcaagugcgcgaccugcguguacaacaugauggggaagagagagaagaagcugggagaguucggcaaagccaaggggagccgggcuaucugguacauguggcucggcgcccgcuuccuggaguuugaagcucugggauucaugaaugaggaucacugguuuuccagagaaaacucucucagcggcgucgagggggagggacugcauaaacuuggcuauauucugcgggacaucuccaagauccccgggggaaauauguacgccgaugacacagcgggcugggauacccgcauuacagaagacgaucuccagaacgaggccaaaaucaccgacauuauggaaccugagcacgcucugcuugccaagucuaucuucaagcugacauaucaaaauaaaguggucagagugcagcggcccgcuaagaacgggaccguuauggaugugauuagccgcagagaccagcggggcuccggacaggucggcacguacgggcucaauaccuuuacaaacauggaagcccaacugauccgccagauggagagcgagggaaucuucucuccuuccgaacuggagacccccaaccucgcgggcagagugcuggauuggcuugaaaaauaugggguggagcggcugaagagaauggccauuagcggagacgacuguguugugaaaccgaucgaugaccgcuuugcuacagcccucaccgcucugaaugauaugggcaagguccggaaggacauuccucagugggaacccucuaaaggguggaacgauuggcagcaagugccuuucugcucccaucacuuucaccagcuuaucaugaaggacggcagagagauuguugugcccugucgcaaucaggaugagcuggucggacgggccagagugagccagggcgcuggguggucccuccgcgaaacggccugccugggaaaaucuuacgcgcaaauguggcagcugauguauuuccaucggagagaccuccgccuggccgcuaacgccaucuguagcgccgucccuguggauuggguucccacaucccggaccacauggagcauucacgcucaucaccaguggaugaccacggaggacaugcuuucuguguggaauagagucuggaucgaagagaacccguggauggaagauaagacccauaucuccagcuggggcgacgugccuuaccuggggaaacgcgaggaccaauggugcggaucucucauuggccugacagcccgggcgaccugggcuacaaauauccagguugccauuaaccaggugagacggcuuaucgggaaugagaacuaccuggauuauaugaccagcaugaagagauuuaagaaugaauccgaccccgagggcgcccucugguga

SEQ ID NO: 19108 - RNA, 9879 nt, Artificial Sequence
  derived and/or modified CDS sequence (opt5) from DENV-1__FJ898405__SS-prME
uccgugaccaugcugcucaugcugaugcccaccgcccuugcuuuccaccugacgaccagaggcggggaaccucauaugaucgucaccaagcaggaacggggaaaaucccuccuguuuaagaccucugccggcguuaauaugugcacccuuauugccauggaccugggggaacucugugaagauaccaugacauacaaaugcccgcgcaucaccgaggcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcaauauugggaagauguuugaggccacagcuagaggcgcccgccggauggcgauccugggagauaccgccugggacuucggcuccaucgggggaguguuuacaucuguuggcaaacugguccaucagauuuucgggaccgcuuacggagugcucuuuagcggcguguccuggacgaugaagaucgggauuggcguccugcuuaccuggcugggacucaacagcagaucuacaucccugagcaugaccuguaucgccgugggccugguuacacuuuaccucggggugaugguccaggcugauucuggaugcgugauuaauuggaaaggccgcgaacugaaguguggguccggaaucuucguuaccaacgaggugcacacauggaccgaacaauauaaguuucaggccgacagcccuaaacggcuguccgcggccauuggcaaggcuugggaggagggggucugcggcaucagaucugccacgcgccucgaaaacaucauguggaaacagauuagcaaugagcugaaccauauccuucuggaaaaugacaugaaguucacagugguugugggagaugucgugggcauucucgcucaggggaaaaagaugauccggccgcaacccauggagcacaaauacuccuggaagucuuggggaaaggccaaaauuaucggcgccgacgugcagaacaccaccuuuaucauugaugggccuaauacacccgaauguccugacgaucagagagcuuggaacaucugggaggucgaggacuauggauucggcauuuuuaccacgaauaucuggcugaagcugcgcgauagcuacacacagguuugcgaccaccggcuuauguccgcggccauuaaagauagcaaggcugugcaugccgacaugggcuauuggaucgaaucugagaaaaacgaaaccuggaagcucgccagagcuuccuucaucgaggugaagacauguauuuggcccaaaagccacacccuguggucuaaugggguccuggaauccgagaugaucauuccgaagaucuacggaggcccuauuagccaacauaacuaucgccccggguacuucacacagaccgccggaccuuggcaccucggcaaacuggagcuugauuuugaccugugcgaagggacgaccgugguuguggaugagcacugcggaaaucggggccccucucucagaacaaccacagucaccggcaagaucauccaugaaugguguugccggagcuguacgcugccuccccugcgcuucaaaggggaggacggaugcugguacggcauggagauuagaccggugaaggaaaaggaggaaaaccuuguuaaauccauggugagcgcggggucuggagaggucgacuccuuuagccucggccugcuguguaucuccauuaugaucgaagaggugaugcggucuagauggagccgcaagaugcucaugacagggacccuggcuguuuuccuucugcucauuaugggacagcugacauggaaugaucugauccggcuuugcauuauggugggcgccaacgccuccgacagaaugggcauggggaccaccuaucuggcucucauggccacauuuaaaaugcgcccuauguucgcggucggacugcucuuuagacggcugacgucucgcgaggugcuucugcucaccaucggccugagccugguggcuuccgucgaacuucccaauucucuggaggaacucggggauggacuggccaugggcaucaugauucucaagcugcuuacagacuuccaaagccaccagcugugggccacccuccugucccugacauuuaucaaaaccacgcuuagccugcauuacgcuuggaagacaauggccaugguucucucuauugugucccuguucccccucugucugagcaccaccucucagaagacaaccuggcuuccugugcugcuggggucccucggaugcaaaccgcugacaauguuucuuaucgcugagaacaagauuuggggcagaaaaagcuggccccugaacgaaggcaucauggccgucggggugguuucuauccuccuguccagccuccugaagaaugaugugccucuugcgggaccccugauugccggcgggaugcugaucgcuuguuaugucauuuccggaagcucugccgaccucagccuggagaaagcugccgagguguccugggaagaggaagccgagcacucuggcgcuagccauaacauccuuguugaagugcaggaugacgggacgaugaagauuaaagaugaggagcgggacgauacccugacaauccuccugaaggcgacccuccuggccgucuccggaguguacccucuuucuauccccgcuacacuguucgucugguauuuuuggcaaaagaaaaagcagcgcagcggcgugcugugggacaccccuagcccucccgaaguugagagagccgugcucgaugacggcauuuaccggaucaugcagcgcgggcugcuuggaagaucucaggucggcguggggguuuuccaagaaaauguguuccacacgauguggcacgucacccggggagccgugcugauguaucagggcaaacgccucgagcccagcugggcuuccgugaagaaagaccugauuagcuacgggggaggcuggagacuccagggcucuuggaacacaggggaggaaguucaggucaucgccguggagcccggaaagaauccuaagaacgugcaaaccgcgcccggcacauuuaaaaccccggaaggggaggucggagcuauugcccuggauuucaagccuggcacauccgggagccccaucgugaaucgggaaggaaaaauuguuggccuuuacggcaacgggguggucacgaccucuggaacauauguguccgccaucgcucaggccaaggcgagccaggagggcccucugcccgagaucgaagacgagguuuuuagaaaacgcaaucugaccauuauggaucuccaucccggguccggaaagacccggagauaccugccugcuaucgugcgcgaagccauuaagcggaaacuuagaacacugauccucgccccgacgcgcgucguggcuucugagauggccgaagcucugaagggcaugcccauucgguaucaaaccacagccguuaaaagcgagcacaccgggaaggagaucguggaccugaugugccaugcgacauucaccaugagacuccuuuccccuguccgcgugcccaacuacaauaugaucauuauggaugaagcccacuuuacggacccuagcucuaucgcugcccggggcuauauuuccacaagagugggaaugggcgaggcugccgccaucuucaugaccgcuacacccccugggagcgucgaagcguuuccgcagucuaacgccguuauucaggaugaggaacgggacauccccgagcgcagcuggaacuccggauacgaguggaucacagauuucccuggcaaaaccgugugguuugugcccucuauuaagagcgggaacgacaucgcuaauugucugagaaagaacggaaaacgggucauucagcugucccgcaagacauucgauaccgaauaucagaagacgaagaacaaugacugggacuacgugguuacaaccgauaucucugagaugggcgccaacuuuagagccgaccgggugauugauccuagacgcugccucaaacccgucauccugaaggacgggccggaacgggugauucuugcuggcccuaugcccguuacaguggccagcgcggcucagagacgcggacggaucggcagaaaucauaacaaggagggggaucaguacaucuauaugggacagccccugaauaacgacgaggaucacgcccacuggaccgaagccaaaaugcuccuggacaauauuaacacgccugagggcaucauucccgcucuguucgaaccugagcgcgaaaaguccgccgcgaucgauggggaguaccggcucagaggagaggcccgcaaaaccuucgucgaacuuaugagacggggcgaccugccgguguggcugagcuauaaggucgcuucugagggguuucaauacuccgaucgcagauggugcuucgacggcgaacggaauaaccaggugcucgaggaaaauauggauguugagauuuggacaaaagagggagaacgcaagaaacugagaccccgguggcuugacgccagaaccuauagcgacccucuggcucuccgcgaguuuaaggaguucgccgcuggccggagauccgugucuggggaucugauccuggagaucggaaagcucccccagcaucuuacacagcgcgcccaaaacgcgcuggacaaucuggugaugcuccacaacagcgaacagggcgggcgggccuacagacaugcuauggaggagcugccugauaccauugaaacacuuaugcugcucgcccugaucgcuguccugaccggaggcguuacgcucuuuuuccuuuccggccgggggcugggaaaaacaucuauuggccugcucugugugauggccagcuccgugcugcuuuggauggccagcgucgagccccacuggaucgcugcgucuauuauccuggaauuuuuccucauggugcugcugaucccggagccugaccgccagagaacaccccaggauaaucaacucgccuauguugugauugggcuucuguuuaugauccugaccgucgcugccaacgagaugggacuccuggaaacaaccaagaaagaccuuggcauugggcacguggccgucgagaaccaucaccaugcuacaaugcuggauguggaccuccacccugccuccgcguggacgcuguacgccguugcuaccacaaucauuacccccaugaugcggcauacaaucgaaaauaccacggccaacauuagccugaccgcuaucgccaaucaggcggccauccucaugggacuugauaagggcuggccuauuucuaaaauggacaucggcgugccccugcuggcucucgggugcuacucccaggucaacccgcugacacuuaccgccgcugugcugaugcucguugcccacuaugcuauuaucggaccuggccugcaagccaaggcgacacgcgaggcccagaagagaaccgcugccgggauuaugaaaaaucccacgguggauggaaucgucgcuaucgaccuggaucccgugguguacgacgccaaguucgaaaaacagcucggccagauuaugcuucugauccuguguacaagccaaauucuccugaugcggaccacaugggcccuuugcgagucuaucacccuggcgaccgggccucucacaacgcugugggagggaagcccgggcaaguuuuggaacaccacaauugcuguuuccauggccaauaucuuccgcggcucuuaucuggcuggggccggacucgccuuuagccuuaugaaaucccugggcgggggaagacggggcaccggggcucagggagaaacacugggcgagaaguggaagcgccagcucaaccagcugagcaaauccgaguucaauaucuacaagagaucuggcauuauggaggucgaccggagcgaagccaaagaggggcuuaagagaggagagaccacgcgccacgcggugucccggggcacagccaaacugagaugguucguggaacgcaaccucgucaagcccgaggggaagguuaucgaucugggauguggcagagggggauggucuuauuacugcgcuggccugaaaaaggugaccgaagugaaaggcuauaccaaagggggaccuggccaugaggaacccauuccuauggccacauacggguggaaucucgucaaacuucacagcggaaaggacguguuuuucacacccccugagaaaugugauacacugcugugcgacaucggcgaguccucuccgaaccccacgauugaagaggggagaacccuccgcguucugaagaugguggaaccuuggcuucggggaaaucaauuuuguaucaagauucugaaccccuacaugccuagcgucguggagacacucgagcagaugcagagaaaacauggcggcaugcugguucgcaauccccugucccggaacagcacccacgaaauguauugggugucuugcgggacaggaaauaucgucuccgcugugaacaugaccagcagaaugcuccugaaccgcuucacgauggcccaccggaagccgaccuacgagagagauguggaccuuggcgcggggacacgccaugucgccguugaaccugagguggcuaaucuggauaucauuggacagagaaucgaaaacauuaaacacgagcauaagucuaccuggcacuaugacgaggauaaucccuacaaaacaugggccuaucauggcuccuacgaagugaagcccagcgggucugcuuccagcauggucaacggagugguuaagcuccugaccaaaccuugggacgugauccccauggucacacaaauugccaugaccgauacgacaccuuuuggccagcagcggguguucaaggagaaaguugacacccgcaccccgaaggcuaaaagaggcacagcccaaaucauggaagugacggcgcgguggcuuuggggguuucuguccagaaauaagaagccccggaucuguacccgcgaggaguucacaagaaaaguccggagcaacgccgcuauuggagccguguuuguugacgagaaucaguggaacucugcuaaggaggccguggaagaugagcgcuucugggaccucguccagaaagaaagagagcugcacaagcagggcaaaugcgcgaccugcguguauaauaugauggggaagcgggaaaagaaacugggagaguuuggcaaggcgaaagggagccgcgcuaucugguacauguggcucggcgccagauuccuggaguuugaagcccuuggauucaugaacgaggaucacugguucucccgggaaaauucucugagcggcgucgagggggagggacuccauaagcugggcuacauucuucgcgacaucuccaaaauuccugggggaaacauguaugcugaugacacagccggcugggauaccagaaucacagaagacgaucugcaaaaugaggcuaagaucaccgacauuauggaacccgagcacgcccuccuggcgacgucuaucuuuaaacugaccuaccagaacaaggugguucgggugcagcgcccugccaagaaugggacagucauggaugugauuagcagacgggaccagcgcggcuccggacaagugggcaccuaugggcucaacacauucaccaacauggaagcucagcugaucagacagauggagucugagggaauuuuuagccccuccgaacuugagaucccgaaucuggccgaacggguucucgauuggcuggagaaauacggcguggaaagacuuaagcgcauggcuaucagcggggacgacugugucgugaaaccuauugaugaccgguucgccacggcgcugacagcccucaacgauaugggaaagguuagaaaagacgugccccagugggagccuucuaagggcuggaaugauuggcaacagguccccuuuugcucccaucacuuccaccagcugaucaugaaggacgggcgcgagauuguggucccuugucggaaccaggaugaacuggugggcagagcucgcguuagccaaggagccggcuggucucuccgggagaccgcuugccuggggaaauccuaugcccagauguggcagcuuauguacuuucauagacgcgaccugcggcucgcugccaaugcgaucuguagcgccgugcccgucgauugggugccgacauccagaaccacguggucuauucacgcucaucaccaauggaugaccacagaagacaugcugagcguuuggaaccgcguguggaucgaggaaaauccuuggauggaggauaagacccaugucuccagcuggggagacgugcccuaucuuggcaaacgggaggaccaguggugcgggucucugauuggacucacagccagagccaccugggcuuccaacauccagguggccaucaaucagguucggagacugauuggcaacgaaaauuaccuggauuacaugacaagcaugaagcgcuucaaaaacgagggggaccccgaaggcgcgcucugguga

SEQ ID NO: 19109 - RNA, 9879 nt, Artificial Sequence
  derived and/or modified CDS sequence (opt5) from DENV-1__FJ898406__SS-prME
uccgugaccaugcugcucaugcugaugcccaccgcccuugcuuuccaccugacgaccagaggcggggaaccucauaugaucgucaccaagcaggaacggggaaaaucccuccuguuuaagaccucugccggcguuaauaugugcacccuuauugccauggaccugggggaacucugugaagauaccaugacauacaaaugcccgcgcaucaccgaggcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcaauauugggaagauguuugaggccacagcuagaggcgcccgccggauggcgauccugggagauaccgccugggacuucggcuccaucgggggaguguuuacaucuguuggcaaacugguccaucagauuuucgggaccgcuuacggagugcucuuuagcggcguguccuggacgaugaagaucgggauuggcguccugcuuaccuggcugggacucaacagcagaucuacaucccugagcaugaccuguaucgccgugggccugguuacacuuuaccucggggugaugguccaggcugauucuggaugcgugauuaauuggaaaggccgcgaacugaaguguggguccggaaucuucguuaccaacgaggugcacacauggaccgaacaauauaaguuucaggccgacagcccuaaacggcuguccgcggccauuggcaaggcuugggaggagggggucugcggcaucagaucugccacgcgccucgaaaacaucauguggaaacagauuagcaaugagcugaaccauauccuucuggaaaaugacaugaaguucacagugguugugggagaugucgugggcauucucgcucaggggaaaaagaugauccggccgcaacccauggagcacaaauacuccuggaagucuuggggaaaggccaaaauuaucggcgccgacgugcagaacaccaccuuuaucauugaugggccuaauacacccgaauguccugacgaucagagagcuuggaacaucugggaggucgaggacuauggauucggcauuuuuaccacgaauaucuggcugaagcugcgcgauagcuacacacagguuugcgaccaccggcuuauguccgcggccauuaaagauagcaaggcugugcaugccgacaugggcuauuggaucgaaucugagaaaaacgaaaccuggaagcucgccagagcuuccuucaucgaggugaagacauguauuuggcccaaaagccacacccuguggucuaaugggguccuggaauccgagaugaucauuccgaagaucuacggaggcccuauuagccaacauaacuaucgccccggguacuucacacagaccgccggaccuuggcaccucggcaaacuggagcuugauuuugaccugugcgaagggacgaccgugguuguggaugagcacugcggaaaucggggccccucucucagaacaaccacagucaccggcaagaucauccaugaaugguguugccggagcuguacgcugccuccccugcgcuucaaaggggaggacggaugcugguacggcauggagauuagaccggugaaggaaaaggaggaaaaccuuguuaaauccauggugagcgcggggucuggagaggucgacuccuuuagccucggccugcuguguaucuccauuaugaucgaagaggugaugcggucuagauggagccgcaagaugcucaugacagggacccuggcuguuuuccuucugcucauuaugggacagcugacauggaaugaucugauccggcuuugcauuauggugggcgccaacgccuccgacagaaugggcauggggaccaccuaucuggcucucauggccacauuuaaaaugcgcccuauguucgcggucggacugcucuuuagacggcugacgucucgcgaggugcuucugcucaccaucggccugagccugguggcuuccgucgaacuucccaauucucuggaggaacucggggauggacuggccaugggcaucaugauucucaagcugcuuacagacuuccaaagccaccagcugugggccacccuccugucccugacauuuaucaaaaccacgcuuagccugcauuacgcuuggaagacaauggccaugguucucucuauugugucccuguucccccucugucugagcaccaccucucagaagacaaccuggcuuccugugcugcuggggucccucggaugcaaaccgcugacaauguuucuuaucgcugagaacaagauuuggggcagaaaaagcuggccccugaacgaaggcaucauggccgucggggugguuucuauccuccuguccagccuccugaagaaugaugugccucuugcgggaccccugauugccggcgggaugcugaucgcuuguuaugucauuuccggaagcucugccgaccucagccuggagaaagcugccgagguguccugggaagaggaagccgagcacucuggcgcuagccauaacauccuuguugaagugcaggaugacgggacgaugaagauuaaagaugaggagcgggacgauacccugacaauccuccugaaggcgacccuccuggccgucuccggaguguacccucuuucuauccccgcuacacuguucgucugguauuuuuggcaaaagaaaaagcagcgcagcggcgugcugugggacaccccuagcccucccgaaguugagagagccgugcucgaugacggcauuuaccggaucaugcagcgcgggcugcuuggaagaucucaggucggcguggggguuuuccaagaaaauguguuccacacgauguggcacgucacccggggagccgugcugauguaucagggcaaacgccucgagcccagcugggcuuccgugaagaaagaccugauuagcuacgggggaggcuggagacuccagggcucuuggaacacaggggaggaaguucaggucaucgccguggagcccggaaagaauccuaagaacgugcaaaccgcgcccggcacauuuaaaaccccggaaggggaggucggagcuauugcccuggauuucaagccuggcacauccgggagccccaucgugaaucgggaaggaaaaauuguuggccuuuacggcaacgggguggucacgaccucuggaacauauguguccgccaucgcucaggccaaggcgagccaggagggcccucugcccgagaucgaagacgagguuuuuagaaaacgcaaucugaccauuauggaucuccaucccggguccggaaagacccggagauaccugccugcuaucgugcgcgaagccauuaagcggaaacuuagaacacugauccucgccccgacgcgcgucguggcuucugagauggccgaagcucugaagggcaugcccauucgguaucaaaccacagccguuaaaagcgagcacaccgggaaggagaucguggaccugaugugccaugcgacauucaccaugagacuccuuuccccuguccgcgugcccaacuacaauaugaucauuauggaugaagcccacuuuacggacccuagcucuaucgcugcccggggcuauauuuccacaagagugggaaugggcgaggcugccgccaucuucaugaccgcuacacccccugggagcgucgaagcguuuccgcagucuaacgccguuauucaggaugaggaacgggacauccccgagcgcagcuggaacuccggauacgaguggaucacagauuucccuggcaaaaccgugugguuugugcccucuauuaagagcgggaacgacaucgcuaauugucugagaaagaacggaaaacgggucauucagcugucccgcaagacauucgauaccgaauaucagaagacgaagaacaaugacugggacuacgugguuacaaccgauaucucugagaugggcgccaacuuuagagccgaccgggugauugauccuagacgcugccucaaacccgucauccugaaggacgggccggaacgggugauucuugcuggcccuaugcccguuacaguggccagcgcggcucagagacgcggacggaucggcagaaaucauaacaaggagggggaucaguacaucuauaugggacagccccugaauaacgacgaggaucacgcccacuggaccgaagccaaaaugcuccuggacaauauuaacacgccugagggcaucauucccgcucuguucgaaccugagcgcgaaaaguccgccgcgaucgauggggaguaccggcucagaggagaggcccgcaaaaccuucgucgaacuuaugagacggggcgaccugccgguguggcugagcuauaaggucgcuucugagggguuucaauacuccgaucgcagauggugcuucgacggcgaacggaauaaccaggugcucgaggaaaauauggauguugagauuuggacaaaagagggagaacgcaagaaacugagaccccgguggcuugacgccagaaccuauagcgacccucuggcucuccgcgaguuuaaggaguucgccgcuggccggagauccgugucuggggaucugauccuggagaucggaaagcucccccagcaucuuacacagcgcgcccaaaacgcgcuggacaaucuggugaugcuccacaacagcgaacagggcgggcgggccuacagacaugcuauggaggagcugccugauaccauugaaacacuuaugcugcucgcccugaucgcuguccugaccggaggcguuacgcucuuuuuccuuuccggccgggggcugggaaaaacaucuauuggccugcucugugugauggccagcuccgugcugcuuuggauggccagcgucgagccccacuggaucgcugcgucuauuauccuggaauuuuuccucauggugcugcugaucccggagccugaccgccagagaacaccccaggauaaucaacucgccuauguugugauugggcuucuguuuaugauccugaccgucgcugccaacgagaugggacuccuggaaacaaccaagaaagaccuuggcauugggcacguggccgucgagaaccaucaccaugcuacaaugcuggauguggaccuccacccugccuccgcguggacgcuguacgccguugcuaccacaaucauuacccccaugaugcggcauacaaucgaaaauaccacggccaacauuagccugaccgcuaucgccaaucaggcggccauccucaugggacuugauaagggcuggccuauuucuaaaauggacaucggcgugccccugcuggcucucgggugcuacucccaggucaacccgcugacacuuaccgccgcugugcugaugcucguugcccacuaugcuauuaucggaccuggccugcaagccaaggcgacacgcgaggcccagaagagaaccgcugccgggauuaugaaaaaucccacgguggauggaaucgucgcuaucgaccuggaucccgugguguacgacgccaaguucgaaaaacagcucggccagauuaugcuucugauccuguguacaagccaaauucuccugaugcggaccacaugggcccuuugcgagucuaucacccuggcgaccgggccucucacaacgcugugggagggaagcccgggcaaguuuuggaacaccacaauugcuguuuccauggccaauaucuuccgcggcucuuaucuggcuggggccggacucgccuuuagccuuaugaaaucccugggcgggggaagacggggcaccggggcucagggagaaacacugggcgagaaguggaagcgccagcucaaccagcugagcaaauccgaguucaauaucuacaagagaucuggcauuauggaggucgaccggagcgaagccaaagaggggcuuaagagaggagagaccacgcgccacgcggugucccggggcacagccaaacugagaugguucguggaacgcaaccucgucaagcccgaggggaagguuaucgaucugggauguggcagagggggauggucuuauuacugcgcuggccugaaaaaggugaccgaagugaaaggcuauaccaaagggggaccuggccaugaggaacccauuccuauggccacauacggguggaaucucgucaaacuucacagcggaaaggacguguuuuucacacccccugagaaaugugauacacugcugugcgacaucggcgaguccucuccgaaccccacgauugaagaggggagaacccuccgcguucugaagaugguggaaccuuggcuucggggaaaucaauuuuguaucaagauucugaaccccuacaugccuagcgucguggagacacucgagcagaugcagagaaaacauggcggcaugcugguucgcaauccccugucccggaacagcacccacgaaauguauugggugucuugcgggacaggaaauaucgucuccgcugugaacaugaccagcagaaugcuccugaaccgcuucacgauggcccaccggaagccgaccuacgagagagauguggaccuuggcgcggggacacgccaugucgccguugaaccugagguggcuaaucuggauaucauuggacagagaaucgaaaacauuaaacacgagcauaagucuaccuggcacuaugacgaggauaaucccuacaaaacaugggccuaucauggcuccuacgaagugaagcccagcgggucugcuuccagcauggucaacggagugguuaagcuccugaccaaaccuugggacgugauccccauggucacacaaauugccaugaccgauacgacaccuuuuggccagcagcggguguucaaggagaaaguugacacccgcaccccgaaggcuaaaagaggcacagcccaaaucauggaagugacggcgcgguggcuuuggggguuucuguccagaaauaagaagccccggaucuguacccgcgaggaguucacaagaaaaguccggagcaacgccgcuauuggagccguguuuguugacgagaaucaguggaacucugcuaaggaggccguggaagaugagcgcuucugggaccucguccagaaagaaagagagcugcacaagcagggcaaaugcgcgaccugcguguauaauaugauggggaagcgggaaaagaaacugggagaguuuggcaaggcgaaagggagccgcgcuaucugguacauguggcucggcgccagauuccuggaguuugaagcccuuggauucaugaacgaggaucacugguucucccgggaaaauucucugagcggcgucgagggggagggacuccauaagcugggcuacauucuucgcgacaucuccaaaauuccugggggaaacauguaugcugaugacacagccggcugggauaccagaaucacagaagacgaucugcaaaaugaggcuaagaucaccgacauuauggaacccgagcacgcccuccuggcgacgucuaucuuuaaacugaccuaccagaacaaggugguucgggugcagcgcccugccaagaaugggacagucauggaugugauuagcagacgggaccagcgcggcuccggacaagugggcaccuaugggcucaacacauucaccaacauggaagcucagcugaucagacagauggagucugagggaauuuuuagccccuccgaacuugagaucccgaaucuggccgaacggguucucgauuggcuggagaaauacggcguggaaagacuuaagcgcauggcuaucagcggggacgacugugucgugaaaccuauugaugaccgguucgccacggcgcugacagcccucaacgauaugggaaagguuagaaaagacgugccccagugggagccuucuaagggcuggaaugauuggcaacagguccccuuuugcucccaucacuuccaccagcugaucaugaaggacgggcgcgagauuguggucccuugucggaaccaggaugaacuggugggcagagcucgcguuagccaaggagccggcuggucucuccgggagaccgcuugccuggggaaauccuaugcccagauguggcagcuuauguacuuucauagacgcgaccugcggcucgcugccaaugcgaucuguagcgccgugcccgucgauugggugccgacauccagaaccacguggucuauucacgcucaucaccaauggaugaccacagaagacaugcugagcguuuggaaccgcguguggaucgaggaaaauccuuggauggaggauaagacccaugucuccagcuggggagacgugcccuaucuuggcaaacgggaggaccaguggugcgggucucugauuggacucacagccagagccaccugggcuuccaacauccagguggccaucaaucagguucggagacugauuggcaacgaaaauuaccuggauuacauggcgagcaugaagcgcuucaaaaacgagggggaccccgaaggcgcucucugguga

SEQ ID NO: 19110 - RNA, 9879 nt, Artificial Sequence
  derived and/or modified CDS sequence (opt5) from DENV-1__GQ199841__SS-prME
agcgugaccaugcugcucaugcugaugcccaccgcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucucucacauuuauuaagaccacguucucccugcacuaugccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuacgugauuucuggaagcuccgcugaccuuucucuggagaaggccgccgaggucagcugggaagaggaagcugagcauuccggcgcgucucacaauauccugguggaaguucaggaugacgggacgaugaaaauuaaggaugaggagcgggacgauacccucacaauccugcuuaaggccacccugcucgcugugagcggagucuauccucuguccauccccgccacacucuucgugugguacuuuuggcagaaaaagaaacaacgcucuggcguccugugggacaccccuuccccucccgaaguggagagagccguucuugaugacggcauuuaucggaucaugcagcgcgggcugcugggaagaucccaggugggcgucgggguguuccaggaaaacguuuuucauacgauguggcacgugacccggggagcuguccucauguaccaaggcaagcgccuggagcccagcugggccucugugaaaaaggaccuuauuuccuacgggggaggcuggagacugcagggcagcuggaauacaggggaggaagugcagguuaucgcggucgagcccggaaagaacccuaaaaaugugcagaccgcucccggcacauucaagaccucugaaggggaggugggagccauugcccucgauuuuaaaccgggcacauccgggagcccuaucgucaaccgggaaggaaagauugugggccuguauggcaaugggguugugacgaccuccggaacauacgucucugcuaucgcccaagcgaaagcuagccaggagggcccccucccugagaucgaagacgagguguucagaaagcgcaaccugaccauuauggaucuucaccccggguccggaaagacccggagauaucugcccgccaucguucgcgaagccauuaaacggaagcugagaacacucauccuggcuccuacgcgcguggucgccagcgagauggcugaagcccuuaaaggcaugccgauucgguaccagaccacagcggugaagucugagcauaccgggaaagagaucguugaccugaugugccacgccacauuuaccaugagacuccugucccccgugcgcgucccuaauuauaacaugaucauuauggaugaagcucauuucacggaccccagcucuaucgccgcucggggcuacauuagcacaagagugggaaugggcgaggccgccgcuaucuuuaugaccgcgaccccucccggguccguggaagccuucccucaaucuaaugcugucauucaggaugaggaacgggacaucccggagcgcagcuggaacuccggauaugaguggaucacagauuuucccggcaagaccguuugguucgugccuucuauuaagagcgggaaugacaucgccaacugucugcgcaagaauggaaagcgggugauucagcucucccgcaaaacauucgauaccgaauaccagaagacgaaaaacaacgacugggacuacgucgugacaaccgauaucagcgagaugggcgccaauuuuagagcugaccggguuauugaucccagacgcugccuuaagccugugauccugaaggacgggcccgaacgggucauucuggccggcccgaugccugugacaguugcgucugcugcccaaagacgcggacggaucggcagaaaccacaauaaagagggggaucaguauaucuacaugggacagccccucaacaaugacgaggaucaugcccacuggaccgaagcuaagaugcugcuugacaacauuaauacgcccgagggcaucauuccugcccuguucgaacccgagcgcgaaaaauccgcggccaucgauggggaguaucggcucagaggagaggcucgcaagaccuuuguggaacugaugagacggggcgaccugccugucuggcucagcuacaaaguggccuccgagggguuccaguauucugaucgcagauggugcuuugacggcgaacggaacaaucaaguccuugaggaaaacauggauguggagauuuggacaaaggagggagaacgcaaaaagcugagaccgcgguggcuggacgcuagaaccuacagcgacccccucgcccugcgcgaguucaaggaauuugcugccggccggagauccguuucuggggaucuuauccuggagaucggaaaacucccucagcaccugacacagcgcgcgcagaaugcccuggacaaccucgugaugcuucauaauagcgaacaaggcgggcgggcuuauagacacgccauggaggagcugcccgauaccauugaaacacugaugcuccuggcucuuaucgccgugcugaccggaggcgucacgcuguucuuucuguccggccgggggcugggaaagacaagcauuggccuccuuuguguuauggccucuuccgcucugcuguggauggcgagcguggagccucauuggaucgccgcuucuauuauccucgaguucuuucugauggugcuucugauccccgagccggaccgccagagaaccccucaggauaaccagcucgccuacgucgugauugggcugcuguucaugauccucaccguugccgcuaaugagaugggacuucuggaaacaaccaaaaaggaccugggcauugggcacguggccgucgagaaccaccaucacgcggccaugcucgauguggaccugcaucccgcuuccgccuggacacuuuacgcugucgccacgaccaucauuacaccuaugaugcggcacaccaucgaaaacacaaccgcgaauauuagccugacggccaucgcuaaccaagccgcuauccucaugggacuggauaaaggcuggcccauuucuaagauggacaucggcgugccucugcucgcccuugggugcuauagccagguuaauccccugacccugacagcugccgugcucaugcuggucgcgcauuacgccauuaucggaccgggccuucaggcuaaggccacccgcgaggcucagaagagaacagccgccgggauuaugaagaacccuaccguggauggaaucguugcgaucgaccuggaucccguggucuaugacgcuaaauuugaaaagcagcucggccagauuaugcugcugauccucuguacgucccagauucuucugaugcggacaaccugggcccugugcgagucuaucacacucgcuaccgggccccugaccacacuuugggagggaagcccuggcaaauucuggaauacgaccauugccguguccauggccaacaucuuccgcggcagcuaccuggcuggggccggacucgcguuuucccugaugaagucucugggcgggggaagacggggcacaggggcccaaggagaaacccucggcgagaaguggaaacgccagcuuaaucagcugagcaaguccgaguucaacacauauaaaagaucuggcaucauggagguggaccggagcgaagcuaaggaggggcugaaaagaggagagaccacgaagcacgccguuucccgcggcacagcuaagcuccggugguuugucgaaagaaaucuggugaaaccggaggggaaggugauugaucuuggauguggccgcgggggauggucuuacuauugcgccggccugaaaaaggucaccgaaguuaaaggcuacaccaaagggggacccggccacgaggaaccuauccccauggcgacauacggguggaaccucgugaaacugcauagcggaaaggacguguucuuuauuccucccgagaagugugauacccugcucugcgacaucggcgaguccagcccuaauccgacaauugaagaggggcggacgcuuagaguccugaaaaugguggaacccuggcugcgcggaaaccaguucuguaucaagauucucaauccuuauaugcccucuguuguggagacccuggagcaaaugcagcggaaacacggcggcaugcuugucagaaacccucugucccgcaauagcacacaugaaauguacugggugucuugcgggaccggaaacaucguuuccgccgugaauaugacaagccggaugcuccugaacagauuuaccauggcucaccgcaagcccacguaugagcgggaugucgaccugggcgccgggaccagacacguggcuguggaaccggaggucgccaaccucgauaucauuggacagcgcaucgaaaauauuaaacaugagcacaagucuacauggcauuacgacgaggauaacccuuauaagaccugggcuuaccacggcuccuaugaaguuaaacccagcggguccgccagcucuauggugaauggaguggucaagcugcuuacaaaacccugggacgugaucccuaugguuacccagauugcgaugacagauaccacgcccuucggccaacagagaguguuuaaggagaaagucgacacacggaccccuaaggccaagcgcggcaccgcucagaucauggaagugacagccaaauggcuguggggguuccucagcagaaacaagaaaccgcggaucuguacgagagaggaauuuacccggaagguucgcuccaaugcugccauuggagccguguucgucgacgagaaccaauggaacucugcgaaagaggcuguggaagaugagagauuuugggaccugguucaucgggaacgcgagcuucacaagcagggcaagugcgccacaugcguguacaacaugauggggaaaagagaaaagaaacugggagaguucggcaaggccaaagggagccgggcuaucugguacauguggcucggcgcccgcuuccuggaguuugaagcucugggauucaugaaugaggaucacugguuuuccagagaaaacucucucagcggcgucgagggggagggacugcauaaacuuggcuauauucugcgggacaucuccaaaauucccgggggaaauauguacgccgaugacaccgcgggcugggauacacgcaucaccgaagacgaucuccagaacgaggccaagaucacagacauuauggaaccugagcacgcucugcuugccaagucuaucuucaaacugaccuaucagaauaagguggucagagugcaacggcccgcuaaaaacgggacgguuauggaugugauuagccgcagagaccagcggggcuccggacaggucggcaccuacgggcucaauacauuuaccaacauggaagcccagcugauccgccaaauggagagcgagggaauuuucucuccuuccgaacuggagacacccaaccucgcgggcagagugcuggauuggcuugaaaagcaugggguggagcggcugaaaagaauggccaucagcggagacgacuguguugugaagccgaucgaugaccgcuuugcuaccgcccucacggcucugaaugauaugggcaagguccggaaagacauuccucagugggaacccucuaagggguggaacgauuggcaacaggugccuuucugcucccaccacuuucaucaacuuaucaugaaagacggcagagagauuguugugcccugucgcaaucaggaugagcuggucggacgggccagagugagccagggcgcuggguggucccuccgcgaaacagccugccugggaaagucuuaugcgcagauguggcaacugauguacuuccaccggagagaccuccgccuggccgcuaacgccaucuguagcgccgucccuguggauuggguucccaccucccggacaaccuggagcauucaugcucaccaucaguggaugacgaccgaggacaugcuuucuguguggaauagagucuggaucgaagagaacccguggauggaagauaaaacacacauuuccagcuggggcgacgugccuuaucuggggaagcgcgaggaccaguggugcggaucucucaucggccugaccgcccgggcgacaugggcuaccaauauccaaguugccauuaaccaggugagacggcuuaucgggaaugagaacuaccuggauuacaugacaagcaugaagagauuuaaaaaugaauccgaccccgagggcgcccucugguga

SEQ ID NO: 19111 - RNA, 9879 nt, Artificial Sequence
  derived and/or modified CDS sequence (opt5) from DENV-1__FJ898407__SS-prME
agcgugaccaugcugcucaugcugaugcccaccgcucuugcuuuccaccugacgaccagaggcggggaaccucauaugaucgucuccaagcaggaacggggaaagucucuccuguuuaagaccagcgccggcguuaauaugugcacccuuaucgcgauggaccugggggagcucugugaagauacgaugaccuacaagugcccgagaaucacagagguggaacccgacgauguggacuguuggugcaauaccacggauaccugggucacauauggaaccuguucccaaacaggcgagcacagacgggacaagcgcucuguggcucuggccccucauguugggcugggacucgagaccagagccgaaacguggaugagcuccgagggcgcuuggaaacagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaagauaagcccacacuggacaucgaacugcucaaaaccgagguuacaaacccugcugugcugcggaaacuuugcauugaagccaaaaucuccaauaccacgacagauagccgcuguccgacccaaggagaggcgacccugguggaagaacaggacgccaacuucgucugcagacggacauuuguggaucgcggcuggggcaauggguguggacucuucggcaaggggucucugauuaccugcgcuaaguuuaaaugcguuacaaaacuugagggaaaaaucgugcaguacgaaaaccugaaguauuccgucaucgugacgguucacaccggcgaccagcaucaaguggggaaugagagcacagaacacggaaccacagccaccauuacgccccaggcuccuaccucugagauccagcucacagacuacggcgcccugacccuggauuguucccccagaacaggccucgacuucaacgaaaugguccugcuuaccaugaaagaaaaguccuggcuggugcauaaacagugguuucucgaucugccucuucccuggacguccggggccucuacaagccaagagaccuggaaucggcaggaccugcucgucacauucaagaccgcucacgcgaagaaacaggaagugguugugcugggaucccaagagggcgccaugcacaccgcucugacaggggccacggaaauucagaccagcggaacaaccacaaucuuugccggccaucucaagugccgccugaaaauggauaaacuuacccugaaagggaugucuuaugucauguguacgggcuccuucaagcucgagaaggaaguggcugagacacagcacggaaccguucuggugcagauuaaauacgagggcaccgacgccccgugcaagaucccuuucagcacacaagaugaaaaaggggucacccagaacggaagacugaucacagcgaaucccauugugacggacaaggagaaaccugugaacaucgaagcugagccgcccuuuggcgagucuuauauuguuaucggggccggagaaaaggcccuuaagcucagcugguucaaaaagggcuccucuauugggaaaauguuugaggcuaccgcccggggcgcuagacgcauggccauccugggagauacagcgugggacuucggcagcaucgggggagucuuuaccuccgugggcaagcuggugcaucagauuuucgggacagccuacggaguccucuuuagcggcgugucuuggaccaugaaaaucgggauuggcguucugcuuacguggcugggacucaauucccggagcaccucucuguccaugacauguaucgcugugggccuggucacccuuuaccucggggugaugguucaggccgauagcggaugcgugauuaacuggaagggcagagaacugaaguguggguccggaaucuucgucacaaaugaggugcacaccuggacagaacaauauaaauuucaggcugacucuccuaagcgccugagcgccgcgauuggcaaagccugggaggaggggguuugcggcauccgguccgcuaccagacucgaaaacaucauguggcgccagauuucuaacgagcugaaucauauccuucuggaaaacgacaugaaguucacgguggucgugggagauguggucggcauucucgcccaggggaaaaagaugauccggccgcaacccauggagcacaaauacagcuggaaguccuggggaaaggcuaaaauuaucggcgccgacguucagaauacaaccuuuaucauugaugggccuaacacccccgaauguccugacgaucagagagccuggaauaucugggagguggaggacuauggauucggcauuuuuacaaccaacaucuggcugaagcugcgcgauagcuacacacaggugugcgaccaccggcuuaugucugcugcgauuaaagauuccaaggccguccaugcugacaugggcuauuggaucgaaagcgagaaaaaugaaacauggaagcucgccagagccucuuucaucgaggugaagaccuguauuuggcccaaaucccacacacuguggagcaacgggguucuggaaucugagaugaucauuccgaagaucuacggaggcccuauuagccaacauaauuaucgccccggguacuucacccagacagcuggaccuuggcaccucggcaaacuggagcuugauuuugaccugugcgaagggaccacgguggucguggaugagcacugcggaaaccggggccccucccucagaaccacaaccguuacaggcaagaucauccaugaaugguguugccggagcuguacccugccuccccugcgcuucaaaggggaggacggaugcugguacggcauggagauuagaccggugaaggaaaaggaggaaaaucuugucaaaucuaugguguccgccgggagcggagagguugacuccuuuucucucggccugcuguguaucagcauuaugaucgaagaggugaugcgguccagauggucucgcaagaugcucaugacggggacacuggcggucuucuuucuucugauuaugggacagcucaccuggaacgaucugauccggagcugcauuauggugggcgcuaaugccuccgacagaaugggcauggggacaaccuaucuggcccuuauggcuaccuucaaaaugcgcccuauguuugccgugggacuccuguucagacggcugacaucucgcgagguccuccugcuuacgaucggccugagccucguugcguccguggaacugcccaacagccuggaggaacuuggggauggacuggcuaugggcaucaugauucucaagcugcucaccgacuuucaaucuuaccagcugugggccacacuucugucccucaccuucaucaaaacaaccuuuagccugcacuaugccuggaagacgauggcuauggugcugucuauugucucccuucugccccucugucugagcacaaccucucagaagaccacauggcucccugugcugcuugggucccugggaugcaaaccgcugaccauguuccucaucgccgagaauaagauuuggggcagaaaaagcuggccccugaacgaaggcaucauggcuguugggaucguguccauucuucugagcucucuccugaagaacgaugucccucucgccggaccccugaucgcgggcgggaugcuuauugccuguuacgugaucagcggauccucugcugaccugagccuggagaaagccgcugagguuuccugggaagaggaagccgagcauucuggcgccagccacaauauucucguggaaguccaggaugacgggacaaugaagaucaaagaugaggagcgggacgauacgcugaccauccuucugaaggcuacacuccuggcgguguccggagucuauccucucucuauucccgccacccuguuugugugguacuucuggcaaaagaaaaagcagcgcagcggcguucuuugggacacaccuagcccucccgaaguggagagagcuguccuggaugacggcaucuaucggauuaugcagcgcgggcugcucggaagaagccaggugggcguugggguguuccaagaaaacgucuuucauaccauguggcacgugacgcggggagccgugcugauguaccagggcaaacgccuugagcccucuugggccuccguuaagaaagaccugaucagcuacgggggaggcuggagacuccagggcucuuggaauaccggggaggaaguccaggugauugcuguggagcccggaaagaacccuaagaauguccaaacagcccccggcaccuucaaaacaccggaaggggaggugggagcgaucgcucuggauuuuaagccuggcaccuccgggagccccauuguuaaccgggaaggaaaaaucgugggccucuauggcaauggggucgugacaacguccggaaccuacguuucugccaucgcccagacaaaggcuagccaggagggcccucugcccgagauugaagacgagguguucagaaaacgcaaccuuaccaucauggaucugcaccccggguccggaaagacccggagauaucugccugccauuguccgcgaagcgaucaagcggaaacucagaacacugauucuugcuccgacgcgcgugguugccagcgagauggccgaagcucugaagggcaugcccauccgguaccaaaccacagccgugaaaucugagcauaccgggagagagaucgucgaccucaugugccacgcuacauuuaccaugcgccugcuguccccugugcgggugcccaauuauaacaugauuaucauggaugaagcccauuucacggacccuagcucuauugcggccagaggcuacaucagcacacgggucggaaugggcgaggcugccgcuauuuuuaugaccgccacacccccuggguccguugaagccuucccgcagucuaaugcugugauccaggaugaggaacgcgacauccccgagagaagcuggaacuccggauaugaguggauuacagauuuuccuggcaagaccgugugguucguccccucuaucaaaagcgggaaugacauugcgaacugucuccggaagaauggaaagcgcgugauccagcuuuccagaaaaacauuugauaccgaauaccaaaagacgaaaaacaacgacugggacuacguugugacaaccgauauuagcgagaugggcgccaauuuccgggcugacagagucaucgauccucgccggugccugaagcccgugauucugaaagacgggccggaaagaguuauccucgccggcccuaugcccgugacagucgccucugcugcccagcgccggggaagaaucggccgcaaccacaauaaggagggggaucaguauauuuacaugggacagccccugaacaaugacgaggaucaugcgcacuggaccgaagcuaagaugcuucuggacaacaucaauacgccugagggcauuauccccgcccucuucgaaccugagcgggaaaaauccgccgcuauugauggggaguauagacugcgcggagaggccagaaagaccuuuguggaacugaugcggcgcggcgaccucccggucuggcuuagcuacaaaguggcguccgagggguuccaauauucugauagacgguggugcuuugacggcgaacgcaacaaucagguucuggaggaaaacauggauguggagaucuggacaaaggagggagaacgcaagaagcugcggcccagauggcucgacgcccgcaccuacagcgacccucuggcccuucgggaguucaaagaauuugccgcuggcagacgcuccgugucuggggaucugauccucgagauuggaaagcugccccagcaccugacacagcgggcccaaaaugcucucgacaaccuugucaugcugcauaauagcgaacagggcgggagagccuaucggcacgcgauggaggagcugccugauaccaucgaaacacucaugcugcuugcccugauugcuguucucaccggaggcgugacgcuguucuuucuguccggccgcgggcucggaaagacaagcaucggccuucugugugugauggccucuuccgcucugcucuggauggccagcgucgagccccauuggauugccgcuucuaucauccuggaguucuuucuuauggugcugcucauuccggagccugacagacagcggacaccccaggauaaccaacuggcguacguugugaucgggcuccuguucaugauucuuaccgucgccgcuaaugagaugggacugcuggaaacaaccaaaaaggaccucggcaucgggcacguggccgucgagaaccaccaucacgccacaaugcuggauguggaccuucauccugcuuccgccuggacgcuguacgcgguugccaccacaauuaucacccccaugaugcgccacacaauugaaaacaccacggcuaauaucagccucaccgccaucgcuaaccaggccgcgauucugaugggacuggauaaaggcuggccuaucucuaagauggacauuggcgugccccuccuugcccuggggugcuauagccaggucaauccgcugacacucaccgcugccgugcugaugcuuguugcucauuacgccaucauuggaccuggccugcaagcuaaagccacaagagaggcgcagaagcggaccgccgcugggaucaugaagaaccccacgguggauggaaucgucgccauugaccucgaucccgugguguaugacgcuaaauuugaaaagcagcugggccagaucaugcugcucauucuuuguacaucccaaauccugcugaugcgcaccacaugggcccucugcgagucuauuacccuggccaccgggccucuuacaacgcugugggagggaagcccgggcaaauucuggaauaccacaaucgcgguuuccauggcuaacaucuuuagaggcagcuaccucgccggggcuggacuggccuucucccugaugaagucucucggcgggggacggcgcggcaccggggcccagggagaaacacuuggcgagaaauggaagagacagcugaaucagcugagcaaguccgaguucaacaccuauaaacggucuggcauuauggaggucgacagaagcgaagcuaaggaggggcuccgccggggagagacgacaaaacacgccguguccagaggcaccgcgaagcugcgcugguuuguggaacggaaucuugucaaacccgaggggaagguuaucgaucugggauguggcagagggggauggucuuacuauugcgccggccucaagaaagugaccgaagugaagggcuacacaaaagggggaccuggccacgaggaacccauuccuauggcuaccuacggguggaaccuggucaagcugcauagcggaaaagacguguucuuuauucccccugagaagugugauacacuccuuugcgacauuggcgaguccagcccgaaucccacgaucgaagaggggcgcacccugcggguucugaaaaugguggaaccuuggcucagaggaaaccaauucuguauuaagauccugaaucccuauaugccuucugucguggagacacuugagcagaugcagcgcaagcacggcggcaugcugguucggaacccccucuccagaaauagcacccaugaaauguacugggugucuugcgggacaggaaacaucgucuccgccgugaauaugaccagccgcaugcugcugaaccgguuuacgauggcucacagaaaaccgaccuaugagcgcgauguggaccucggcgccgggacaagacacgucgcgguugaaccugagguggccaaccuggauauuaucggacagcggauugaaaauaucaagcaugagcacaaaucuaccuggcauuacgacgaggauaaccccuauaagacaugggcuuaccacggcuccuaugaagugaaacccagcggguccgccagcucuauggucaauggagugguuaaacuucugaccaagccuugggacgugauucccauggucacacaaaucgcuaugaccgauacgacaccuuucggccagcagcgcguguuuaaagagaagguugacaccagaaccccgaaagccaagcggggcacagcucaaaucauggaagugacggccagauggcucuggggguuccugagccggaacaaaaagccccgcauuuguaccagagaggaauuuacacggaagguccgcuccaaugcggccaucggagcuguguucguugacgagaaccaguggaacucugccaaagaggcuguggaagaugagagauuuugggaccuuguccaucgggaacgcgagcugcacaagcagggcaaaugcgcuaccugcguguacaacaugauggggaagagagagaagaagcucggagaguucggcaaggccaaagggagccgggcgauuugguacauguggcugggcgcucgcuuucuggaguucgaagcccucggauucaugaaugaggaucacugguuuuccagagaaaacucucugagcggcgucgagggggagggacuucauaagcugggcuauauccuccgggacauuuccaaaaucccugggggaaauauguacgccgaugacacagcuggcugggauacccgcaucacagaagacgaucugcagaacgaggccaagauuaccgacaucauggaacccgagcacgcccuucuggccacgucuauuuucaaacucaccuaucaaaauaaggugguuagagugcagcggccugcgcgcaacgggacagucauggaugugaucagcagacgggaccagagaggcuccggacaggugggcaccuacgggcugaauacauuuaccaacauggaagcccaacugauucgccagauggagagcgagggaaucuucucucccuccgaacucgagacgccgaaccuggcugaacggguucuugauuggcuggagaaacauggcguggaaagacucaagcgcauggccaucagcggggacgacugugucgugaagccuauugaugaccgguuugcuacagcccugucugcgcuuaaugauaugggaaaaguuagaaaggacaucccccagugggagccuuccaaaggcuggaacgauuggcagcaagugcccuucugcagccaccacuuucaucagcugauuaugaaggacgggcgcgagaucgucgugccuugucggaaucaggaugaacucgucggcagagcccgcgugucccagggagcuggcuggucucugcgggagaccgccugccuggggaaaagcuaugcucaaauguggcagcucauguacuuccacagacgcgaccugcggcuugccgcuaacgccauuuguuccgcgguucccguggauugggucccgacaagcagaaccacguggucuauccaugcccaccaucaguggaugaccacagaagacaugcuguccguguggaaucggguuuggauugaggaaaacccuuggauggaggauaagacccacaucagcucuuggggagacgugcccuaucucggcaagagagaggaccaauggugcgggagccugaucggacuuacagcucgcgccaccugggccacaaauauucaggucgcuaucaaccaggugcggagacugauuggcaaugaaaacuaccucgauuacaugaccuccaugaaacgcuuuaagaaugagucugaccccgaaggggcccugugguga

SEQ ID NO: 19112 - RNA, 9879 nt, Artificial Sequence
  derived and/or modified CDS sequence (opt5) from DENV-1__FJ898408__SS-prME
agcgugaccaugcugcugaugcugaugcccaccgcccuugcuuuccaccugacgacccggggaggggaaccucauaugaucgucacaaagcaggaacggggaaaaucccuccuguuuaagaccucugccggcguuaacaugugcacacuuauugcgauggaccugggggaacucugugaagauaccaugacauacaaaugcccccgcaucaccgaggcugaacccgacgauguggacuguuggugcaaugccacggauaccugggugacauauggaaccuguagccagacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacggaaugaaguucacagugguugugggcgacgucguggggauucucgcucagggcaaaaagaugauccggccgcaacccauggagcacaaauacucuuggaaaagcuggggcaaggccaagauuaucggggccgaugugcagaauaccaccuuuaucauugacggaccuaacacacccgaauguccugaugaccagagagcuuggaauaucugggaggucgaggauuauggcuucggcauuuuuaccacgaacaucuggcugaagcugcgcgacuccuacacacagguuugcgaucaccggcuuaugagcgcggccauuaaagacucuaaggcugugcaugccgauaugggguauuggaucgaauccgagaaaaaugaaaccuggaagcucgccagagcuagcuucaucgaggugaagacauguauuuggcccaaaucucacacccugugguccaacggaguccuggaaagcgagaugaucauuccgaagaucuacggcgggccuauuucucaacauaauuaucgccccggauacuucacacagaccgccggcccuuggcaccucgggaaacuggagcuugacuuugaucugugcgaaggaacgaccgugguuguggacgagcacugcggcaaccggggccccagccucagaacaaccacagucaccgggaagaucauccaugaaugguguugccgguccuguacgcugccuccccugcgcuucaaaggagaggauggcugcugguacgggauggagauuagaccggugaaggaaaaggaggaaaaucuuguuaaaagcauggugucugcgggauccggcgaggucgacagcuuuucccucgggcugcuguguacaucuaucaugauugaagaggugaugcggagcagauggucccgcaagaugcucaugaccggaacacuggcuguuuuccuucugcucaucaugggccagcugaccuggaacgaccugauucggcuuugcaucauggugggcgccaaugccucugauagaauggggaugggaaccacauaucuggcucucauggccacguuuaaaaugcgcccuauguucgcggucggccugcucuuuagacggcugaccagccgcgaggugcuucugcucacaauugggcugucccugguggcuucugucgaacuucccaacagccuggaggaacucggagacggccuggccauggggaucaugauccucaagcugcuuaccgauuuccaaucccaccagcugugggccacacuccugagccugaccuuuauuaaaacgacacuuucucugcauuacgcuuggaagaccauggccaugguucucuccaucgugagccuguucccccucugucugucuaccacaucccagaagaccacauggcuuccugugcugcugggaagccucggcugcaaaccgcugacgauguuucuuauugcugagaauaagaucuggggcagaaaaucuuggccccugaacgaagggauuauggccgucggagugguuuccauccuccugagcucccuccugaagaacgacgugccucuugcgggcccccugaucgccgggggaaugcugauugcuuguuaugucaucagcggcucuagcgccgaucucucccuggagaaagcugccgaggugucuugggaagaggaagccgagcacagcggggcuucccauaauauucuuguugaagugcaggacgauggaaccaugaagaucaaagacgaggagcgggaugacacacugaccauucuccugaaggcgacacuccuggccgucucuggcguguacccucuuagcauccccgcuacccuguucgucugguauuuuuggcaaaagaaaaagcagcgcuccggcgugcugugggauacgccuucucccccggaaguugagagagccgugcucgacgaugggaucuaccggauuaugcagcgcggacugcuuggcagaagccaggucggggugggaguuuuccaagaaaacguguuccacaccauguggcacgucacacggggcgccgugcugauguaucaggggaaacgccucgagccuuccugggcuagcgugaagaaagaccugaucucuuacggaggcggcuggagacuccagggguccuggaauaccggagaggaaguucaggucauugccguggagcccggcaagaacccuaagaaugugcaaacagcgcccgggaccuuuaaaacaccggaaggagaggucggcgcuaucgcccuggacuucaagccugggacgagcggaucucccauugugaaccgggaaggcaaaaucguuggccuuuacgggaauggaguggucaccacauccggcaccuaugugagcgccauugcucaggccaaggcgucccaggaggggccucugcccgagaucgaagaugagguuuuuagaaaacgcaaccugaccaucauggaccuccaucccggaucuggcaagacacggagauaccugccugcuauugugcgcgaagccaucaagcggaaacuuagaacgcugauucucgccccgacccgcgucguggcuagcgagauggccgaagcucugaaggggaugcccauccgguaucaaacaaccgccguuaaauccgagcacacaggcaaggagauuguggaucugaugugccaugcgaccuucacgaugagacuccuuagcccuguccgcgugcccaauuacaacaugaucaucauggacgaagcccacuuuacagauccuucuuccauugcugcccggggauauaucagcaccagagugggcaugggggaggcugccgccauuuucaugaccgcuacacccccuggaucugucgaagcguuuccgcagagcaaugccguuauccaggacgaggaacgggauauucccgagcgcuccuggaacucuggcuacgaguggaucaccgacuucccugggaaaacagugugguuugugcccagcaucaaguccggaaaugauauugcuaacugucugagaaagaauggcaaacgggucauccagcugucucgcaagaccuucgacacggaauaucagaaaaccaagaacaacgauugggacuacgugguuaccacagacauuagcgagaugggggccaauuuuagagccgaucgggugaucgacccuagacgcugccucaaacccgucauucugaaggauggcccggaacgggugauccuugcuggaccuaugcccguuaccguggccuccgcggcucagagacgcggccggauugggagaaaccauaauaaggagggagaccaguacaucuauaugggccagccccugaacaaugaugaggaccacgcccacuggacggaagccaaaaugcuccuggauaacaucaauaccccugaggggauuauccccgcucuguucgaaccugagcgcgaaaagagcgccgcgauugacggagaguaccggcucagaggcgaggcccgcaaaacauucgucgaacuuaugagaagaggggaucugccgguguggcugucuuauaaggucgcuuccgagggcuuucaauacagcgaccgcagauggugcuucgauggagaacggaacaaucaggugcucgaggaaaacauggacguugagaucuggaccaaagagggcgaacgcaagaaacugagaccccgguggcuugaugccagaacauauuccgacccucuggcucuccgcgaguuuaaggaguucgccgcugggcggagaucugugagcggagaccugauucuggagaucggcaagcucccccagcaucuuacccagcgcgcccaaaaugcgcuggauaaccuggugaugcuccacaauuccgaacaaggcgggcgggccuacagacaugcuauggaggagcugccugacacaaucgaaacccuuaugcugcucgcccugauugcuguccugacagggggcguuacgcucuuuuuccuuucugggcggggacugggcaaaaccagcaucgggcugcucugugugauggccuccagcgugcugcuuuggauggccucugucgagccccacuggauugcugcguccaucauucuggaauuuuuccucauggugcugcugaucccggagccugaucgccagagaacaccccaggacaaccaacucgccuauguugugaucggacuucuguuuauuauccugacagucgcugccaaugagaugggccuccuggaaaccacaaagaaagaucuugggauuggacacguggccgucgagaaccaucaccaugcuacgaugcuggacguggaucuccacccugccagcgcguggacccuguacgccguugcuacaaccaucauuacacccaugaugcggcauaccaucgaaaacacgaccgccaauauuucucugacagcuaucgccaaccaggcggccauccucaugggccuugacaagggcuggccuauuuccaaaauggauaucggggugccccugcuggcucucggaugcuacagccaggucaauccgcugacccuuacagccgcugugcugaugcucguugcccacuaugcuauuaucggcccugggcugcaagccaaggcgacccgcgaggcccagaagagaacggcugccggaauuaugaaaaaccccacaguggacggcaucgucgcuaucgaucuggaccccgugguguacgaugccaaguucgaaaaacagcucgggcagauuaugcuucugauccuguguaccucucaaauucuccugaugcggacaaccugggcccuuugcgagagcaucacccuggcgacaggaccucucacgacccugugggagggcuccccgggcaaguuuuggaauacaaccauugcuguuucuauggccaacaucuuccgcgggagcuaucuggcuggagccggccucgccuuuucccuuaugaaaagccucgggggaggcagacgggggacaggagcucagggcgaaacccugggcgagaaguggaagcgccagcucaaucagcuguccaaaucugaguucaacaucuacaagagaagcgggauuauggaggucgaccgguccgaagccaaagagggacuuaagagaggcgagacgacacgccacgcggugucucgggggaccgccaaacugagaugguucguggaacgcaaucucgucaagcccgagggaaagguuaucgaccugggcugugggcggggaggcuggagcuauuacugcgcuggccugaaaaaggugaccgaagugaaaggguauacaaagggaggcccugggcaugaggaacccauuccuauggccaccuacggauggaaccucgucaaacuucacuccggcaaggauguguuuuucacacccccugagaaaugugacacgcugcugugcgauaucggggagucuagcccgaaucccaccauugaagagggaagaacacuccgcguucugaagaugguggaaccuuggcuucggggcaaccaauuuuguaucaagauucugaaucccuacaugccuuccgucguggagacccucgagcagaugcagagaaaacauggcgggaugcugguucgcaacccccugagcagaaauucuacacacgaaauguauuggguguccugcggaaccggcaacaucgucagcgcugugaauaugacgucuagaaugcuccugaaccgcuucaccauggcccaccggaagccgacauacgagagagacguggaucuuggggcgggaacccgccaugucgccguugaaccugagguggcuaaccuggacaucauuggccagagaaucgaaaauauuaaacacgagcauaaguccacauggcacuaugaugaggacaaccccuacaaaaccugggccuaucaugggagcuacgaagugaagcccucuggauccgcuagcuccauggucaauggcgugguuaagcuccugacaaaaccuugggaugugauccccauggucacccaaauugccaugacggacacaaccccuuuuggccagcagcggguguucaaggagaaaguugauacccgcacaccgaaggcuaaaagagggacggcccaaaucauggaagugaccgcgcgguggcuuuggggauuucugagcagaaacaagaagccccggaucuguacacgcgaggaguucaccagaaaaguccggucuaaugccgcuauuggcgccguguuuguugacgagaaccaguggaauagcgcuaaggaggccguggaagacgagcgcuucugggaucucguccagaaagaaagagagcugcacaagcaggggaaaugcgccacaugcguguauaacaugaugggaaagcgggaaaagaaacugggcgaguuugggaaggcgaaaggcucccgcgcuaucugguacauguggcucggagccagauuccuggaguuugaagcccuuggcuucaugaaugaggaccacugguucucucgggaaaacagccuguccggggucgagggagagggccuccauaagcugggguacauucuucgcgauaucucuaaaauuccuggaggcaauauguaugcugacgauaccgccgggugggacacaagaaucaccgaagaugaccugcaaaacgaggcuaagaucacggauauuauggaacccgagcacgcccuccuggcgaccagcaucuuuaaacugacauaccagaauaaggugguucgggugcagcgcccugccaagaacggcaccgucauggacgugauuuccagacgggaucagcgcggaucuggccaaguggggacauauggacucaauaccuucacgaacauggaagcucagcugaucagacagauggagagcgagggcauuuuucuucccuccgaacuggagacaccgaaccucgccgaacggguucuggacuggcuugagaaauacgggguggaaagacugaagcgcauggcuaucagcggagaugacugugucgugaaaccuaucgacgaucgguucgccaccgcgcucacagcccugaaugacaugggcaagguuagaaaagauauuccccagugggagccuucuaagggguggaacgacuggcaacaggugcccuuuugcucccaucacuuccaccagcugaucaugaaggauggccgcgagauugucgugccuugucggaaucaggacgaacucgucggacgggcucgcgugagccaaggcgccggguggucucugcgggagaccgcuugccuuggaaaauccuaugcccagauguggcagcugauguacuuucauagacgcgaucuccggcuggcugccaacgcgaucuguagcgccgaccccggcgauuggguuccgacguccagaaccacauggucuauucacgcucaucaccaauggaugaccacagaagacaugcuuagcguguggaaucgcgucuggaucgaggaaaacccuuggauggaggauaagacccauguguccagcuggggagacguucccuaucugggaaaacgggaggaccaguggugcggcucucucauugggcugacagccagagccaccugggcuuccaauauccagguggccaucaaccagguccggagacugauuggcaaugaaaacuaccucgauuacaugacgagcaugaagcgcuucaaaaaugagggagaccccgaaggcgcgcugugguga

SEQ ID NO: 19113 - RNA, 9879 nt, Artificial Sequence
  derived and/or modified CDS sequence (opt5) from DENV-1__GQ199843__SS-prME
agcgugaccaugcugcucaugcugaugcccaccgcccuugcuuuccaccugacgaccagaggcggggaaccucauaugaucgucuccaagcaggaacggggaaagucucuccuguuuaagacgagcgccggcguuaauaugugcacccuuaucgcgauggaccugggggaacucugugaagauacaaugaccuacaaaugcccgagaaucacagagguggaacccgacgauguggacuguuggugcaauaccacggauaccugggucacauauggaaccuguucccaaacaggcgagcacagacgggacaagcgcucuguggcucuggccccucauguugggcugggacucgagaccagagccgaaacguggaugagcuccgagggcgcuuggaaacagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaagauaagcccacacuggacaucgaacugcucaaaaccgagguuacaaacccugcugugcugcggaaacuuugcauugaagccaaaaucuccaauaccacgacagauagccgcuguccgacccaaggagaggcgacccugguggaagaacaggacgccaacuucgucugcagacggacauuuguggaucgcggcuggggcaauggguguggacucuucggcaaggggucucugauuaccugcgcuaaguuuaaaugcguuacaaaacuugagggaaaaaucgugcaguacgaaaaccugaaguauuccgucaucgugacgguucacaccggcgaccagcaucaaguggggaaugagagcacagaacacggaaccacagccaccauuacgccccaggcuccuaccucugagauccagcucacagacuacggcgcccugacccuggauuguucccccagaacaggccucgacuucaacgaaaugguccugcuuaccaugaaagaaaaguccuggcuggugcauaaacagugguuucucgaucugccucuucccuggacguccggggccucuacaagccaagagaccuggaaucggcaggaccugcucgucacauucaagaccgcucacgcgaagaaacaggaagugguugugcugggaucccaagagggcgccaugcacaccgcucugacaggggccacggaaauucagaccagcggaacaaccacaaucuuugccggccaucucaagugccgccugaaaauggauaaacuuacccugaaagggaugucuuaugucauguguacgggcuccuucaagcucgagaaggaaguggcugagacacagcacggaaccguucuggugcagauuaaauacgagggcaccgacgccccgugcaagaucccuuucagcacacaagaugaaaaaggggucacccagaacggaagacugaucacagcgaaucccauugugacggacaaggagaaaccugugaacaucgaagcugagccgcccuuuggcgagucuuauauuguuaucggggccggagaaaaggcccuuaagcucagcugguucaaaaagggcuccucuauugggaaaauguuugaggcuaccgcccggggcgcuagacgcauggccauccugggagauacagcgugggacuucggcagcaucgggggagucuuuaccuccgugggcaagcuggugcaucagauuuucgggacagccuacggaguccucuuuagcggcgugucuuggaccaugaaaaucgggauuggcguucugcuuacguggcugggacucaauucccggagcaccucucuguccaugacauguaucgcugugggccuggucacccuuuaccucggggugaugguucaggccgauagcggaugcgugauuaacuggaagggcagagaacugaaguguggguccggaaucuucgucacaaaugaggugcacaccuggacagaacaauauaaauuucaggcugacucuccuaagcgccugagcgccgcgauuggcaaagccugggaggaggggguuugcggcauccgguccgcuaccagacucgaaaacaucauguggcgccagauuucuaacgagcugaaucauauccuucuggaaaacgacaugaaguucacgguggucgugggagauguggucggcauucucgcccaggggaaaaagaugauccggccgcaacccauggagcacaaauacagcuggaaguccuggggaaaggcuaaaauuaucggcgccgacguucagaauacaaccuuuaucauugaugggccuaacacccccgaauguccugacgaucagagagccuggaauaucugggagguggaggacuauggauucggcauuuuuacaaccaacaucuggcugaagcugcgcgauagcuacacacaggugugcgaccaccggcuuaugucugcugcgauuaaagauuccaaggccguccaugcugacaugggcuauuggaucgaaagcgagaaaaaugaaacauggaagcucgccagagccucuuucaucgaggugaagaccuguauuuggcccaaaucccacacacuguggagcaacgggguucuggaaucugagaugaucauuccgaagaucuacggaggcccuauuagccaacauaauuaucgccccggguacuucacccagacagcuggaccuuggcaccucggcaaacuggagcuugauuuugaccugugcgaagggaccacgguggucguggaugagcacugcggaaaccggggccccucccucagaaccacaaccguuacaggcaagaucauccaugaaugguguugccggagcuguacccugccuccccugcgcuucaaaggggaggacggaugcugguacggcauggagauuagaccggugaaggaaaaggaggaaaaucuugucaaaucuaugguguccgccgggagcggagagguugacuccuuuucucucggccugcuguguaucagcauuaugaucgaagaggugaugcgguccagauggucucgcaagaugcucaugacggggacacuggcggucuucuuucuucugauuaugggacagcucaccuggaacgaucugauccggagcugcauuauggugggcgcuaaugccuccgacagaaugggcauggggacaaccuaucuggcccuuauggcuaccuucaaaaugcgcccuauguuugccgugggacuccuguucagacggcugacaucucgcgagguccuccugcuuacgaucggccugagccucguugcguccguggaacugcccaacagccuggaggaacuuggggauggacuggcuaugggcaucaugauucucaagcugcucaccgacuuucaaucuuaccagcugugggccacacuucugucccucaccuucaucaaaacaaccuuuagccugcacuaugccuggaagacgauggcuauggugcugucuauugucucccuucugccccucugucugagcacaaccucucagaagaccacauggcucccugugcugcuugggucccugggaugcaaaccgcugaccauguuccucaucgccgagaauaagauuuggggcagaaaaagcuggccccugaacgaaggcaucauggcuguugggaucguguccauucuucugagcucucuccugaagaacgaugucccucucgccggaccccugaucgcgggcgggaugcuuauugccuguuacgugaucagcggauccucugcugaccugagccuggagaaagccgcugagguuuccugggaagaggaagccgagcauucuggcgccagccacaauauucucguggaaguccaggaugacgggacaaugaagaucaaagaugaggagcgggacgauacgcugaccauccuucugaaggcuacacuccuggcgguguccggagucuauccucucucuauucccgccacccuguuugugugguacuucuggcaaaagaaaaagcagcgcagcggcguucuuugggacacaccuagcccucccgaaguggagagagcuguccuggaugacggcaucuaucggauuaugcagcgcgggcugcucggaagaagccaggugggcguugggguguuccaagaaaacgucuuucauaccauguggcacgugacgcggggagccgugcugauguaccagggcaaacgccuugagcccucuugggccuccguuaagaaagaccugaucagcuacgggggaggcuggagacuccagggcucuuggaauaccggggaggaaguccaggugauugcuguggagcccggaaagaacccuaagaauguccaaacagcccccggcaccuucaaaacaccggaaggggaggugggagcgaucgcucuggauuuuaagccuggcaccuccgggagccccauuguuaaccgggaaggaaaaaucgugggccucuauggcaauggggucgugacaacguccggaaccuacguuucugccaucgcccaggcuaaggccagccaggagggcccucugcccgagauugaagacgagguguucagaaaacgcaaccuuacaaucauggaucugcaccccggguccggaaagacccggagauaucugccugcgauuguccgcgaagcuaucaagcggaaacucagaacccugauucuugccccgacacgcgugguugccagcgagauggcugaagcccugaagggcaugcccauccgguaccaaacgaccgcugugaaaucugagcauacagggagagagaucgucgaccucaugugccacgccaccuuuacaaugcgccugcuguccccugugcgggugcccaauuauaacaugauuaucauggaugaagcgcauuucaccgacccuagcucuauugccgcuagaggcuacaucagcacgcgggucggaaugggcgaggccgcugccauuuuuaugacagccacacccccuggguccguugaggcuuucccgcagucuaaugcggugauccaggaugaggaacgcgacauccccgagagaagcuggaacuccggauaugaguggauuaccgauuuuccuggcaagacagugugguucguccccucuaucaaaagcgggaaugacauugccaacugucuccggaagaauggaaagcgcgugauccagcuuuccagaaaaaccuuugauacagaauaccaaaagaccaaaaacaacgacugggacuacguugugacgacagauauuagcgagaugggcgcuaauuuccgggccgacagagucaucgauccucgccggugccugaagcccgugauucugaaagacgggccggaaagaguuauccucgccggcccuaugcccgugaccgucgcuucugccgcgcagcgccggggaagaaucggccgcaaccacaauaaggagggggaucaguauauuuacaugggacagccccugaacaaugacgaggaucaugcucacuggacagaagccaagaugcuucuggacaacaucaauaccccugagggcauuauccccgcccucuucgaaccugagcgggaaaaauccgcugccauugauggggaguauagacugcgcggagaggcgagaaagacguuuguggaacugaugcggcgcggcgaccucccggucuggcuuagcuacaaaguggccuccgagggguuccaauauucugauagacgguggugcuuugacggcgaacgcaacaaucagguucuggaggaaaacauggauguggagaucuggaccaaggagggagaacgcaagaagcugcggcccagauggcucgacgcucgcacauacagcgacccucuggcccuucgggaguucaaagaauuugcugccggcagacgcuccgugucuggggaucugauccucgagauuggaaagcugccccagcaccugacccagcgggcucaaaaugcccucgacaaccuugucaugcugcauaauagcgaacagggcgggagagcguaucggcacgccauggaggagcugccugauacaaucgaaacccucaugcugcuugcucugauugccguucucacaggaggcgugacccuguucuuucuguccggccgcgggcucggaaagacgagcaucggccuucugugugugauggcuucuuccgcccugcucuggauggccagcgucgagccccauuggauugcugcgucuaucauccuggaguucuuucuuauggugcugcucauuccggagccugacagacagcggacaccccaggauaaccaacuggccuacguugugaucgggcuccuguucaugauucuuaccgucgcugccaaugagaugggacugcuggaaaccaccaagaaggaccucggcaucgggcacgccgcuguggagaaccaccaucacgccaccaugcuggaugucgaccuucauccugcguccgccuggacacuguacgcuguggccacgaccauuaucacacccaugaugcgccacaccauugaaaacacaaccgcuaauaucagccucacggccaucgcgaaccaggccgcuauucugaugggacuggauaaaggcuggccuaucucuaagauggacauuggcguuccccuccuugcccuggggugcuauagccaggugaauccgcugacccucacagcugccguccugaugcuuguggcucauuacgccaucauuggaccuggccugcaagcgaaagccaccagagaggcucagaagcggacagccgcugggaucaugaagaaccccaccguugauggaaucguggccauugaccucgaucccgucguguaugacgccaaauuugaaaagcagcugggccagaucaugcugcucauucuuuguacgucccaaauccugcugaugcgcacaaccugggcgcucugcgagucuauuacacuggcuaccgggccucuuaccacacugugggagggaagcccgggcaaauucuggaauacgaccaucgccguguccauggcuaacaucuuuagaggcagcuaccucgccggggccggacuggcuuucucccugaugaagucucucggcgggggacggcgcggcacaggggcccagggagaaacccuuggcgagaaauggaagagacagcugaaucagcugagcaaguccgaguucaacacauauaaacggucuggcauuauggagguugacagaagcgaagcgaaggaggggcuccgccggggagagaccacgaaacacgccgucuccagaggcacagcuaagcugcgcugguuuguggaacggaaucuugugaaacccgaggggaaggucaucgaucugggauguggcagagggggauggucuuacuauugcgccggccucaagaaaguuaccgaagugaagggcuacaccaaagggggaccuggccacgaggaacccauuccuauggcuacauacggguggaaccuggugaagcugcauagcggaaaagacgucuucuuuauucccccugagaagugugauacccuccuuugcgacauuggcgaguccagcccgaaucccacaaucgaagaggggcgcacgcugcgggugcugaaaaugguugaaccuuggcucagaggaaaccaauucuguauuaagauccugaaucccuauaugccuucuguggucgagacccuugagcagaugcagcgcaagcacggcggcaugcuggugcggaacccccucuccagaaauagcacacaugaaauguacuggguuucuugcgggaccggaaacaucguguccgccgucaauaugacaagccgcaugcugcugaaccgguuuaccauggcgcacagaaaaccgacguaugagcgcgauguggaccucggcgccgggaccagacacguggcugucgaaccugagguugccaaccuggauauuaucggacagcggauugaaaauaucaagcaugagcacaaaucuacauggcauuacgacgaggauaaccccuauaagaccugggcuuaccacggcuccuaugaagugaaacccagcggguccgccagcucuauggugaauggagucgugaaacuucugacaaagccuugggacguuauucccauggugacccaaaucgcuaugacagauaccacgccuuucggccagcagcgcgucuuuaaagagaagguggacacaagaaccccgaaagccaagcggggcaccgcgcaaaucauggaaguuacagccagauggcucuggggguuccugagccggaacaaaaagccccgcauuuguacgagagaggaauuuacccggaaggugcgcuccaaugcugccaucggagcugucuucguggacgagaaccaguggaacucugccaaagaggccguugaagaugagagauuuugggaccuugugcaucgggaacgcgagcugcacaagcagggcaaaugcgcgacaugcgucuacaacaugauggggaagagagagaagaagcucggagaguucggcaaggcuaaagggagccgggccauuugguacauguggcugggcgcccgcuuucuggaguucgaagcucucggauucaugaaugaggaucacugguuuuccagagaaaacucucugagcggcguggagggggagggacuucauaagcugggcuauauccuccgggacauuuccaaaaucccugggggaaauauguacgccgaugacaccgcuggcugggauacacgcaucaccgaagacgaucugcagaacgaggccaagauuacagacaucauggaacccgagcacgcgcuucuggccaccucuauuuucaaacucacguaucaaaauaaggucgugagaguucagcggccugcucgcaacgggaccgugauggaugucaucagcagacgggaccagagaggcuccggacaggugggcacauacgggcugaauaccuuuacaaacauggaagcccaacugauucgccagauggagagcgagggaaucuucucucccuccgaacucgagaccccgaaccuggcugaacgggugcuugauuggcuggagaaacauggcguugaaagacucaagcgcauggccaucagcggggacgacuguguggucaagccuauugaugaccgguuugcgacggcccugucugcucuuaaugauaugggaaaagugagaaaggacaucccccagugggagccuuccaaaggcuggaacgauuggcagcaaguucccuucugcagccaccacuuucaucagcugauuaugaaggacgggcgcgagaucguggucccuugucggaaucaggaugaacucgugggcagagcccgcgucucccagggagcuggcuggucucugcgggagacagccugccuggggaaaagcuaugcucaaauguggcagcucauguacuuccacagacgcgaccugcggcuugccgcgaacgccauuuguuccgcugugcccguugauugggugccgaccagcagaacaaccuggucuauccaugcccaccaucaguggaugacgaccgaagacaugcuguccgucuggaaucggguguggauugaggaaaacccuuggauggaggauaagacacacaucagcucuuggggagacguucccuaucucggcaagagagaggaccaauggugcgggagccugaucggacuuaccgcccgcgcuacaugggccaccaauauucagguggcgaucaaccagguccggagacugauuggcaaugaaaacuaccucgauuacaugacauccaugaaacgcuuuaagaaugagucugaccccgaaggggcucugugguga

SEQ ID NO: 19114 - RNA, 9879 nt, Artificial Sequence
  derived and/or modified CDS sequence (opt5) from DENV-1__GQ199844__SS-prME
agcgugaccaugcugcucaugcugaugcccacggcccuugcuuuccaccugacgaccagaggcggggagccucauaugaucgugacaaagcaggaacggggaaaaucccuccuguuuaagaccucugccggcguuaauaugugcacacuuauugcgauggaccugggggagcucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuuguuacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaggaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaauugcuaccaucacgccccaggccccuaccagcgagauucagcucacagacuacggcgcccugacccuggauuguucuccccggacaggccucgacuucaacgaaaugguucugcuuaccaugaaggagaaauccuggcuggugcauaagcagugguuucucgaucugccucuucccuggacgagcggggcuuccacaucucaagagaccuggaaucgccaggaccugcucgucacauucaaaaccgcgcacgccaagaagcaggaaguggucgugcugggaagccaagagggcgcuaugcacaccgcccugacaggggccacggaaauccagaccuccggaacaaccacaauuuuugcuggccaucucaaaugcagacugaagauggauaaacuuacccugaaggggaugagcuauguuauguguacgggcucuuucaaacucgagaaggaaguggccgagacacagcacggaaccguccuggugcagaucaaguacgagggcaccgacgcgccgugcaaaaucccuuucuccacacaagaugaaaaggggguuacccagaacggacggcugauuacagcuaaucccaucgugacggacaaagagaagccugucaacauugaagccgagccgcccuuuggcgagagcuauaucgugauuggggccggagaaaaagcucuuaagcucucuugguucaagaaaggcagcuccaucgggaagauguuugaggccaccgcuagaggcgcccgccggauggcgauccugggagauacagccugggacuucggcucugucgggggaguuuuuaccagcgucggcaaacuggugcaucagauuuucgggacagcuuacggagugcucuuuuccggcgucagcuggaccaugaagaucgggauuggcgugcugcuuacguggcugggacucaauucuagauccaccagccugucuaugacauguaucgccguuggccuggugacccuuuaccucggggucauggugcaggcugauuccggaugcguuauuaacuggaaaggccgcgaacugaagugugggagcggaaucuucgugacaaaugagguccacaccuggacagaacaauauaaguuucaggccgacuccccuaaacggcugucugcggccauuggcaaggcuugggaggagggggugugcggcaucagaagcgccacccgccucgaaaacaucauguggaaacagauuuccaacgagcugaaucauauccuucuggaaaacgacaugaaguucacgguuguggucggagauguggugggcauucucgcucaggggaaaaagaugauccggccgcaacccauggagcacaaauacucuuggaaaagcuggggaaaggccaagauuaucggcgccgacguccagaauacaaccuuuaucauugaugggccuaacacccccgaauguccugacgaucagagagcuuggaauaucugggagguugaggacuauggauucggcauuuuuacaaccaacaucuggcugaagcugcgcgauuccuacacacaggugugcgaccaccggcuuaugagcgcggccauuaaagauucuaaggcugugcaugccgacaugggcuauuggaucgaauccgagaaaaaugaaacauggaagcucgccagagcuagcuucaucgaggucaagaccuguauuuggcccaaaucucacacacugugguccaacggggugcuggaaagcgagaugaucauuccgaagaucuacggaggcccuauuucucaacauaauuaucgccccggguacuucacccagacagccggaccuuggcaccucggcaaacuggagcuugauuuugaccugugcgaagggaccacgguuguggucgaugagcacugcggaaaccggggccccagccucagaaccacaaccgugacaggcaagaucauccaugaaugguguugccgguccuguacccugccuccccugcgcuucaaaggggaggacggaugcugguacggcauggagauuagaccgguuaaggaaaaggaggaaaaucuugugaaaagcauggucucugcgggguccggagagguggacagcuuuucccucggccugcuguguaucucuauuaugaucgaagagguuaugcggagcagauggucccgcaagaugcucaugacggggacacuggcuguguuccuucugcucauuaugggacagcugaccuggaacgaucugauccggcuuugcauuauggucggcgccaaugccucugacagaaugggcauggggacaaccuaucuggcucucauggccaccuuuaaaaugcgcccuauguucgcggugggacugcucuuuagacggcugacaagccgcgaggugcuucugcucacgaucggccugucccuggucgcuucuguugaacuucccaacagccuggaggaacucggggauggacuggccaugggcaucaugauucucaagcugcuuaccgacuuccaaucccaccagcugugggccacacuccugagccugaccuuuaucaaaacaacccuuucucugcauuacgcuuggaagacgauggccauggugcucuccauugcuagccuguucccccucugucugucuacaaccucccagaagaccacauggcuuccugugcugcuggggagccucggaugcaaaccgcugaccauguuucuuaucacagagacgaagauuuggggcagaaaaucuuggccccugaaugaaggcaucauggccgucggggugguuuccauccuccugagcucccuccugaagaacgaugugccucuugcgggaccccugauugccggcgggaugcugaucgcuuguuaugucauuagcggaucuagcgccgaccucucccuggagaaagcugccgaggugucuugggaagaggaagccgagcacagcggcgcuucccauaacauccuuguugugguccaggaugacgggaccaugaagauuaaagaugaggaacgggacgauacacugaccauccuccugaaggcgacacuccuggccgugucuggagucuacccucuuagcauccccgcuacccuguucgugugguauuuuuggcaaaagaaaaagcagcgcuccggcguucugugggacacgccuucucccccggagguggaaagagccguccucgaugacggcauuuaccggaucaugcagcgcgggcugcuuggaagaagccaggugggcguugggguguuccaagagaaugucuuccacaccauguggcacgugacacggggagccgugcugauguaucagggcaaacgccucgaaccuuccugggcuagcguuaagaaagaccugauuucuuacgggggaggcuggagacuccagggcuccuggaacaccggggaggagguccaggugaucgccguggaacccggaaagaauccuaagaacguccaaacagcgcccggcaccuuuaaaacaccggagggggaagugggagcuauugcccuggauuucaagccuggcacgagcgggucucccaucguuaaucgggagggaaaaauugugggccuuuacggcaacggggucgugaccacauccggaaccuauguuagcgccaucgcucaggccaaggcgucccaggaaggcccucugcccgagaucgaggacgaaguguuuagaaaacgcaaucugaccauuauggaucuccaucccgggucuggaaagacacggagauaccugccugcuaucguccgcgaggccauuaagcggaaacuuagaacgcugauccucgccccgacccgcgugguugcuagcgaaauggccgaggcucugaagggcaugcccauucgguaucaaacaaccgccgugaaauccgaacacacagggaaggagaucgucgaccugaugugccaugcgaccuucacgaugagacuccuuagcccugugcgcgugcccaacuacaauaugaucauuauggaugaggcccacuuuacagacccuucuuccaucgcugcccggggcuauauuagcaccagagucggaaugggcgaagcugccgccaucuucaugaccgcuacacccccugggucuguugaggcguuuccgcagagcaacgccgugauucaggaugaggaacgggacauccccgaacgcuccuggaacucuggauacgaguggaucaccgauuucccuggcaaaacagugugguuuguccccagcauuaaguccgggaacgacaucgcuaauugucugagaaagaacggaaaacgggugauucagcugucucgcaagaccuucgauacggaguaucagaagaccaagaauaacgacugggacuacguugugaccacagauaucagcgaaaugggcgccaacuuuagagccgaccgggucauugauccuagacgcugccucaaacccgugauccugaaggacgggccggagcggguuauucuugcuggcccuaugcccgugaccgucgccuccgcggcucagagacgcggacggaucggcagaaaucauaacaaggaaggggaucaguacaucuauaugggacagccccugaauaacgacgaggaucacgcccacuggacggaggccaaaaugcuccuggacaauauuaacaccccugaaggcaucauucccgcucuguucgagccugaacgcgaaaagagcgccgcgaucgauggggaauaccggcucagaggagaggcccgcaaaacauucguggagcuuaugagacggggcgaccugccggucuggcugucuuauaagguggcuuccgaaggguuucaauacagcgaucgcagauggugcuucgacggcgagcggaauaaccagguucucgaagagaauauggauguggaaauuuggaccaaagagggagagcgcaagaaacugagaccccgguggcuugacgccagaacauauuccgacccucuggcucuccgcgaauuuaaggaguucgccgcuggccggagaucugugagcggggaucugauccuggaaaucggaaagcucccccagcaucuuacccagcgcgcccaaaacgcgcuggacaaucuggucaugcuccacaacuccgagcagggcgggcgggccuacagacaugcuauggaggaacugccugauacaauugagacccuuaugcugcucgcccugaucgcuguucugacgggaggcgugacacucuuuuuccuuucuggccgggggcugggaaaaaccagcauuggccugcucugugugauggccuccagcguccugcuuuggauggccucuguggaaccccacuggaucgcugcguccauuauccuggaguuuuuccucaugguucugcugaucccggaaccugaccgccagagaacaccccaggauaaucaacucgccuauguggucauugggcuucuguuuaugauccugacaguggcugccaacgagaugggacuccuggagaccacaaagaaagaccuuggcauugggcacgucgccguggaaaaucaucaccaugcuacgaugcuggauguugaccuccacccugccagcgcguggacccuguacgccguggcuacaaccaucauuacacccaugaugcggcauaccaucgagaacacgaccgccaacauuucucugacagcuaucgccaaucaggcggccauccucaugggacuugauaagggcuggccuauuuccaaaauggacaucggcgucccccugcuggcucucgggugcuacagccaggugaacccgcugacccuuacagccgcuguucugaugcucguggcccacuaugcuauuaucggaccuggccugcaagccaaggcgacccgcgaagcccagaagagaacggcugccgggauuaugaaaaaucccacagucgauggaaucguggcuaucgaccuggaucccgugguuuacgacgccaaguucgagaaacagcucggccagauuaugcuucugauccuguguaccucucaaauucuccugaugcggacaaccugggcccuuugcgaaagcaucacccuggcgacagggccucucacgacccugugggagggauccccgggcaaguuuuggaacacaaccauugcugucucuauggccaauaucuuccgcggcagcuaucuggcuggggccggacucgccuuuucccuuaugaaaagccugggcgggggaagacggggcacaggggcucagggagagacccugggcgaaaaguggaagcgccagcucaaccagcuguccaaaucugaguucaauaucuacaagagaagcggcauuauggaaguggaccgguccgaggccaaagaagggcuuaagagaggagagacgacacgccacgcggugucucggggcaccgccaaacugagaugguucgucgagcgcaaccucguuaagcccgaagggaaggugaucgaucugggauguggcagagggggauggagcuauuacugcgcuggccugaaaaaggugaccgaggucaaaggcuauacaaaagggggaccuggccaugaggagcccauuccuauggccaccuacggguggaaucucgugaaacuucacuccggaaaggacgucuuuuucacacccccugaaaaaugugauacgcugcugugcgacaucggcgagucuagcccgaaccccaccauugaggaagggagaacacuccgcgugcugaagauggucgagccuuggcuucggggaaaucaauuuuguaucaagauucugaaccccuacaugccuuccgugguugaaacccucgagcagaugcagagaaaacauggcggcaugcuggugcgcaauccccugagccggaacucuacacacgagauguauugggucuccugcgggaccggaaauaucgugagcgcugugaacaugacgucuagaaugcuccugaaucgcuucaccauggcccaccggaagccgacauacgaaagagaugucgaccuuggcgcggggacccgccauguugccguggagccugaaguggcuaaccuggauaucauuggacagagaaucgagaacauuaaacacgaacauaaguccacauggcacuaugacgaggauaaucccuacaaaaccugggccuaucauggcagcuacgaggucaagcccucuggguccgcuagcuccauggugaacggaguugugaagcuccugacaaaaccuugggacgucauccccauggugacccaaauugccaugacggauacaaccccuuuuggccagcagcggguuuucaaggaaaaaguggacacccgcacaccgaaggcuaaaagaggcacggcccaaaucauggaggucaccgcgcgguggcuuuggggguuucugagcagaaauaagaagccccggaucuguacacgcgaagaguucaccagaaaagugcggucuaacgccgcuauuggagccguuuuuguggacgaaaaucaguggaacagcgcuaaggaggccgucgaggaugaacgcuucugggaccucgugcagaaagagagagaacugcacaagcagggcaaaugcgccacaugcgucuauaauaugauggggaagcgggagaagaaacugggagaauuuggcaaggcgaaagggucccgcgcuaucugguacauguggcucggcgccagauuccuggaguuugaggcccuuggauucaugaacgaagaucacugguucucucgggagaauagccuguccggcguggaaggggagggacuccauaagcugggcuacauucuucgcgacaucucuaaaauuccugggggaaacauguaugcugaugacaccgccggcugggauacaagaaucaccgaggacgaucugcaaaaugaagcuaagaucacggacauuauggagcccgaacacgcccuccuggcgaccagcaucuuuaaacugacauaccagaacaagguugugcggguccagcgcccugccaagaaugggaccgugauggaugugauuuccagacgggaccagcgcggcucuggacaaguuggcacauaugggcucaacaccuucacgaauauggaggcucagcugaucagacagauggaaagcgagggaauuuuucuucccuccgagcuggaaacaccgaaccucgccgagcgggugcuggauuggcuugaaaaauacggcgucgagagacugaagcgcauggcuaucagcggggacgacugugugguuaaaccuaucgaugaccgguucgccaccgcgcucacagcccugaacgauaugggaaaggugagaaaagacauuccccagugggaaccuucuaagggcuggaaugauuggcaacagguccccuuuugcucccaucacuuccaccagcugaucaugaaggacgggcgcgagauuguggucccuugucggaaccaggaugagcucgugggcagagcucgcguuagccaaggagccggcuggucucugcgggaaaccgcuugccuugggaaauccuaugcccagauguggcagcugauguacuuucauagacgcgaccuccggcuggcugccaaugcgaucuguagcgccgugcccgucgauugggugccgacguccagaaccacauggucuauucacgcucaucaccaauggaugaccacagaggacaugcuuagcguuuggaaccgcguguggaucgaagagaauccuuggauggaagauaagacccaugucuccagcuggggagacgugcccuaucugggcaaacgggaggaccaguggugcgggucucucauuggacugacagccagagccaccugggcuuccaacauccagguggccaucaaucagguucggagacugauuggcaacgagaauuaccucgauuacaugacgagcaugaagcgcuucaaaaacgaaggggaccccgagggcgcgcugugguga

SEQ ID NO: 19115 - RNA, 9879 nt, Artificial Sequence
  derived and/or modified CDS sequence (opt5) from DENV-1__GQ199845__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagagcaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguuccccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccccccuucggcgagucuuauauugugaucggggccggagaaaaagcucugaagcuuagcugguuuaagaaaggcuccucuauugggaagauguucgaggccaccgcuagaggcgcccgccggauggcgauccucggagauacagccugggacuuuggcagcaucgggggaauguucaccuccguuggcaaacugguccaucagauuuuugggacagcuuacggagugcuguucagcggcgugucuuggaccaugaagaucgggauuggcguccuccugacguggcuuggacugaauuccagaagcaccucucucuccaugacauguaucgccgugggccugguuacccuguaccuuggggugaugguccaggcugauagcggaugcgugauuaacuggaaaggccgcgaacucaaguguggguccggaaucuuuguuacaaaugaggugcacaccuggacagaacaauauaaguuccaggccgacucuccuaaacggcugagcgcggccauuggcaaggcuugggaggagggggucugcggcaucagauccgccacccgccuggaaaacaucauguggaaacagauuucuaacgagcucaaucauauccugcuugaaaacgacaugaagcugacggugguugugggagaugucgcuggcauucucgcccaggggaaaaagaugauccggccgcaacccauggaguacaaauauagcuggaagauuuggggaaaggccaaaaucaucggcgcugacgugcagaauacaaccuuuauuaucgaugggccuaacacccccgaauguccugacgaucagagagcguggaauauuugggagguggaggacuacggauucggcaucuuuacaaccaacauuuggcugaagcugcgcgauuccuauacgcaggucugcgaccaccggcuuaugagcgccgcuaucaaagauucuaaggccguucacgccgacaugggcuacuggaucgaauccgagaaaaaugaaacauggaagcucgcuagagccagcuucauugaggugaagaccuguaucuggcccaaaucucauacacugugguccaacggggugcuggaaagcgagaugauuaucccgaagauuuauggaggcccuaucucucaacacaauuaccgccccggguacuucacccagacagcgggaccuuggcaucucggcaaacuggagcuugauuuugaccugugcgaagggaccacggucgugguugaugagcacugcggaaaccggggccccagccucagaaccacaaccgugacaggcaagaucauucacgaaugguguugccgguccuguacccugccuccccugcgcuucaaaggggaggacggaugcugguauggcauggagaucagaccggucaaggaaaaggaggaaaaucuugugaaaagcaugguuucugcuggguccggagagguggacagcuuuucccucggccugcuguguauuucuaucaugauugaagaggucaugcggagcagauggucccgcaagaugcucaugacggggacacuggccguguucuuucuucugaucaugggacagcucaccuggaacgaucugauucggcugugcaucaugguuggcgccaaugcuucugacagaaugggcauggggacaaccuaccuugcccugauggcgaccuucaaaaugcgcccuauguuugcugugggacuccuguucagacggcucacaagccgcgagguccugcuucugacgaucggccucucccugguggccucuguggaacugcccaacagccuugaggaacugggggauggacucgccaugggcauuaugauccugaagcuccugaccgacuuucaaucccaucagcuuugggcuacacugcucagccugaccuucauuagaacaaccuuuucucugcacuaugccuggaaaacgauggcuaugguccuuuccaucguuagccuguucccccucugucugucuacaaccucccagaagaccacauggcucccugugcugcuugggagccugggaugcaagccgcugaccauguuucucauugccgagaauaaaaucuggggccggaagucuuggccccugaacgaaggcaucauggcgguggggauugucuccauccuucugagcucccuccugaaaaacgaugugccucucgccggaccccugauugcuggcgggaugcuuaucgccuguuacguuauuagcggaucuagcgcugaccugucccuggagaaggccgccgaggugucuugggaagaggaagcugagcauagcggcgcgucccacaauauccucgucgaagugcaggaugacgggacaaugaaaaucaaggaugaggagcgcgacgauacgcugaccauucuucugaaagccacacuccuggcuguuucuggaguguauccucucagcauccccgccacccuguucgucugguacuucuggcaaaagaagaaacagagauccggcgugcuuugggacacaccuucucccccggaagucgagcgggccgugcuggaugacggcauuuaucgcaucaugcagagagggcugcucggacggagccagguuggcgugggggucuuucaagaaaacguguuccauaccauguggcacguuacgcgcggagcugugcugauguaccagggcaagagacuugagccuuccugggccagcgucaaaaaggaccugauuucuuacgggggaggcuggcggcuccagggcuccuggaauaccggggaggaagugcaggugaucgcgguugagcccggaaaaaacccuaagaauguccaaacagcucccggcaccuuuaagacaagcgaaggggaggugggagccauugcccuggauuucaaaccgggcaccucuggguccccuaucgugaacagagaaggaaagaucgucggccucuauggcaauggggugguuacaacgagcggaaccuacguguccgcuauugcccaggcgaaagcuucucaggagggcccccugccugagaucgaagacgaggucuuucgcaagcggaaccuuacaauuauggaucugcaccccgggagcggaaaaaccagacgcuaucugcccgccaucgugcgggaagccaccaagagacgccuccggacacugauucuugcuccuacgagaguuguggccuccgagauggcugaagcccugaagggcaugccgauccgcuaccaaaccacagcggucaaaagcgagcauaccgggaaggagaucguggaccucaugugccacgccacauucaccaugcggcugcugucucccguuagagugccuaauuauaacaugauuaucauggaugaagcucauuuuacggaccccuccagcauugccgcucggggcuacaucucuacacgcgucggaaugggcgaggccgccgcuauuuucaugaccgcgaccccucccgggagcguggaagccuuuccucaguccaaugcugugauccaggaugaggaaagagacaucccggagcggucuuggaacagcggauaugaguggauuacagauuuccccggcaaaaccgucugguuuguuccuuccaucaagucugggaaugacauugccaacugucuccgcaaaaauggaaagagagugauccagcuuagccggaagacauucgauaccgaauaccaaaaaacgaagaacaacgacugggacuacguggucacaaccgauauuuccgagaugggcgccaauuucagagcugaccgcgugaucgauccccggagaugccugaaaccuguuauucugaaggacgggcccgaacgcgugauccucgccggcccgaugccugucacaguggcgagcgcugcccagcggagaggacgcaucggccggaaccacaauaaagagggggaucaguauauuuacaugggacagccccugaacaaugacgaggaucaugcccacuggaccgaagcuaagaugcuucuggacaacaucaauacgcccgagggcauuaucccugcccucuuugaacccgagagagaaaagucugcggccauugauggggaguaucgccugagaggagaggcucggaaaaccuucguugaacugaugcgcagaggcgaccucccuguguggcuuuccuacaaggucgccagcgagggguuucaauauuccgaucggcgcuggugcuucgacggcgaaagaaacaaucaggugcuggaggaaaacauggaugucgagaucuggacaaaagagggagaacggaagaaacugagaccgcgcuggcucgacgcucggaccuacucugacccccuggcccuuagagaguuuaaggaauucgcugccggccgccggagcguguccggggaucugauccucgagauuggaaaacugccucagcaccugacacagagagcgcaaaaugcccucgacaaccuuguuaugcugcauaauucugaacagggcgggcgggcuuaucgccacgccauggaggagcugcccgauaccaucgaaacacucaugcugcuugcucugauugccgugcucaccggaggcgugacgcuguuuuuccugagcggcagagggcucggaaagacauccaucggccuucugugugucauggccagcucuguucugcucuggauggcuuccguggagccucauuggauugcggccagcaucauccuggaauuuuuccuuauggugcugcucauucccgagccggaccggcagcgcaccccucaggauaaccaacuggcuuacgucgugaucgggcugcucuuuaugauucuuaccguugccgccaaugagaugggacugcuggaaacaaccaagaaagaccucggcaucgggcacguggcugucgagaaccaccaucacgccgcgaugcuggauguggaccuucaucccgccucugcuuggacacuguacgccgucgcuacgaccauuaucacaccuaugaugagacacaccauugaaaacacaaccgccaauaucucccucacggcgaucgccaaccaggcugccauucugaugggacuggauaagggcuggcccaucagcaaaauggacauuggcgugccucuccuugcucuggggugcuauucucagguuaauccccugacccucacagccgcugugcugaugcuugucgcccauuacgcgaucauuggaccgggccugcaagccaaggcuacccgggaggcccagaaacgcacagcugccgggaucaugaagaacccuaccguggauggaaucguugccauugaccucgaucccguggucuaugacgcgaaguucgaaaaacagcugggccagaucaugcugcucauucuuuguacgagccaaauccugcugaugagaacaaccugggcucucugcgaguccauuacacuggccaccgggccccuuaccacacugugggagggaucuccuggcaaguuuuggaauacgaccaucgcugugagcauggccaacaucuuccggggcuccuaccucgccggggcuggacuggccuucagccugaugaaaucccucggcgggggacgcagaggcacaggggcgcagggagaaacccuuggcgagaaguggaaacggcagcugaaucagcugucuaagagcgaauuuaacacauauaagagauccggcauuauggagguggaccgcucugaagccaaagaggggcucaagcggggagagaccacgaaacacgcuguuagcagaggcacagccaagcugcgcugguucgucgaacggaaucuugugaaaccggaggggaaggugaucgaucugggauguggcagagggggaugguccuacuauugcgcuggccucaagaaagucaccgaaguuaagggcuacaccaaagggggacccggccacgaggaaccuauucccauggccacauacggguggaaccuggugaagcugcauucuggaaaagacguguuuuucaucccucccgagaagugugauacccuccuuugcgacauuggcgagagcuccccuaauccgacaaucgaagaggggcgcacgcugcggguccugaaaaugguggaacccuggcucagaggaaaccaauuuuguauuaagauccugaauccuuauaugcccagcguuguggagacccuugagcagaugcagcgcaagcacggcggcaugcugguccggaacccucucucuagaaauuccacacaugaaauguacugggugagcugcgggaccggaaacaucguuucugcggugaauaugacaucccgcaugcugcugaaccgguucaccauggcccacagaaaacccacguaugagcgcgaugucgaccucggcgcugggaccagacacguggccguggaaccggaggucgcuaaccuggauauuaucggacagcggauugaaaauaucaagcaugagcacaaaagcacauggcauuacgacgaggauaacccuuauaagaccugggccuaccacggcucuuaugaaguuaaacccuccgggagcgcuuccagcauggugaauggaguggucaagcuucugacaaagcccugggacgugauuccuaugguuacccaaaucgccaugacagauaccacgcccuuuggccagcagcgcguguucaaagagaaggucgacacaagaaccccuaaagcgaagcggggcaccgcccaaaucauggaagugacagcuaaauggcucuggggguuucugucuagaaacaagaagccgcggauuuguacgcgcgaggaauucaccagaaaaguucggagcaaugccgcuaucggagccguguuugucgacgagaaccaguggaauuccgccaaggaggcgguggaagaugagcgcuucugggaccuuguucauagagaacgggagcugcacaaacagggcaagugcgcuacaugcguguacaacaugauggggaaacgcgaaaagaagcucggagaguuuggcaaagccaaggggucuagagccauuugguacauguggcugggcgcucgguuccuggaguucgaagcccucggauuuaugaaugaggaucacugguucagccgcgaaaacucccugucuggcgucgagggggagggacuucauaaacugggcuauauccucagagacauuagcaagauccccgggggaaauauguacgcugaugacaccgccggcugggauacacggaucaccgaagacgaucugcagaacgaggcgaaaauuacagacaucauggaaccugagcacgcccuucuggcuaaguccauuuuuaaacucaccuaucaaaauaaggugguccgcgugcagagacccgccaagaacgggacgguuauggaugugaucucucggcgcgaccagagaggcagcggacaggucggcaccuacgggcugaauacauucaccaacauggaagcucaacugauucggcagauggaguccgagggaaucuuuagcccuucugaacucgagacacccaaccuggccggcagagugcuugauuggcuggaaaaacaugggguggagcgccucaagcggauggcgaucuccggagacgacuguguugugaaaccgauugaugacagauucgccaccgcucugacggcccuuaaugauaugggcaagguccgcaaagacaucccucagugggaacccagcaagggguggaacgauuggcagcaagugccuuuuugcucucaccacuuccaucagcugauuaugaaggacggccgggagaucguugugcccuguagaaaucaggaugagcucgucggacgcgcucgggugucccagggcgccggguggagccugagagaaacagcuugccugggaaaauccuaugcccaaauguggcagcucauguacuuucaccgccgggaccugagacuugcggccaacgcuauuuguucugccgucccuguggauuggguucccaccagccgcacaaccugguccauccaugcccaccaucaguggaugacgaccgaggacaugcugagcguguggaaucgggucuggauugaagagaacccguggauggaagauaagacacacgugucuuccuggggcgacguuccuuaucucgggaaaagagaggaccaauggugcggaagccugaucggccuuaccgcucgggccacaugggcgaccaauauccagguggcuauuaaccaggucagacgccugcucgggaaugagaacuaccuggauuacaugacaucuaugaagcgguucaaaaaugaaagcgaccccgagggcgcccugugguga

SEQ ID NO: 19116 - RNA, 9879 nt, Artificial Sequence
  derived and/or modified CDS sequence (opt5) from DENV-1__GQ199846__SS-prME
agcgugaccaugcugcucaugcugaugcccacagcccuugcuuuccaccugacgaccagaggcggggagccucauaugaucgucacaaagcaggaacggggaaaaucccuccuguuuaagaccucugccggcguuaacaugugcacacuuauugcgauggaccugggggagcucugugaagauaccaugacauacaaaugcccgcgcaucaccgaggcugaacccgacgauguggacuguuggugcaaugccacggauaccugggugacauauggaaccuguagccaaacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccaucauggcucgcgauaagcccacacuggacauugaacugcucaaaaccgaggucacaaacccugccguucugagaaagcuuugcaucgaagcgaaaauuucuaauaccacgacagauucccgguguccgacccaaggagaggccacccugauggaagagcaggacgcuaacuucgugugccgcagaacauuuguggaucggggcuggggcaauggguguggacucuucggcaaggggagccugaucaccugcgccaaauuuaagugcgucacaaagcuugagggaaaaaucgugcaguacgaaaaccugaaguauucuguuauugugacgguccacaccggcgaccagcaucaaguggggaaugaguccacagaacacggaaccacagcuaccaucacgccccaggccccuaccagcgagauucagcucacagacuacggcgcccugacccuggauuguucuccccgcacaggccucgacuucaacgaaaugguucugcuuaccaugaaagagaaguccuggcuggugcauaaacagugguuucucgaucugccucuucccuggacgagcggggcuuccacaucucaagagaccuggaauagacaggaccugcucgucacauucaagaccgcgcacgccaaaaagcaggaaguggucgugcugggaagccaagagggcgcuaugcacaccgcccugacaggggccacggaaauccagaccuccggaacaaccacaauuuuugcuggccaucucaagugccggcugaaaauggauaagcuuacccugaaagggaugagcuauguuauguguacgggcucuuucaagcucgagaaagaaguggccgagacacagcacggaaccguccuggugcagaucaaguacgagggcaccgacgcgccgugcaagaucccuuucuccacacaagaugaaaaagggguuacccagaacggaagacugauuacagcuaaucccaucgugacggacaaggagaaaccugucaacauugaagccgagccccccuuuggcgagagcuauaucgugauuggggccggagaaaaggcucuuaaacucucuugguucaagaagggcagcuccaucgggaaaauguuugaggccaccgcucgcggcgcccggagaauggcgauccugggagauacagccugggacuucggcucuguggggggaguuuuuaccagcgucggcaagcuggugcaucagauuuucgggacagcuuacggagugcucuuuuccggcgucagcuggaccaugaaaaucgggauuggcgugcugcuuacguggcugggacucaauucucgcuccaccagccugucuaugacauguaucgccguuggccuggugacccuuuaccucggggucauggugcaggcugauuccggaugcguuauuaacuggaagggccgggaacugaaaugugggagcggaaucuucgugacaaaugagguccacaccuggacagaacaauauaaguuucaggccgacuccccuaagagacugucugcggccauuggcaaagcuugggaggagggggugugcggcauccgcagcgccacccggcucgaaaacaucauguggaagcagauuuccaacgagcugaaucauauccuucuggaaaacgacaugaaauucacgguuguggucggagauguggugggcauucucgcucaggggaagaaaaugaucagaccgcaacccauggagcacaaguacucuuggaaaagcuggggaaaggccaagauuaucggcgccgacguccagaauacaaccuuuaucauugaugggccuaacacccccgaauguccugacgaucagcgcgcuuggaauaucugggagguugaggacuauggauucggcauuuuuacaaccaacaucuggcugaaacugcgggauuccuacacgcaggugugcgaccacagacuuaugagcgcggccauuaaggauucuaaagcugugcaugccgacaugggcuauuggaucgaauccgagaagaaugaaacauggaaacucgcccgcgcuagcuucaucgaggucaagaccuguauuuggcccaagucucacacacugugguccaacggggugcuggaaagcgagaugaucauuccgaaaaucuacggaggcccuauuucucaacauaauuaucggcccggguacuucacccagacagccggaccuuggcaccucggcaagcuggagcuugauuuugaccugugcgaagggaccacgguuguggucgaugagcacugcggaaacagaggccccagccuccggaccacaaccgugacaggcaaaaucauccaugaaugguguugccgcuccuguacccugccuccccugagauucaagggggaggacggaugcugguacggcauggagauucggccgguuaaagaaaaggaggaaaaucuugugaagagcauggucucugcgggguccggagagguggacagcuuuucccucggccugcuguguaucucuauuaugaucgaagagguuaugagaagccgcuggucccggaaaaugcucaugacggggacacuggcuguguuccuucugcucauuaugggacagcugaccuggaacgaucugaucagacuuugcauuauggucggcgccaaugccucugaccgcaugggcauggggacaaccuaucuggcucucauggccaccuuuaagaugagaccuauguucgcggugggacugcucuuucggcgccugacaagcagagaggugcuucugcucacgaucggccugucccuggucgcuucuguugaacuucccaacagccuggaggaacucggggauggacuggccaugggcaucaugauucucaaacugcuuaccgacuuccaaucccaccagcugugggccacacuccugagccugaccuuuaucaagacaacccuuucucugcauuacgcuuggaaaacgauggccauggugcucuccauugcuagccuguucccccucugucugucuacaaccucccagaagaccacauggcuuccugugcugcuggggagccucggaugcaagccgcugaccauguuucuuaucacagagacgaaaauuuggggccggaagucuuggccccugaaugaaggcaucauggccgucggggugguuuccauccuccugagcucccuccugaaaaacgaugugccucuugcgggaccccugauugccggcgggaugcugaucgcuuguuaugucauuagcggaucuagcgccgaccucucccuggagaaggcugccgaggugucuugggaagaggaagccgagcacagcggcgcuucccauaacauccuuguugugguccaggaugacgggaccaugaaaauuaaggaugaagagcgcgacgauacacugaccauccuccugaaagcgacacuccuggccgugucuggagucuacccucuuagcauccccgcuacccuguucgugugguauuuuuggcaaaagaagaaacagagauccggcguucugugggacacgccuucucccccggagguggaacgggccguccucgaugacggcauuuaccgcaucaugcagagagggcugcuuggacggagccaggugggcguugggguguuccaagagaaugucuuccacaccauguggcacgugacacgcggagccgugcugauguaucagggcaagagacucgaaccuuccugggcuagcguuaaaaaggaccugauuucuuacgggggaggcuggcggcuccagggcuccuggaacaccggggaggagguccaggugaucgccguggaacccggaaaaaauccuaagaacguccaaacagcgcccggcaccuuuaagacaccggagggggaagugggagcuauugcccuggauuucaaaccuggcacgagcgggucucccaucguuaauagagagggaaagauugugggccuuuacggcaacggggucgugaccacauccggaaccuauguuagcgccaucgcucaggccaaagcgucccaggaaggcccucugcccgagaucgaggacgaaguguuucgcaagcggaaucugaccauuauggaucuccaucccgggucuggaaaaacaagacgcuaccugccugcuaucguccgggaggccauuaagagaaagcuucgcacgcugauccucgccccgacccgggugguugcuagcgaaauggccgaggcucugaaaggcaugcccauuagauaucaaacaaccgccgugaaguccgaacacacagggaaagagaucgucgaccugaugugccaugcgaccuucacgaugcgccuccuuagcccugugcgggugcccaacuacaauaugaucauuauggaugaggcccacuuuacagacccuucuuccaucgcugccagaggcuauauuagcacccgggucggaaugggcgaagcugccgccaucuucaugaccgcuacacccccugggucuguugaggcguuuccgcagagcaacgccgugauucaggaugaagagcgcgacauccccgaaagauccuggaauucuggauacgaguggaucaccgauuucccuggcaagacagugugguuuguccccagcauuaaauccgggaacgacaucgcuaauugucugcggaagaacggaaagcgcgugauucagcugucuagaaaaaccuucgauacggaguaucaaaagacaaaaaauaacgacugggacuacguugugaccacagauaucagcgaaaugggcgccaacuuucgggccgacagagucauugauccucgccggugccucaagcccgugauccugaaagacgggccggagagaguuauucuugcuggcccuaugcccgugaccgucgccuccgcggcucagcgccggggaagaaucggccgcaaucauaacaaggaaggggaucaguacaucuauaugggacagccccugaauaacgacgaggaucacgcccacuggacggaggccaagaugcuccuggacaauauuaacaccccugaaggcaucauucccgcucuguucgagccugaacgggagaaaagcgccgcgaucgauggggaauacagacuccgcggagaggccagaaagacauucguggagcuuaugcggcgcggcgaccugccggucuggcugucuuauaaaguggcuuccgaaggguuucaauacagcgauagacgguggugcuucgacggcgagcgcaauaaccagguucucgaagagaauauggauguggaaauuuggaccaaggagggagagagaaaaaagcugcggcccagauggcuugacgcccgcacauauuccgacccucuggcucuccgggaauuuaaagaguucgccgcuggcagacgcucugugagcggggaucugauccuggaaaucggaaagcucccccagcaucuuacccagcgggcccaaaacgcgcuggacaaucuggucaugcuccacaacuccgagcagggcgggagagccuaccggcaugcuauggaagagcugccugauacaauugagacccuuaugcugcucgcccugaucgcuguucugacgggaggcgugacacucuuuuuccuuucuggccgcgggcugggaaagaccagcauuggccugcucugugugauggccuccagcguccugcuuuggauggccucuguggaaccccacuggaucgcugcguccauuauccuggaguuuuuccucaugguucugcugaucccggaaccugacagacagcggaccccccaggauaaucaacucgccuauguggucauugggcuucuguuuaugauccugacaguggcugccaacgagaugggacuccuggagaccacaaaaaaggaccuuggcauugggcacgucgccguggaaaaucaucaccaugcuacgaugcuggauguugaccuccacccugccagcgcguggacccuguacgccguggcuacaaccaucauuacacccaugaugcgccauaccaucgagaacacgaccgccaacauuucucugacagcuaucgccaaucaggcggccauccucaugggacuugauaaaggcuggccuauuuccaagauggacaucggcgucccccugcuggcucucgggugcuacagccaggugaacccgcugacccuuacagccgcuguucugaugcucguggcccacuaugcuauuaucggaccuggccugcaagccaaagcgaccagagaagcccagaagcggacggcugccgggauuaugaagaaucccacagucgauggaaucguggcuaucgaccuggaucccgugguuuacgacgccaaauucgagaagcagcucggccagauuaugcuucugauccuguguaccucucaaauucuccugaugcgcacaaccugggcccuuugcgaaagcaucacccuggcgacagggccucucacgacccugugggagggauccccgggcaaauuuuggaacacaaccauugcugucucuauggccaauaucuucagaggcagcuaucuggcuggggccggacucgccuuuucccuuaugaagagccugggcgggggacggcgcggcacaggggcucagggagagacccugggcgaaaaauggaagagacagcucaaccagcuguccaagucugaguucaauaucuacaaacggagcggcauuauggaaguggacagauccgaggccaaggaagggcuuaaacgcggagagacgacacggcacgcggugucuagaggcaccgccaagcugcgcugguucgucgagcggaaccucguuaaacccgaagggaaggugaucgaucugggauguggcagagggggauggagcuauuacugcgcuggccugaagaaagugaccgaggucaagggcuauacaaaagggggaccuggccaugaagagcccauuccuauggccaccuacggguggaaucucgugaagcuucacuccggaaaagacguuuuuuucacacccccugaaaagugugauacgcugcugugcgacaucggcgagucuagcccgaaccccaccauugaggaagggcgcacacuccgggugcugaaaauggucgagccuuggcuuagaggaaaucaauuuuguaucaagauucugaaccccuacaugccuuccgugguugaaacccucgagcagaugcagcgcaagcauggcggcaugcuggugcggaauccccugagcagaaacucuacacacgagauguauugggucuccugcgggaccggaaauaucgugagcgcugugaacaugacgucucgcaugcuccugaaucgguucaccauggcccacagaaaaccgacauacgaacgcgaugucgaccuuggcgcggggaccagacauguugccguggagccugaaguggcuaaccuggauaucauuggacagcggaucgagaacauuaagcacgaacauaaauccacauggcacuaugacgaggauaaucccuacaagaccugggccuaucauggcagcuacgaggucaaacccucuggguccgcuagcuccauggugaacggaguugugaagcuccugacaaagccuugggacgucauccccauggugacccaaauugccaugacggauacaaccccuuuuggccagcagcgcguuuucaaagaaaagguggacaccagaacaccgaaagcuaagcggggcacggcccaaaucauggaggucaccgcgagauggcuuuggggguuucugagccggaauaaaaagccccgcaucuguacaagagaagaguucacccggaaggugcgcucuaacgccgcuauuggagccguuuuuguggacgaaaaucaguggaacagcgcuaaagaggccgucgaggaugaaagauucugggaccucgugcagaaggagcgggaacugcacaaacagggcaagugcgccacaugcgucuauaauaugauggggaaacgcgagaagaagcugggagaauuuggcaaagcgaagggguccagagcuaucugguacauguggcucggcgcccgguuccuggaguuugaggcccuuggauucaugaacgaagaucacugguucucucgcgagaauagccuguccggcguggaaggggagggacuccauaaacugggcuacauucuuagagacaucucuaagauuccugggggaaacauguaugcugaugacaccgccggcugggauacacggaucaccgaggacgaucugcaaaaugaagcuaaaaucacggacauuauggagcccgaacacgcccuccuggcgaccagcaucuuuaagcugacauaccagaacaaaguugugcgcguccagagaccugccaagaaugggaccgugauggaugugauuucccggcgcgaccagagaggcucuggacaaguuggcacauaugggcucaacaccuucacgaauauggaggcucagcugauccggcagauggaaagcgagggaauuuuucuucccuccgagcuggaaacaccgaaccucgccgagagagugcuggauuggcuugaaaaguacggcgucgagcgccugaaacggauggcuaucagcggggacgacugugugguuaagccuaucgaugacagauucgccaccgcgcucacagcccugaacgauaugggaaaagugcgcaaggacauuccccagugggaaccuucuaaaggcuggaaugauuggcaacagguccccuuuugcucccaucacuuccaccagcugaucaugaaggacgggcgggagauuguggucccuuguagaaaccaggaugagcucgugggccgcgcucggguuagccaaggagccggcuggucucugagagaaaccgcuugccuugggaaguccuaugcccagauguggcagcugauguacuuucaucgccgggaccucagacuggcugccaaugcgaucuguagcgccgugcccgucgauugggugccgacgucccgcaccacauggucuauucacgcucaucaccaauggaugaccacagaggacaugcuuagcguuuggaaccggguguggaucgaagagaauccuuggauggaagauaaaacccaugucuccagcuggggagacgugcccuaucugggcaagagagaggaccaguggugcgggucucucauuggacugacagcccgggccaccugggcuuccaacauccagguggccaucaaucagguuagacgccugauuggcaacgagaauuaccucgauuacaugacgagcaugaaacgguucaagaacgaaggggaccccgagggcgcgcugugguga

SEQ ID NO: 19117 - RNA, 9879 nt, Artificial Sequence
  derived and/or modified CDS sequence (opt5) from DENV-1__GQ199847__SS-prME
agcgugaccaugcugcugaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacagaacaguauaaauuccaagccgacucuccuaagcggcugagcgcggccauuggcaaggcuugggaggagggggugugcggcaucagauccgccacccgccuggaaaacaucauguggaagcagauuucuaacgagcucaaucauauccugcuugaaaacgacaugaaauuuacgguuguggucggagauguggcuggcauucuggcccaggggaagaaaaugauccggccgcagcccauggaguacaaguauagcuggaaguccuggggaaaagccaagauuaucggcgcugacgugcaaaauacaaccuucaucauugaugggccuaacacccccgaauguccugacgaucagagagcguggaauaucugggaggucgaggacuacggauuuggcauuuucacaaccaacaucuggcucaaacugcgcgauagcuauacgcagguuugcgaccaccggcugaugucugccgcuauuaaggauuccaaagccgugcacgccgacaugggcuacuggaucgaaagcgagaagaaugaaacauggaaacuugcuagagccucuuucaucgaggugaaaaccuguauuuggcccaagucccauacacucuggagcaacgggguccuggaaucugagaugaucauuccgaaaaucuauggaggcccuauuagccagcacaauuaccgccccggguacuuuacccaaacagcgggaccuuggcaucugggcaagcucgagcuggauuucgaccuuugcgaagggaccacggugguuguggaugagcacugcggaaaccggggccccucccugagaaccacaaccgucacaggcaaaaucauccacgaaugguguugccggagcuguacccucccuccccugcgcuuuaagggggaggacggaugcugguauggcauggagauuagaccggugaaggaaaaagaggaaaaucugguuaagucuaugguguccgcugggagcggagaggucgacuccuucucucuuggccuccuguguaucagcauuaugaucgaagaggugaugcgguccagauggucucgcaaaaugcugaugacggggacacucgccgucuuuuuccugcuuauuaugggacagcugaccuggaacgaucucauccggcugugcauuauggugggcgccaaugcuagcgacagaaugggcauggggacaaccuaccuggcccuuauggcgaccuuuaagaugcgcccuauguucgcugucggacugcucuuuagacggcugacaucccgcgaggugcuccugcuuacgaucggccugucucucguggccagcgucgaacugcccaacucccuggaggaacuuggggauggacuggccaugggcaucaugauucucaaacugcucaccgacuuccagagccaucaacugugggcuacacuucugucucucaccuuuaucaagacaaccuucucccugcacuaugccuggaagacgauggcuaugguucugagcauugugucucuuuuuccccugugucucuccacaaccagccagaaaaccacauggcugccugugcuccuggggucucuuggaugcaagccgcugaccauguuccugaucgccgagaauaaaauuuggggcagaaaguccuggccccucaacgaaggcaucauggcggucgggaucgugagcauucugcuuuccgcccugcucaaaaacgauguuccucuggcuggaccccucaucgccggcgggaugcugauugcuuguuacgugaucagcggaucuagcgccgaccuuucccuggagaaggccgcugaggucucuugggaagaggaagcggagcauagcggcgccucccacaauauucugguggaaguucaggaugacgggacaaugaaaaucaaggaugaggagcgggacgauacgcucaccauccugcuuaaggcuacacugcucgccgugucuggagucuauccucugagcauucccgccacccucuucgugugguacuuuuggcagaaaaagaaacaacgcuccggcguccugugggacacaccuucucccccggaaguggagagagcuguucuugaugacggcaucuaucggauuaugcagcgcgggcugcugggaagaagccaggugggcgucgggguguuccaggaaaacguuuuucauaccauguggcacgugacgcggggagccguccucauguaccaaggcaagcgccuggagccuuccugggcgagcgugaaaaaggaccuuaucucuuacgggggaggcuggagacugcagggcuccuggaauaccggggaggaagugcagguuauugcugucgagcccggaaagaacccuaaaaaugugcagacagcccccggcaccuucaagacaagcgaaggggaggugggagccaucgcucucgauuuuaaaccgggcaccucuggguccccuauugucaaccgggaaggaaagaucgugggccuguauggcaaugggguugugacaacgagcggaaccuacgucuccgccaucgcgcaagcuaaagccucucaggagggcccccucccugagauugaagacgagguguucagaaagcgcaaccugacaaucauggaucuucaccccgggagcggaaagacccggagauaucugcccgccauuguucgcgaagcuaucaaacggaagcugagaacccucauucuggccccuacacgcguggucgcuuccgagauggccgaagcgcuuaaaggcaugccgauccgguaccagacgaccgccgugaaguccgagcauacagggaaagagaucguugaccugaugugccacgcuaccuuuacaaugagacuccugucucccgugcgcgucccuaauuauaacaugauuaucauggaugaagcccauuucaccgaccccuccagcauugcugcccggggcuacaucucuacgagagugggaaugggcgaggccgcugcgauuuuuaugacagccaccccucccgggagcguggaggcuuucccucaauccaaugccgucauccaggaugaagaacgggacaucccggagcgcucuuggaacagcggauaugaguggauuaccgauuuucccggcaagacaguuugguucgugccuuccaucaagucugggaaugacauugccaacugucugcgcaagaauggaaagcgggugauccagcucagccgcaaaaccuucgauacagaauaccagaagaccaaaaacaacgacugggacuacgucgugacgacagauauuuccgagaugggcgcuaauuuuagagccgaccggguuaucgaucccagacgcugccuuaagccugugauucugaaggacgggcccgaacgggucauccuggcgggcccgaugccugugaccguugcuagcgccgcccaaagacgcggacggaucggcagaaaccacaauaaagagggggaucaguauauuuacaugggacagccccucaacaaugacgaggaucaugcucacuggacagaagccaagaugcugcuugacaacaucaauacccccgagggcauuaucccugcgcuguucgaacccgagcgcgaaaaaucugccgcuauugauggggaguaucggcucagaggagaggcccgcaagacguuuguggaacugaugagacggggcgaccugccugucuggcucuccuacaaaguggcuagcgagggguuccaguauuccgaucgcagauggugcuuugacggcgaacggaacaaucaaguccuugaggaaaacauggauguggagaucuggaccaaggagggagaacgcaaaaagcugagaccgcgguggcuggacgccagaacauacucugacccccucgcucugcgcgaguucaaggaauuugccgcgggccggagaagcguuuccggggaucuuauccuggagauuggaaaacucccucagcaccugacccagcgcgcccagaaugcucuggacaaccucgugaugcuucauaauucugaacaaggcgggcgggccuauagacacgcuauggaggagcugcccgauacaaucgaaacccugaugcuccuggcccuuauugccgugcugacaggaggcgucacccucuucuuucugagcggccgggggcugggaaagacguccaucggccuccuuuguguuauggcuagcucugugcugcuguggauggcguccguggagccucauuggauugccgcuagcaucauccucgaguucuuucugaugguccuucugauucccgagccggaccgccagagaacaccucaggauaaccagcucgccuacgugguuaucgggcugcuguucaugauucucaccguggccgcuaaugagaugggacuucuggaaaccaccaagaaggaccugggcaucgggcacgucgccguggagaaccaccaucacgcggccaugcucgaugucgaccugcaucccgcuucugccuggacccuuuacgcuguggccacaacgauuaucaccccuaugaugcggcacacaauugaaaacaccacagcgaauaucucccugaccgccaucgcuaaccaagccgcuauucucaugggacuggauaaaggcuggcccaucagcaagauggacauuggcguuccucugcucgcccuugggugcuauucucaggugaauccccugacgcugaccgcugccguccucaugcugguggcgcauuacgccaucauuggaccgggccuucaggcuaaggccacacgcgaggcucagaagagaaccgccgccgggaucaugaagaacccuacaguugauggaaucguggcgauugaccuggaucccgucguguaugacgcuaaauuugaaaagcagcucggccagaucaugcugcugauucucuguaccagccagauccuucugaugcggacgacaugggcccugugcgaguccauuacccucgcuacagggccccugaccacccuuugggagggaucuccuggcaaauucuggaauacaacgaucgccgugagcauggccaacaucuuccgcggcuccuaccuggcuggggccggacucgcguuuagccugaugaagucccugggcgggggaagacggggcaccggggcccaaggagaaacacucggcgagaaguggaaacgccagcuuaaucagcugucuaagagcgaguucaacaccuauaaaagauccggcauuauggagguugaccggucugaagcuaaggaggggcugaaaagaggagagacaaccaagcacgccgucagccgcggcacggcuaagcuccggugguuuguggaaagaaaucuggugaaaccggaggggaaggucaucgaucuuggauguggccgcgggggaugguccuacuauugcgccggccugaaaaagguuacagaagugaaaggcuacaccaaagggggacccggccacgaggaaccuauucccauggcgaccuacggguggaaccucgugaaacugcauucuggaaaggacgucuucuuuaucccucccgagaagugugauacacugcucugcgacauuggcgagagcuccccuaauccgaccaucgaagaggggcggacacuuagagugcugaaaaugguugaacccuggcugcgcggaaaccaguucuguauuaagauccucaauccuuauaugcccagcguggucgagacgcuggagcaaaugcagcggaaacacggcggcaugcuugugagaaacccucugucucgcaauuccacccaugaaauguacuggguuagcugcgggacaggaaacaucgugucugccgucaauaugaccucccggaugcuccugaacagauuuacaauggcucaccgcaagcccaccuaugagcgggauguggaccugggcgccgggacgagacacguggcugucgaaccggagguugccaaccucgauauuaucggacagcgcauugaaaauaucaaacaugagcacaagagcaccuggcauuacgacgaggauaacccuuauaagacaugggcuuaccacggcucuuaugaagugaaacccuccgggagcgccuccagcauggugaauggagucgugaagcugcuuaccaaacccugggacguuauuccuauggugacacagaucgcgaugaccgauacaacccccuucggccaacagagagucuuuaaggagaaaguggacacgcggacaccuaaggccaagcgcggcaccgcucagaucauggaaguuaccgccaaauggcuguggggguuccucucuagaaacaagaaaccgcggauuuguacaagagaggaauuuacgcggaaggugcgcagcaaugcugccaucggagccgucuucguggacgagaaccaauggaacuccgcgaaagaggcuguugaagaugagagauuuugggaccuggugcaucgggaacgcgagcuucacaagcagggcaagugcgccacaugcgucuacaacaugauggggaaaagagaaaagaaacugggagaguucggcaaggccaaagggucucgggcuauuugguacauguggcucggcgcccgcuuccuggaguuugaagcucugggauucaugaaugaggaucacugguuuagcagagaaaacucccucucuggcguggagggggagggacugcauaaacuuggcuauauccugcgggacauuagcaaaauccccgggggaaauauguacgccgaugacacagcgggcugggauacccgcaucacagaagacgaucuccagaacgaggccaagauuaccgacaucauggaaccugagcacgcucugcuugccaaguccauuuucaaacugacauaucagaauaaggucgugagaguucaacggcccgcuaaaaacgggaccgugauggaugucaucucucgcagagaccagcggggcagcggacaggugggcacguacgggcucaauaccuuuacaaacauggaagcccagcugauucgccaaauggaguccgagggaaucuucagcccuucugaacuggagacccccaaccucgcgggcagagugcuggauuggcuugaaaagcaugggguugagcggcugaaaagaauggccaucuccggagacgacuguguggucaagccgauugaugaccgcuuugcuacagcccucaccgcucugaaugauaugggcaaggugcggaaagacaucccucagugggaacccagcaagggguggaacgauuggcagcagguuccuuucugcucucaccacuuucaucaacuuauuaugaaagacggcagagagaucgugguccccugucgcaaucaggaugagcuggugggacgggccagagucucccagggcgcuggguggagccuccgcgaaacggccugccugggaaaguccuaugcgcagauguggcaacugauguacuuccaccggagagaccuccgccuggccgcuaacgccauuuguucugccgauccugacgauugggugcccacaagccggaccacaugguccauccaugcucaccaucaguggaugaccacggaggacaugcuuagcguuuggaauagaguguggauugaagagaacccguggauggaagacaaaacccacaucucuuccuggggcgaugucccuuaucuggggaagcgcgaggaccaguggugcggaagccucaucggccugacagcccgggcgaccugggcuacaaauauucaaguggccaucaaccagguuagacggcuuauugggaaugagaacuaccuggauuacaugaccucuaugaagagauuuaaaaaugaaagcgaccccgagggcgcccucugguga

SEQ ID NO: 19118 - RNA, 9879 nt, Artificial Sequence
  derived and/or modified CDS sequence (opt5) from DENV-1__GQ199849__SS-prME
agcgugaccaugcugcugaugcugaugcccacagcccuugcuuuccaccugacgaccagaggaggggaaccucauaugaucgucacaaagcaggaacggggaaaaucccuccuguuuaagaccucugccggcguuaacaugugcacacuuauugcgauggaccugggggaacucugugaagauaccaugacauacaaaugcccccgcaucaccgaggcugaacccgacgauguggacuguuggugcaaugccacggauaccugggugacauauggaaccuguagcagaacaggcgagcaccggcgcgacaagagauccgucgcccuggcuccucauguggggcugggacucgagacccggacggaaacauggaugucuagcgagggcgccuggaaacaaauucagcgcguugaaaccugggcucugagacaccccggcuucacagugaucgcccuuuuucuggcgcaugccauugggaccuccaucacccagaagggaaucauuuucauccuccugaugcuugucacaccuucuauggcuaugcggugcgugggcauugggagccgcgauuuuguugagggacuguccggcgccacguggguggacgucgugcucgagcacgggagcugugugaccacaauggcuaaggauaaacccacccuggacaucgaacugcucaagacagaggucaccaacccugccguucugagaaaacuuugcauugaagcgaagaucucuaauacgacaaccgauucccgguguccgacccagggagaggccacacugauggaagaacaagacgcuaacuucgugugccgcagaaccuuuguggaucggggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucagguggggaaugaguccaccgaacacggaacaaccgcuacgauuacaccccaagccccuacaagcgagauccagcucaccgacuacggcgcccugacacuggauuguucuccccgcaccggccucgacuucaacgaaaugguucugcuuacgaugaaggagaaauccuggcuggugcauaagcagugguuucucgaucugccucuucccuggacaagcggggcuuccaccucucaggagacauggaauagacaagaccugcucgucaccuucaaaaccgcgcacgccaagaagcaggaaguggucgugcugggaagccaggagggcgcuaugcacacagcccugacgggggccaccgaaauucaaacauccggaaccacaaccaucuuugcuggccaucucaaaugccggcugaagauggauaaacuugcccugaaggggaugagcuauguuauguguacgggcucuuucaaacucgagaaggaaguggcggagacacagcacggaaccguccuggugcagauuaaguacgagggcaccgacgcuccgugcaaaaucccuuucuccacacaggaugaaaaggggguuacccaaaacggaagacugaucacagccaaucccauugugacggacaaagagaagccugucaacaucgaagccgagccgcccuuuggcgagagcuauauugugaucggggcuggagaaaaagcccuuaagcucucuugguucaagaaaggcagcuccauugggaagauguuugaggcuaccgcccgcggcgcgcggagaauggccauccugggagauacagcuugggacuucggcucuaucgggggaguguuuaccagcguuggcaaacugguccaucagauuuucgggacagccuacggagugcucuuuuccggcgugagcuggaccaugaagaucgggauuggcguccugcuuacguggcugggacucaauucucgcuccaccagccugucuaugacauguaucgcugugggccugguuacccuuuaccucggggugaugguccaggccgauuccggaugcgugauuaacuggaaaggccgggaacugaagugugggagcggaaucuucguuacaaaugaggugcacaccuggacagaacaguauaaguuucaagcggacuccccuaaaagacugucugccgcuauuggcaaggccugggaggagggggucugcggcauccgcagcgcuacccggcucgaaaacaucauguggaaacagauuuccaacgagcugaaucauauccuucuggaaaacggacucaaguucacggugguugugggcgacgucguggggauucuggcccagggcaagaagaugaucagaccgcagcccauggagcacaaauacucuuggaaaagcuggggcaaggccaagauuaucggggcugaugugcaaaauacaaccuuuaucauugacggaccuaacacccccgaauguccugaugaccagcgcgcguggaauaucugggaggucgaggauuauggcuucggcauuuuuacaaccaacaucuggcugaaacuucgggacuccuacacgcagguuugcgaucacagacucaugagcgccgcuauuaaagacucuaaggccgugcaugccgauaugggguauuggaucgaauccgagcgcaaugaaacauggaaacuggcucgggccagcuucaucgaggugaagaccuguauuuggcccaagucucacacacugugguccaacggaguccucgaaagcgagaugaucauuccgaaaaucuacggcgggccuauuucucagcauaauuauagacccggauacuucacccaaacagcgggcccuuggcaccuggggaaacuugagcuggacuuugaucucugcgaaggaaccacggugguuguggacgagcacugcggcaaccggggccccagccugcgcaccacaaccgucacagggaaaaucauccaugaaugguguugcagauccuguacccugccuccccuucgguucaagggagaggauggcugcugguacgggauggagauuagaccggugaaagaaaaggaggaaaaucucguuaagagcauggugucugcuggauccggcgaggucgacagcuuuucccuggggcugcucuguacgucuaucaugauugaagaggugaugcgcagccggugguccagaaaaaugcugaugacaggaacccuugccguuuuccugcuccugaucaugggccagcugacauggaacgaccuuauucgccugugcaucauggugggcgccaaugcuucugauagaauggggaugggaaccaccuaucucgcccugauggcgacauuuaagaugcggccuauguucgcugucggccuccuguuucgcagacuuacgagccgggaggugcugcuccugaccauugggcugucccuuguggccucugucgaacugcccaacagccucgaggaacugggagacggccucgccauggggaucaugauccugaaacuucugacagauuuccagucccaccaacucugggcuacccugcugagccuuacauuuauuaagaccacgcugucucuccauuacgccuggaaaacaauggcuaugguucuguccaucgugagccucuucccccugugucuuucuaccaccucccagaagacaaccuggcugccugugcugcucggaagccugggcugcaagccgcuuacaauguuucugauugccgagaauaaaaucuggggccgcaagucuuggccccucaacgaagggauuauggcggucggagugguuuccauccugcucagcucccugcuuaaaaacgacgugccucuggccggcccccugaucgcugggggaaugcucauugccuguuaugucaucagcggcucuagcgcugaucugucccuugagaaggccgccgaggugucuugggaagaggaagcugagcacagcggggcgucccauaauauuuucguugaagugcaggacgauggaacgaugaaaaucaaggacgaggagagagaugacacccugacaauucuccugaaagccacccuccuggcugucucuggcguguacccucuuagcauccccgccacacuguuugucugguauuucuggcagaagaagaaacaacgguccggcgugcugugggauaccccuucucccccggaaguugagcgcgccgcucucgacgaugggaucuacagaauuaugcagcggggacugcuuggccgcagccaggugggggucggaguguuccaggaaaacguuuuucacacgauguggcacgugaccagaggcgccguccugauguaucaagggaagcggcucgagccuuccugggcgagcgugaaaaaggaccugaucucuuacggaggcggcuggagacuccagggguccuggaauacaggagaggaagugcagguuauugcugucgagcccggcaaaaacccuaagaaugugcagaccgcccccgggacauucaagaccccggaaggagaggugggcgccaucgcucuggacuuuaaaccugggacaagcggaucucccauugucaaccgcgaaggcaagaucgugggccuuuacgggaauggaguugugacgaccuccggcacauaugucagcgccauugcgcaaaccaaggcuucccaggaggggccucugcccgagaucgaagaugagguguuccggaagagaaaccugaccaucauggaccuccaucccggaucuggcaaaacacgccgguaccugccugccauuguuagagaagccaucaagcgcaaacuucggacgcugauucucgcuccgaccagaguggucgccagcgagauggcugaagcccugaaagggaugcccauccgcuaucagacaaccgcggugaaguccgagcacacaggcaaagagauuguugaucugaugugccaugccaccuuuacgaugcggcuccuuagcccugugagaguccccaauuacaacaugaucaucauggacgaagcucacuucacagauccuucuuccauugccgcucggggauauaucagcacccgcgugggcaugggggaggccgccgcuauuuuuaugaccgcgacacccccuggaucuguggaagccuucccgcaaagcaaugcugucauccaggacgaggaaagagauauucccgagcgguccuggaacucuggcuacgaguggaucaccgacuuuccugggaagacaguuugguucgugcccagcaucaaauccggaaaugauauugccaacugucugcgcaagaauggcaagagagugauccagcugucucggaaaaccuuugacacggaauaucagaagaccaagaacaacgauugggacuacgucgugaccacagacauuagcgagaugggggccaauuucagagcugaucgcguuaucgacccucggagaugccucaagcccgugauucugaaagauggcccggaacgcgucauccuugccggaccuaugcccgugaccguugcguccgcugcccaacggagaggccgcauugggcggaaccauaauaaggagggagaccaguacaucuauaugggccagccccugaacaaugaugaggaccacgcccacuggacggaagcuaagaugcuccuggauaacaucaauaccccugaggggauuauccccgcccuguucgaaccugagagagaaaagagcgcggccauugacggagaguaccgccucagaggcgaggcucggaagacauuuguggagcuuaugcgcagaggggaucugccggucuggcugucuuauaaaguggccuccgagggcuuccaguacagcgaccggcgcuggugcuuugauggagaaagaaacaaucaaguccucgaggaaaacauggacguggagaucuggaccaaggagggcgaacggaaaaagcugagaccccgcuggcuugaugcucggacauauuccgacccucuggcccucagagaguucaaagaauuugcugccgggcgccggucuguuagcggagaccugauucuggagaucggcaagcucccccagcaucuuacccagagagcgcagaaugcccuggauaaccuggugaugcuccacaauuccgaacaagggggacgggcuuaccgccaugccauggaggagcugccugacacaaucgaaacccuuaugcugcucgcucugauugccgugcugacgggcggcgucacacucuucuuucuuucugggagaggacugggcaagaccagcaucgggcugcucuguguuauggccuccagcgugcugcuuuggauggcuucuguggagccccacuggauugcggccuccaucauucuggaguucuuucucaugguccugcugaucccggagccugaucggcagcgcacaccccaggacaaccagcucgcuuaugugguuaucggacuucuguucauuauccugacaguggccgccaaugagaugggccuccuggaaaccaccaagaaggaucuugggauuggacacgucgcuguggagaaccaucaccaugccacgaugcuggacgucgaucuccacccugcgagcgccuggacccuguacgcuguggccacaaccaucauuacacccaugaugagacauaccaucgaaaacacgaccgcuaauauuucucugacagccaucgcgaaccaagccgcuauccucaugggccuugacaaaggcuggccuauuuccaagauggauaucgggguuccccugcuggcccucggaugcuacagccaggugaauccgcugacccuuacagcugccguccugaugcucguggcucacuaugccauuaucggcccugggcugcaggcgaaagccacccgggaggcucaaaagcgcacggccgcuggaauuaugaagaaccccacaguugacggcaucguggccaucgaucuggaccccgucguguacgaugccaaauuugaaaagcagcucgggcagauuaugcuucugauccuguguaccucucagauucuccugaugagaacaaccugggcgcuuugcgagagcaucacccuggcuacaggaccucucacgacccugugggagggcuccccgggcaaauucuggaauacaaccauugccgugucuauggcuaacaucuuucgggggagcuaucuggccggagccggccucgcuuucucccuuaugaaaagccucgggggaggccgcagagggacaggagcccaaggcgaaacccugggcgagaaauggaagcggcagcucaaucagcuguccaagucugaguucaacaucuacaaaagaagcgggauuauggagguugaccgcuccgaagcgaaggagggacuuaaacggggcgagacgacaagacacgccgucucucgcgggaccgcuaagcugcggugguuuguggaaagaaaucucgugaaacccgagggaaaggucaucgaccugggcugugggcgcggaggcuggagcuauuacugcgccggccugaagaaaguuaccgaagugaagggguauacaaaaggaggcccugggcaugaggaacccauuccuauggcuaccuacggauggaaccucgugaaacuucacuccggcaaagaugucuucuuuacacccccugagaagugugacacgcugcugugcgauaucggggagucuagcccgaaucccaccauugaagagggacggacacucagagugcugaaaaugguugaaccuuggcuucgcggcaaccaguucuguaucaagauucugaaucccuacaugccuuccguggucgagacccucgagcaaaugcagcggaagcauggcgggaugcuggugagaaacccccugagccgcaauucuacacacgaaauguauuggguuuccugcggaaccggcaacaucgugagcgccgucaauaugacgucucggaugcuccugaacagauuuaccauggcgcaccgcaaaccgacauacgagagagacguggaucuuggggccggaacccggcauguggcugucgaaccugagguugccaaccuggacaucauuggccagcgcaucgaaaauauuaagcacgagcauaaauccacauggcacuaugaugaggacaaccccuacaagaccugggcuuaucaugggagcuacgaagugaaacccucuggauccgccagcuccauggugaauggcgucgugaagcuccugacaaagccuugggauguuauccccauggugacccagauugcuaugacggacacaaccccuuucggccaacagagagucuuuaaagagaagguggauacccggacaccgaaagccaagagagggacggcgcagaucauggaaguuaccgcccgguggcuuuggggauuccugagccgcaacaaaaagcccagaaucuguacacgggaggaauuuacccgcaaggugagaucuaaugcugccauuggcgcugucuucguggacgagaaccaauggaauagcgccaaagaggccguugaagacgagcgguuuugggaucucgugcagaaggaacgcgagcugcacaaacaggggaagugcgcgacaugcgucuauaacaugaugggaaaaagagaaaagaagcugggcgaguucgggaaagcuaagggcucccgggccaucugguacauguggcucggagcccgcuuucuggaguucgaagcucuuggcuucaugaaugaggaccacugguuuucuagagaaaacagccuguccgggguggagggagagggccuccauaaacugggguacauucuucgggauaucucuaagauuccuggaggcaauauguaugccgacgauaccgcugggugggacacacgcaucaccgaagaugaccugcagaacgaggccaaaaucacggauauuauggaacccgagcacgcgcuccuggccaccagcaucuucaagcugacauaccaaaauaaagucgugagaguucagcggccugcuaagaacggcaccgugauggacgucauuucccgcagagaucagcggggaucuggccagguggggacauauggacucaauaccuuuacgaacauggaagcccaacugaucagacagauggagagcgagggcauuuuccuucccuccgaacuggagacaccgaaccucgcugaacgcgugcuggacuggcuugagaaguacgggguugaacggcugaaaagaauggccaucagcggagaugacuguguggucaagccuaucgacgaucgcuuugcgaccgcccucacagcucugaaugacaugggcaaagugcggaaggauauuccccagugggagccuucuaaaggguggaacgacuggcagcaaguucccuucugcucccaucacuuucaccagcugaucaugaaggauggcagagagauuguggucccuugucgcaaucaggacgaacucgugggacgggccagagucagccagggcgcuggguggucucugcgcgagaccgccugccuuggaaaguccuaugcucaaauguggcagcugauguacuuccaucggagagaucuccgccuggccgcgaacgccaucuguagcgcugugcccguugacugggugccgacgucccggaccacauggucuauucacgcccaucaccaguggaugaccacagaagauaugcuuagcgucuggaauagaguguggaucgaggaaaacccuuggauggaggacaaaacccauguuuccagcuggggcgaugugcccuaucuggggaagcgggaggaccaauggugcggaucucucauuggccugacagccagagcuaccugggccuccaauauccaggucgcgaucaaccaggugcgccggcugauugggaaugaaaacuaccucgacuacaugacgagcaugaaaagauuuaagaaugagggcgaucccgaaggagcucugugguga

SEQ ID NO: 19119 - RNA, 9879 nt, Artificial Sequence
  derived and/or modified CDS sequence (opt5) from DENV-1__FJ898410__SS-prME
agcgugaccaugcugcucaugcugacacccacggcccuugcuuuccaccugaccacaagaggcggggagccucauaugaucgucuccaagcaggaacggggaaaaucucuccuguuuaagaccagcgccggcguuaacaugugcacacuuauugcgauggaccugggggaguucugugaagauaccaugacauacaaaugcccgcgcaucaccgaggcugaacccgacgauguggacuguuggugcaaugccacggauaccugggugacauauggaaccuguucccaaacaggcgagcacagacgggacaagcgcucugucgcccucgcuccucauguggggcugggacuggagaccagaacggaaacauggaugagcuccgagggcgccuggaaacagauucagcggguugaaaccugggcucuccgccaccccggcuuuacagugaucgcccuguuccuugcgcaugccauugggaccucuaucacccagaagggaaucauuuuuauccugcucaugcuggucacaccuagcauggcuaugagaugcgugggcauugggucccgggauuucguugagggacuuagcggcgccacguggguggacgucgugcuggagcacgggucuugugugaccacaauggcuaaggauaaacccacccucgacaucgaacugcugaagacagaggucaccaacccugccguucuccgcaaacugugcauugaagcgaagaucuccaauacgacaaccgauagcagauguccgacccaaggagaggccacacuuguggaagagcaggacgcuaacuuugugugccggcgcaccuucgucgauagaggcuggggcaauggguguggacuguuuggcaaagggucucucauuacaugcgccaaguucaagugcgugacgaaacuggagggaaagaucguucaguacgaaaaccuuaaauauuccgugaucgucaccgugcacacaggcgaccagcaucaaguugggaaugagagcaccgaacacggaacaaccgcuacgauuaccccccaggccccuucuacagagauccagcugaccgacuacggcgcccucacacuggauuguuccccccggaccggccuggacuuuaacgaaauggugcuccugacgaugaaggagaaaagcuggcuuguccauaagcagugguuccuggaucucccucugcccuggacauccggggcuucuaccagccaagagacauggaaucgccaggaccuucuggugaccuuuaaaaccgcgcacgccaagaagcaggaagucgugguucucggaucccaagagggcgcuaugcacacagcccugacgggggccaccgaaauucagacaagcggaaccacaaccaucuucgcuggccaucugaaaugcagacucaagauggauaaacugacgcuuaaggggaugucuuaugugauguguacaggcuccuucaaacuggagaaggaagucgccgagacccagcacggaaccgugcucguucagauuaaguacgagggcacagacgcgccgugcaaaaucccuuuuagcacccaagaugaaaagggggugacacagaacggacggcugaucacggcuaaucccauugucaccgacaaagagaagccugugaacaucgaagccgagccccccuucggcgagucuuauauugugaucggggccggagaaaaagcucugaagcuuagcugguuuaagaaaggcuccucuauugggaagauguucgaggccacagcuagaggcgcccgccggauggcgauccucggagauaccgccugggacuuuggcagcaucgggggaguuuucacauccgucggcaaacuggugcaucagauuuuugggaccgcuuacggagugcuguucagcggcgucucuuggacgaugaagaucgggauuggcgugcuccugaccuggcuuggacugaauuccagaagcacaucucucuccaugaccuguaucgccguuggccuggugacacuguaccuuggggucauggugcaggcugauagcggaugcguuauuaacuggaaaggccgcgaacucaaguguggguccggaaucuuugugaccaaugagguccacacauggaccgaacaauauaaguuccaggccgacucuccuaaacggcugagcgcggccauuggcaaggcuugggaggagggggugugcggcaucagauccgccacgcgccuggaaaacaucauguggaaacagauuucuaacgagcucaaucauauccugcuugaaaacgacaugaagcugacaguuguggucggagauguggcuggcauucucgcccaggggaaaaagaugauccggccgcaacccauggaguacaaauauagcuggaagauuuggggaaaggccaaaaucaucggcgcugacgugcagaauaccaccuuuauuaucgaugggccuaacacacccgaauguccugacgaucagagagcguggaauauuugggaggucgaggacuacggauucggcaucuuuaccacgaacauuuggcugaagcugcgcgauuccuauacacagguuugcgaccaccggcuuaugagcgccgcuaucaaagauucuaaggccgugcacgccgacaugggcuacuggaucgaauccgagaaaaaugaaaccuggaagcucgcuagagccagcuucauugaggugaagacauguaucuggcccaaaucucauacccugugguccaacgggguccuggaaagcgagaugauuaucccgaagauuuauggaggcccuaucucucaacacaauuaccgccccggguacuucacacagaccgcgggaccuuggcaucucggcaaacuggagcuugauuuugaccugugcgaagggacgaccgugguuguggaugagcacugcggaaaccggggccccagccucagaacaaccacagucaccggcaagaucauucacgaaugguguugccgguccuguacgcugccuccccugcgcuucaaaggggaggacggaugcugguauggcauggagaucagaccggugaaggaaaaggaggaaaaucuuguuaaaagcauggugucugcuggguccggagaggucgacagcuuuucccucggccugcuguguauuucuaucaugauugaagaggugaugcggagcagauggucccgcaagaugcucaugacagggacccuggccguuuucuuucuucugaucaugggacagcucacauggaacgaucugauucggcugugcaucauggugggcgccaaugcuucugacagaaugggcauggggaccaccuaccuugcccugauggcgacauucaaaaugcgcccuauguuugcugucggacuccuguucagacggcucacgagccgcgaggugcugcuucugaccaucggccucucccugguggccucugucgaacugcccaacagccuugaggaacugggggauggacucgccaugggcauuaugauccugaagcuccugacagacuuucaaucccaucagcuuugggcuacccugcucagccugacauucauuagaaccacguuuucucugcacuaugccuggaaaacaauggcuaugguucuuuccaucgugagccuguucccccucugucugucuaccaccucccagaagacaaccuggcucccugugcugcuugggagccugggaugcaagccgcugacaauguuucucauugccgagaauaaaaucuggggccggaagucuuggccccugaacgaaggcaucauggcggucgggauuguguccauccuucugagcucccuccugaaaaacgauguuccucucgccggaccccugauugcuggcgggaugcuuaucgccuguuacgugauuagcggaucuagcgcugaccugucccuggagaaggccgccgaggucucuugggaagaggaagcugagcauagcggcgcgucccacaauauccucguggaaguucaggaugacgggacgaugaaaaucaaggaugaggagcgcgacgauacccugacaauucuucugaaagccacccuccuggcugugucuggagucuauccucucagcauccccgccacacuguucgugugguacuucuggcaaaagaagaaacagagauccggcguccuuugggacaccccuucucccccggaaguggagcgggccguucuggaugacggcauuuaucgcaucaugcagagagggcugcucggacggagccaggugggcgucgggguguuucaagaaaacguuuuccauacgauguggcacgugacccgcggagcuguccugauguaccagggcaagagacuugagccuuccugggccagcgugaaaaaggaccugauuucuuacgggggaggcuggcggcuccagggcuccuggaauacaggggaggaagugcagguuaucgcggucgagcccggaaaaaacccuaagaaugugcaaaccgcucccggcacauuuaagaccagcgaaggggaggugggagccauugcccuggauuucaaaccgggcacaucuggguccccuaucgucaacagagaaggaaagaucgugggccucuauggcaaugggguugugacgaccagcggaacauacgucuccgcuauugcccaggcgaaagcuucucaggagggcccccugccugagaucgaagacgagguguuucgcaagcggaaccuuaccauuauggaucugcaccccgggagcggaaaaaccagacgcuaucugcccgccaucguucgggaagccauuaagagacgccuccggacacugauccuugcuccuacgagaguggucgccuccgagauggcugaagcccugaagggcaugccgauccgcuaccaaaccacagcggugaaaagcgagcauaccgggaaggagauuguugaccucaugugccacgccacauucaccaugcggcugcugucucccgugagagucccuaauuauaacaugaucauuauggaugaagcucauuuuacggaccccuccagcaucgccgcucggggcuacauuucuacacgcgugggaaugggcgaggccgccgcuaucuucaugaccgcgaccccucccgggagcguggaagccuuuccucaguccaaugcugucauccaggaugaggaaagagacauuccggagcggucuuggaacagcggauaugaguggaucacagauuuccccggcaaaaccguuugguuugugccuuccauuaagucugggaaugacaucgccaacugucuccgcaaaaauggaaagagagugauucagcuuagccggaagacauucgauaccgaauaccaaaaaacgaagaacaacgacugggacuacgucgugacaaccgauaucuccgagaugggcgccaauuucagagcugaccgcguuauugauccccggagaugccugaaaccugugauccugaaggacgggcccgaacgcgucauccucgccggcccgaugccugugacaguugcgagcgcugcccagcggagaggacgcauuggccggaaccacaauaaagagggggaucaguauaucuacaugggacagccccugaacaaugacgaggaucaugcccacuggaccgaagcuaagaugcuucuggacaacauuaauacgcccgagggcaucauuccugcccucuuugaacccgagagagaaaagucugcggccaucgauggggaguaucgccugagaggagaggcucggaaaaccuucguggaacugaugcgcagaggcgaccucccugucuggcuuuccuacaagguggccagcgagggguuucaauauuccgaucggcgcuggugcuucgacggcgaaagaaacaaucagguccuggaggaaaacauggauguggagaucuggacaaaagagggagaacggaagaaacugagaccgcgcuggcucgacgcucggaccuacucugacccccuggcccuuagagaguuuaaggaauucgcugccggccgccggagcguuuccggggaucugauucucgagaucggaaaacugccucagcaccugacacagagagcgcaaaaugcccucgacaaccuugugaugcugcauaauucugaacagggcgggcgggcuuaucgccacgccauggaggagcugcccgauaccauugaaacacucaugcugcuugcucugaucgccgugcucaccggaggcgucacgcuguuuuuccugagcggcagagggcucggaaagacauccauuggccuucuguguguuauggccagcucugugcugcucuggauggcuuccguggagccucauuggaucgcggccagcaucauucuggaauuuuuccuuaugguccugcucauccccgagccggaccggcagcgcaccccucaggauaaccaacuggcuuacgugguuauugggcugcucuuuaugauccuuaccguggccgccaaugagaugggacugcuggaaacaaccaagaaagaccucggcauugggcacgucgcuguggagaaccaccaucacgccgcgaugcuggaugucgaccuucaucccgccucugcuuggacacuguacgccguggcuacgaccaucauuacaccuaugaugagacacaccaucgaaaacacaaccgccaauaucucccucacggcgauugccaaccaggcugccauccugaugggacuggauaagggcuggcccauuagcaaaauggacaucggcguuccucuccuugcucuggggugcuauucucaggugaauccccugacccucacagccgcuguccugaugcuuguggcccauuacgcgauuaucggaccgggccugcaagccaaggcuacccgggaggcccagaaacgcacagcugccgggaucaugaagaacccuaccguugauggaauuguggccaucgaccucgaucccgucguguaugacgcgaaguucgaaaaacagcugggccagauuaugcugcucauccuuuguacgagccaaauucugcugaugagaacaaccugggcucucugcgaguccaucacacuggccaccgggccccuuaccacacugugggagggaucuccuggcaaguuuuggaauacgaccaucgcugugagcauggccaacauuuuccggggcuccuaccucgccggggcuggacuggccuucagccugaugaaaucccucggcgggggacgcagaggcacaggggcgcagggagaaacccuuggcgagaaguggaaacggcagcugaaucagcugucuaagccggaauuuaacacauauaagagaagcggcaucauggagguugaccgcuccgaagccaaagaggggcucaagcggggagagaccacgaaacacgcugucucuagaggcacagccaagcugcgcugguucguggaacggaaucuugugaaacccgaggggaaggucauugaucugggauguggcagagggggauggagcuacuauugcgcuggccucaagaaaguuaccgaagugaagggcuacaccaaagggggaccuggccacgaggaacccaucccuauggccacauacggguggaaccuggugaagcugcauuccggaaaagacgucuuuuucauucccccugagaagugugauacccuccuuugcgacaucggcgagucuagcccgaaucccacaauugaagaggggcgcacgcugcgggugcugaaaaugguugaaccuuggcucagaggaaaccaauuuuguaucaagauccugaaucccuauaugccuuccguggucgagacccuugagcagaugcagcgcaagcacggcggcaugcuggugcggaacccccucagcagaaauucuacacaugaaauguacuggguuuccugcgggaccggaaacauugugagcgcggucaauaugacaucucgcaugcugcugaaccgguucaccauggcccacagaaaaccgacguaugagcgcgauguggaccucggcgcugggaccagacacguggccgucgaaccugagguugcuaaccuggauaucauuggacagcggaucgaaaauauuaagcaugagcacaaauccacauggcauuacgacgaggauaaccccuauaagaccugggccuaccacggcagcuaugaagugaaacccucuggguccgcuagcuccauggugaauggagucgugaagcuucugacaaagccuugggacguuauccccauggugacccaaaucgccaugacagauaccacgccuuuuggccagcagcgcgucuucaaagagaagguggacacaagaaccccgaaagcgaagcggggcaccgcccaaauuauggaaguuacagcuaaauggcucuggggguuucugagcagaaacaagaagccccggaucuguacgcgcgaggaauucaccagaaaagugcggucuaaugccgcuauuggagccgucuuuguggacgagaaccaguggaauagcgccaaggaggcgguugaagaugagcgcuucugggaccuugugcauagagaacgggagcugcacaaacagggcaagugcgcuacaugcgucuacaacaugauggggaaacgcgaaaagaagcucggagaguuuggcaaagccaagggguccagagccaucugguacauguggcugggcgcucgguuccuggaguucgaagcccucggauuuaugaaugaggaucacugguucucucgcgaaaacagccuguccggcguggagggggagggacuucauaaacugggcuauauucucagagacaucucuaagaucccugggggaaauauguacgcugaugacaccgccggcugggauacacggauuaccgaagacgaucugcagaacgaggcgaaaaucacagacauuauggaacccgagcacgcccuucuggcuaagagcaucuuuaaacucaccuaucaaaauaaggucgugcgcguucagagaccugccaagaacgggacggugauggaugucauuucccggcgcgaccagagaggcucuggacaggugggcaccuacgggcugaauacauucaccaacauggaagcucaacugauccggcagauggagagcgagggaaucuuuucccccagcgaacucgagacaccgaaccuggccggcagagugcuugauuggcuggaaaaacaugggguugagcgccucaagcggauggcgauuucuggagacgacuguguggucaaaccuaucgaugacagauucgccaccgcucugacggcccuuaaugauaugggcaaggugcgcaaagacauuccccagugggaaccuuccaagggguggaacgauuggcagcaaguucccuuuugcagccaccacuuccaucagcugaucaugaaggacggccgggagauuguggucccuuguagaaaucaggaugagcucgugggacgcgcucgggucucucagggcgccggguggucccugagagaaacagcuugccugggaaaaagcuaugcccaaauguggcagcucauguacuuucaccgccgggaccugagacuugcggccaacgcuaucuguuccgccgugcccguugauugggugccgaccucucgcacaaccuggagcauucaugcccaccaucaguggaugacgaccgaggacaugcuguccgucuggaaucggguguggaucgaagagaacccuuggauggaagauaagacacacguuagcucuuggggcgacgugcccuaucucgggaaaagagaggaccaauggugcggaucccugaucggccuuaccgcucgggccacaugggcgaccaauauucaggucgcuaucaaccaggugagacgccugcucgggaaugagaacuaccuggauuacaugacaagcaugaagcgguucaaaaaugaaucugaccccgagggcgcccugugguga

SEQ ID NO: 19120 - RNA, 9879 nt, Artificial Sequence
  derived and/or modified CDS sequence (opt5) from DENV-1__FJ898411__SS-prME
agcgugaccaugcugcugaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacagaacaguauaaauuccaagccgacucuccuaagcggcugagcgcggccauuggcaaggcuugggaggagggggugugcggcaucagauccgccacccgccuggaaaacaucauguggaagcagauuucuaacgagcucaaucauauccugcuugaaaacgacaugaaauuuacgguuguggucggagauguggcuggcauucuggcccaggggaagaaaaugauccggccgcagcccauggaguacaaguauagcuggaaguccuggggaaaagccaagauuaucggcgcugacgugcaaaauacaaccuucaucauugaugggccuaacacccccgaauguccugacgaucagagagcguggaauaucugggaggucgaggacuacggauuuggcauuuucacaaccaacaucuggcucaaacugcgcgauagcuauacgcagguuugcgaccaccggcugaugucugccgcuauuaaggauuccaaagccgugcacgccgacaugggcuacuggaucgaaagcgagaagaaugaaacauggaaacuugcuagagccucuuucaucgaggugaaaaccuguauuuggcccaagucccauacacucuggagcaacgggguccuggaaucugagaugaucauuccgaaaaucuauggaggcccuauuagccagcacaauuaccgccccggguacuuuacccaaacagcgggaccuuggcaucugggcaagcucgagcuggauuucgaccuuugcgaagggaccacggugguuguggaugagcacugcggaaaccggggccccucccugagaaccacaaccgucacaggcaaaaucauccacgaaugguguugccggagcuguacccucccuccccugcgcuuuaagggggaggacggaugcugguauggcauggagauuagaccggugaaggaaaaagaggaaaaucugguuaagucuaugguguccgcugggagcggagaggucgacuccuucucucuuggccuccuguguaucagcauuaugaucgaagaggugaugcgguccagauggucucgcaaaaugcugaugacggggacacucgccgucuuuuuccugcuuauuaugggacagcugaccuggaacgaucucauccggcugugcauuauggugggcgccaaugcuagcgacagaaugggcauggggacaaccuaccuggcccuuauggcgaccuuuaagaugcgcccuauguucgcugucggacugcucuuuagacggcugacaucccgcgaggugcuccugcuuacgaucggccugucucucguggccagcgucgaacugcccaacucccuggaggaacuuggggauggacuggccaugggcaucaugauucucaaacugcucaccgacuuccagagccaucaacugugggcuacacuucugucucucaccuuuaucaagacaaccuucucccugcacuaugccuggaagacgauggcuaugguucugagcauugugucucuuuuuccccugugucucuccacaaccagccagaaaaccacauggcugccugugcuccuggggucucuuggaugcaagccgcugaccauguuccugaucgccgagaauaaaauuuggggcagaaaguccuggccccucaacgaaggcaucauggcggucgggaucgugagcauucugcuuuccgcccugcucaaaaacgauguuccucuggcuggaccccucaucgccggcgggaugcugauugcuuguuacgugaucagcggaucuagcgccgaccuuucccuggagaaggccgcugaggucucuugggaagaggaagcggagcauagcggcgccucccacaauauucugguggaaguucaggaugacgggacaaugaaaaucaaggaugaggagcgggacgauacgcucaccauccugcuuaaggcuacacugcucgccgugucuggagucuauccucugagcauucccgccacccucuucgugugguacuuuuggcagaaaaagaaacaacgcuccggcguccugugggacacaccuucucccccggaaguggagagagcuguucuugaugacggcaucuaucggauuaugcagcgcgggcugcugggaagaagccaggugggcgucgggguguuccaggaaaacguuuuucauaccauguggcacgugacgcggggagccguccucauguaccaaggcaagcgccuggagccuuccugggcgagcgugaaaaaggaccuuaucucuuacgggggaggcuggagacugcagggcuccuggaauaccggggaggaagugcagguuauugcugucgagcccggaaagaacccuaaaaaugugcagacagcccccggcaccuucaagacaagcgaaggggaggugggagccaucgcucucgauuuuaaaccgggcaccucuggguccccuauugucaaccgggaaggaaagaucgugggccuguauggcaaugggguugugacaacgagcggaaccuacgucuccgccaucgcgcaagcuaaagccucucaggagggcccccucccugagauugaagacgagguguucagaaagcgcaaccugacaaucauggaucuucaccccgggagcggaaagacccggagauaucugcccgccauuguucgcgaagcuaucaaacggaagcugagaacccucauucuggccccuacacgcguggucgcuuccgagauggccgaagcgcuuaaaggcaugccgauccgguaccagacgaccgccgugaaguccgagcauacagggaaagagaucguugaccugaugugccacgcuaccuuuacaaugagacuccugucucccgugcgcgucccuaauuauaacaugauuaucauggaugaagcccauuucaccgaccccuccagcauugcugcccggggcuacaucucuacgagagugggaaugggcgaggccgcugcgauuuuuaugacagccaccccucccgggagcguggaggcuuucccucaauccaaugccgucauccaggaugaagaacgggacaucccggagcgcucuuggaacagcggauaugaguggauuaccgauuuucccggcaagacaguuugguucgugccuuccaucaagucugggaaugacauugccaacugucugcgcaagaauggaaagcgggugauccagcucagccgcaaaaccuucgauacagaauaccagaagaccaaaaacaacgacugggacuacgucgugacgacagauauuuccgagaugggcgcuaauuuuagagccgaccggguuaucgaucccagacgcugccuuaagccugugauucugaaggacgggcccgaacgggucauccuggcgggcccgaugccugugaccguugcuagcgccgcccaaagacgcggacggaucggcagaaaccacaauaaagagggggaucaguauauuuacaugggacagccccucaacaaugacgaggaucaugcucacuggacagaagccaagaugcugcuugacaacaucaauacccccgagggcauuaucccugcgcuguucgaacccgagcgcgaaaaaucugccgcuauugauggggaguaucggcucagaggagaggcccgcaagacguuuguggaacugaugagacggggcgaccugccugucuggcucuccuacaaaguggcuagcgagggguuccaguauuccgaucgcagauggugcuuugacggcgaacggaacaaucaaguccuugaggaaaacauggauguggagaucuggaccaaggagggagaacgcaaaaagcugagaccgcgguggcuggacgccagaacauacucugacccccucgcucugcgcgaguucaaggaauuugccgcgggccggagaagcguuuccggggaucuuauccuggagauuggaaaacucccucagcaccugacccagcgcgcccagaaugcucuggacaaccucgugaugcuucauaauucugaacaaggcgggcgggccuauagacacgcuauggaggagcugcccgauacaaucgaaacccugaugcuccuggcccuuauugccgugcugacaggaggcgucacccucuucuuucugagcggccgggggcugggaaagacguccaucggccuccuuuguguuauggcuagcucugugcugcuguggauggcguccguggagccucauuggauugccgcuagcaucauccucgaguucuuucugaugguccuucugauucccgagccggaccgccagagaacaccucaggauaaccagcucgccuacgugguuaucgggcugcuguucaugauucucaccguggccgcuaaugagaugggacuucuggaaaccaccaagaaggaccugggcaucgggcacgucgccguggagaaccaccaucacgcggccaugcucgaugucgaccugcaucccgcuucugccuggacccuuuacgcuguggccacaacgauuaucaccccuaugaugcggcacacaauugaaaacaccacagcgaauaucucccugaccgccaucgcuaaccaagccgcuauucucaugggacuggauaaaggcuggcccaucagcaagauggacauuggcguuccucugcucgcccuugggugcuauucucaggugaauccccugacgcugaccgcugccguccucaugcugguggcgcauuacgccaucauuggaccgggccuucaggcuaaggccacacgcgaggcucagaagagaaccgccgccgggaucaugaagaacccuacaguugauggaaucguggcgauugaccuggaucccgucguguaugacgcuaaauuugaaaagcagcucggccagaucaugcugcugauucucuguaccagccagauccuucugaugcggacgacaugggcccugugcgaguccauuacccucgcuacagggccccugaccacccuuugggagggaucuccuggcaaauucuggaauacaacgaucgccgugagcauggccaacaucuuccgcggcuccuaccuggcuggggccggacucgcguuuagccugaugaagucccugggcgggggaagacggggcaccggggcccaaggagaaacacucggcgagaaguggaaacgccagcuuaaucagcugucuaagagcgaguucaacaccuauaaaagauccggcauuauggagguugaccggucugaagcuaaggaggggcugaaaagaggagagacaaccaagcacgccgucagccgcggcacggcuaagcuccggugguuuguggaaagaaaucuggugaaaccggaggggaaggucaucgaucuuggauguggccgcgggggaugguccuacuauugcgccggccugaaaaagguuacagaagugaaaggcuacaccaaagggggacccggccacgaggaaccuauucccauggcgaccuacggguggaaccucgugaaacugcauucuggaaaggacgucuucuuuaucccucccgagaagugugauacacugcucugcgacauuggcgagagcuccccuaauccgaccaucgaagaggggcggacacuuagagugcugaaaaugguugaacccuggcugcgcggaaaccaguucuguauuaagauccucaauccuuauaugcccagcguggucgagacgcuggagcaaaugcagcggaaacacggcggcaugcuugugagaaacccucugucucgcaauuccacccaugaaauguacuggguuagcugcgggacaggaaacaucgugucugccgucaauaugaccucccggaugcuccugaacagauuuacaauggcucaccgcaagcccaccuaugagcgggauguggaccugggcgccgggacgagacacguggcugucgaaccggagguugccaaccucgauauuaucggacagcgcauugaaaauaucaaacaugagcacaagagcaccuggcauuacgacgaggauaacccuuauaagacaugggcuuaccacggcucuuaugaagugaaacccuccgggagcgccuccagcauggugaauggagucgugaagcugcuuaccaaacccugggacguuauuccuauggugacacagaucgcgaugaccgauacaacccccuucggccaacagagagucuuuaaggagaaaguggacacgcggacaccuaaggccaagcgcggcaccgcucagaucauggaaguuaccgccaaauggcuguggggguuccucucuagaaacaagaaaccgcggauuuguacaagagaggaauuuacgcggaaggugcgcagcaaugcugccaucggagccgucuucguggacgagaaccaauggaacuccgcgaaagaggcuguugaagaugagagauuuugggaccuggugcaucgggaacgcgagcuucacaagcagggcaagugcgccacaugcgucuacaacaugauggggaaaagagaaaagaaacugggagaguucggcaaggccaaagggucucgggcuauuugguacauguggcucggcgcccgcuuccuggaguuugaagcucugggauucaugaaugaggaucacugguuuagcagagaaaacucccucucuggcguggagggggagggacugcauaaacuuggcuauauccugcgggacauuagcaaaauccccgggggaaauauguacgccgaugacacagcgggcugggauacccgcaucacagaagacgaucuccagaacgaggccaagauuaccgacaucauggaaccugagcacgcucugcuugccaaguccauuuucaaacugacauaucagaauaaggucgugagaguucaacggcccgcuaaaaacgggaccgugauggaugucaucucucgcagagaccagcggggcagcggacaggugggcacguacgggcucaauaccuuuacaaacauggaagcccagcugauucgccaaauggaguccgagggaaucuucagcccuucugaacuggagacccccaaccucgcgggcagagugcuggauuggcuugaaaagcaugggguugagcggcugaaaagaauggccaucuccggagacgacuguguggucaagccgauugaugaccgcuuugcuacagcccucaccgcucugaaugauaugggcaaggugcggaaagacaucccucagugggaacccagcaagggguggaacgauuggcagcagguuccuuucugcucucaccacuuucaucaacuuauuaugaaagacggcagagagaucgugguccccugucgcaaucaggaugagcuggugggacgggccagagucucccagggcgcuggguggagccuccgcgaaacggccugccugggaaaguccuaugcgcagauguggcaacugauguacuuccaccggagagaccuccgccuggccgcuaacgccauuuguucugccgugccuguugauugggugcccacaagccggaccacaugguccauccaugcucaccaucaguggaugaccacggaggacaugcuuagcgucuggaauagaguguggauugaagagaacccguggauggaagauaaaacccacaucucuuccuggggcgacguuccuuaucuggggaagcgcgaggaccaguggugcggaagccucaucggccugacagcccgggcgaccugggcuacaaauauucaaguggccaucaaccaggucagacggcuuauugggaaugagaacuaccuggauuacaugaccucuaugaagagauuuaaaaaugaaagcgaccccgagggcgcccucugguga

SEQ ID NO: 19121 - RNA, 9879 nt, Artificial Sequence
  derived and/or modified CDS sequence (opt5) from DENV-1__FJ898412__SS-prME
agcgugaccaugcugcucaugcugaugcccaccgcccuugcuuuccaccugacgacccggggcggggaaccucauaugaucgucaccaagcaggaacggggaaaaucccuccuguuuaagaccucugccggcguuaacaugugcacccuuauugccauggaccugggggaacucugugaagauaccaugacauacaaaugcccccgcaucaccgaggcugaacccgacgauguggacuguuggugcaaugccacggauaccugggugaccuauggaaccuguagccaaacaggcgagcaccggcgggacaagcgcuccguugcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguucacagugguugugggagaugucgugggcauucucgcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaagcugcgcgauuccuacacacagguuugcgaccaccggcuuaugagcgcggccauuaaagauucuaaggcugugcaugccgacaugggcuauuggaucgaauccgagaaaaaugaaaccuggaagcucgccagagcuagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgccggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuucaaaggggaggacggaugcugguacggcauggagauuagaccggugaaggaaaaggaggaaaaucuuguuaaaagcauggugucugcgggguccggagaggucgacagcuuuucccucggccugcuguguaucucuauuaugaucgaagaggugaugcggagcagauggucccgcaagaugcucaugacagggacccuggcuguuuuccuucugcucauuaugggacagcugacauggaacgaucugauccggcuuugcauuauggugggcgccaaugccucugacagaaugggcauggggaccaccuaucuggcucucauggccacauuuaaaaugcgcccuauguucgcggucggacugcucuuuagacggcugacgagccgcgaggugcuucugcucaccaucggccugucccugguggcuucugucgaacuucccaacagccuggaggaacucggggauggacuggccaugggcaucaugauucucaagcugcuuacagacuuccaaucccaccagcugugggccacccuccugagccugacauuuaucaaaaccacgcuuucucugcauuacgcuuggaagacaauggccaugguucucuccauugugagccuguucccccucugucugucuaccaccucccagaagacaaccuggcuuccugugcugcuggggagccucggaugcaaaccgcugacaauguuucuuaucgcugagaauaagauuuggggcagaaaaucuuggccccugaacgaaggcaucauggccgucggggugguuuccauccuccugagcucccuccugaagaacgaugugccucuugcgggaccccugauugccggcgggaugcugaucgcuuguuaugucauuagcggaucuagcgccgaccucucccuggagaaagcugccgaggugucuugggaagaggaagccgagcacagcggcgcuucccauaauauccuuguugaagugcaggaugacgggacgaugaagauuaaagaugaggagcgggacgauacccugacaauccuccugaaggcgacccuccuggccgucucuggaguguacccucuuagcauccccgcuacacuguucgucugguauuuuuggcaaaagaaaaagcagcgcuccggcgugcugugggacaccccuucucccccggaaguugagagagccgugcucgaugacggcauuuaccggaucaugcagcgcgggcugcuuggaagaagccaggucggcguggggguuuuccaagaaaacguguuccacacgauguggcacgucacccggggagccgugcugauguaucagggcaaacgccucgagccuuccugggcuagcgugaagaaagaccugauuucuuacgggggaggcuggagacuccagggcuccuggaauacaggggaggaaguucaggucaucgccguggagcccggaaagaacccuaagaaugugcaaaccgcgcccggcacauuuaaaaccccggaaggggaggucggagcuauugcccuggauuucaagccuggcacaagcgggucucccaucgugaaccgggaaggaaaaauuguuggccuuuacggcaaugggguggucacgaccuccggaacauaugugagcgccaucgcucaggccaaggcgucccaggagggcccucugcccgagaucgaagacgagguuuuuagaaaacgcaaccugaccauuauggaucuccaucccgggucuggaaagacccggagauaccugccugcuaucgugcgcgaagccauuaagcggaaacuuagaacacugauccucgccccgacgcgcgucguggcuagcgagauggccgaagcucugaagggcaugcccauucgguaucaaaccacagccguuaaauccgagcacaccgggaaggagaucguggaccugaugugccaugcgacauucaccaugagacuccuuagcccuguccgcgugcccaauuacaacaugaucauuauggaugaagcccacuuuacggacccuucuuccaucgcugcccggggcuauauuagcacaagagugggaaugggcgaggcugccgccaucuucaugaccgcuacacccccugggucugucgaagcguuuccgcagagcaaugccguuauucaggaugaggaacgggacauccccgagcgcuccuggaacucuggauacgaguggaucacagauuucccuggcaaaaccgugugguuugugcccagcauuaaguccgggaaugacaucgcuaacugucugagaaagaauggaaaacgggucauucagcugucucgcaagacauucgauaccgaauaucagaagacgaagaacaacgacugggacuacgugguuacaaccgauaucagcgagaugggcgccaauuuuagagccgaccgggugauugauccuagacgcugccucaaacccgucauccugaaggacgggccggaacgggugauucuugcuggcccuaugcccguuacaguggccuccgcggcucagagacgcggacggaucggcagaaaccauaauaaggagggggaucaguacaucuauaugggacagccccugaacaaugacgaggaucacgcccacuggaccgaagccaaaaugcuccuggacaacauuaauacgccugagggcaucauucccgcucuguucgaaccugagcgcgaaaagagcgccgcgaucgauggggaguaccggcucagaggagaggcccgcaaaaccuucgucgaacuuaugagacggggcgaccugccgguguggcugucuuauaaggucgcuuccgagggguuucaauacagcgaucgcagauggugcuucgacggcgaacggaacaaucaggugcucgaggaaaacauggauguugagauuuggacaaaagagggagaacgcaagaaacugagaccccgguggcuugacgccagaaccuauuccgacccucuggcucuccgcgaguuuaaggaguucgccgcuggccggagaucugugagcggggaucugauccuggagaucggaaagcucccccagcaucuuacacagcgcgcccaaaaugcgcuggacaaccuggugaugcuccacaauuccgaacagggcgggcgggccuacagacaugcuauggaggagcugccugauaccauugaaacacuuaugcugcucgcccugaucgcuguccugaccggaggcguuacgcucuuuuuccuuucuggccgggggcugggaaaaacaagcauuggccugcucugugugauggccuccagcgugcugcuuuggauggccucugucgagccccacuggaucgcugcguccauuauccuggaauuuuuccucauggugcugcugaucccggagccugaccgccagagaacaccccaggauaaccaacucgccuauguugugauugggcuucuguuuaugauccugaccgucgcugccaaugagaugggacuccuggaaacaaccaagaaagaccuuggcauugggcacguggccgucgagaaccaucaccaugugacaaugcuggauguugaccuccacccugcuagcgccuggacgcuguacgcgguggccaccacaaucauuacccccaugaugcggcauacaaucgaaaacaccacggcuaauauuucucugaccgccaucgcuaaccaggccgcgauccucaugggacuugauaagggcuggccuauuuccaaaauggacaucggcgucccccugcuggcccucgggugcuacagccaggugaauccgcugacacuuaccgcugccguucugaugcucguggcucacuaugccauuaucggaccuggccugcaagcuaaggccacacgcgaggcgcagaagagaaccgccgcugggauuaugaaaaaccccacggucgauggaaucguggccaucgaccuggaucccgugguuuacgacgcuaaguucgaaaaacagcucggccagauuaugcuucugauccuguguacaucucaaauucuccugaugcggaccacaugggcccuuugcgagagcaucacccuggccaccgggccucucacaacgcugugggagggauccccgggcaaguuuuggaauaccacaauugcggucucuauggcuaacaucuuccgcggcagcuaucuggccggggcuggacucgccuuuucccuuaugaaaagccugggcgggggaagacggggcaccggggcccagggagaaacacugggcgagaaguggaagcgccagcucaaucagcuguccaaaucugaguucaacaucuacaagagaagcggcauuauggagguggaccgguccgaagcuaaagaggggcuuaagagaggagagaccacgcgccacgccgugucucggggcacagcgaaacugagaugguucgucgaacgcaaucucguuaagcccgaggggaaggugaucgaucugggauguggcagagggggauggagcuauuacugcgccggccugaaaaaggugaccgaagucaaaggcuauaccaaagggggaccuggccaugaggaacccauuccuauggcuacauacggguggaaccucgugaaacuucacuccggaaaggacgucuuuuucacacccccugagaaaugugauacacugcugugcgacaucggcgagucuagcccgaaucccacgauugaagaggggagaacccuccgcgugcugaagauggucgaaccuuggcuucggggaaaccaauuuuguaucaagauucugaaucccuacaugccuuccgugguugagacacucgagcagaugcagagaaaacauggcggcaugcuggugcgcaacccccugagcagaaauucuacccacgaaauguauugggucuccugcgggacaggaaacaucgugagcgccgugaauaugaccucuagaaugcuccugaaccgcuucacgauggcucaccggaagccgaccuacgagagagaugucgaccuuggcgccgggacacgccauguugcgguggaaccugagguggccaaccuggauaucauuggacagagaaucgaaaauauuaaacacgagcauaaguccaccuggcacuaugacgaggauaaccccuacaaaacaugggcuuaucauggcagcuacgaagucaagcccucuggguccgccagcuccauggugaauggaguugugaagcuccugaccaaaccuugggacgucauccccauggugacacaaauugcuaugaccgauacgacaccuuuuggccagcagcggguuuucaaggagaaaguggacacccgcaccccgaaggccaaaagaggcacagcucaaaucauggaagucacggcccgguggcuuuggggguuucugagcagaaacaagaagccccggaucuguacccgcgaggaguucacaagaaaagugcggucuaaugcggccauuggagcuguuuuuguggacgagaaccaguggaauagcgccaaggaggcugucgaagaugagcgcuucugggaccucgugcagaaagaaagagagcugcacaagcagggcaaaugcgcgaccugcgucuauaacaugauggggaagcgggaaaagaaacugggagaguuuggcaaggccaaagggucccgcgcgaucugguacauguggcucggcgcuagauuccuggaguuugaagcccuuggauucaugaaugaggaucacugguucucucgggaaaacagccuguccggcguggagggggagggacuccauaagcugggcuacauucuucgcgacaucucuaaaauuccugggggaaauauguaugccgaugacacagcuggcugggauaccagaaucacagaagacgaucugcaaaacgaggccaagaucaccgacauuauggaacccgagcacgcucuccuggccacgagcaucuuuaaacugaccuaccagaauaagguugugcggguccagcgcccugcgaagaacgggacagugauggaugugauuuccagacgggaccagcgcggcucuggacaaguuggcaccuaugggcucaauacauucaccaacauggaagcccagcugaucagacagauggagagcgagggaauuuuucuucccuccgaacuggagacgccgaaccucgcugaacgggugcuggauuggcuugagaaauacggcgucgaaagacugaagcgcauggccaucagcggggacgacugugugguuaaaccuaucgaugaccgguucgcuacagcccucaccgcgcugaaugauaugggaaaggugagaaaagacauuccccagugggagccuucuaagggcuggaacgauuggcaacagguccccuuuugcucccaucacuuccaccagcugaucaugaaggacgggcgcgagauuguggucccuugucggaaucaggaugaacucgugggcagagcccgcguuagccaaggagcuggcuggucucugcgggagacagccugccuugggaaauccuaugcucagauguggcagcugauguacuuucauagacgcgaccuccggcuggccgcuaacgccaucuguagcgcggugcccgucgauugggugccgaccuccagaacgaccuggucuauucacgcccaucaccaauggaugacaaccgaagacaugcuuagcguuuggaaucgcguguggaucgaggaaaacccuuggauggaggauaagacacaugucuccagcuggggagacgugcccuaucugggcaaacgggaggaccaguggugcgggucucucauuggacugaccgcuagagccacaugggccuccaauauccagguggcuaucaaccagguucggagacugauuggcaaugaaaacuaccucgauuacaugaccagcaugaagcgcuucaaaaaugagggggaccccgaaggcgcccugugguga

SEQ ID NO: 19122 - RNA, 9879 nt, Artificial Sequence
  derived and/or modified CDS sequence (opt5) from DENV-1__GQ199852__SS-prME
agcgugaccaugcugcucaugcugaugcccacagcccuugcuuuccaccugacgaccagaggcggggagccucauaugaucgugacaaagcaggaacggggaaaaucccuccuguuuaagaccucugccggcguuaauaugugcacacuuauugcgauggaccugggggagcucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuuguuacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaggaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacguccagaauaccaccuuuaucaucgaugggccuaacacacccgaauguccugacgaucagagagcuuggaauauuugggagguugaggacuauggauucggcaucuuuaccacgaacauuuggcugaagcugcgcgauuccuacacacaggugugcgaccaccggcuuaugagcgcggccaucaaagauucuaaggcugugcaugccgacaugggcuauuggauugaauccgagaaaaaugaaaccuggaagcucgccagagcuagcuucaucgaggucaagacauguaucuggcccaaaucucacacccugugguccaacggggugcuggaaagcgagaugauuaucccgaagauuuacggaggcccuaucucucaacauaauuaucgccccggguacuucacacagaccgccggaccuuggcaccucggcaaacuggagcuugauuuugaccugugcgaagggacgaccguuguggucgaugagcacugcggaaaccggggccccagccucagaacaaccacagugaccggcaagauuauccaugaaugguguugccgguccuguacgcugccuccccugcgcuucaaaggggaggacggaugcugguacggcauggagaucagaccgguuaaggaaaaggaggaaaaucuugugaaaagcauggucucugcgggguccggagagguggacagcuuuucccucggccugcuguguauuucuaucaugauugaagagguuaugcggagcagauggucccgcaagaugcucacaaccgggacacuggcuguguuccuucugcucaucaugggacagcugaccuggaacgaucugauucggcuuugcaucauggucggcgccaaugccucugacagaaugggcauggggaccacauaucuggcucucauggccacguuuaaaaugcgcccuauguucgcggugggacugcucuuuagacggcugaccagccgcgaggugcuucugcucacaauuggccugucccuggucgcuucuguugaacuucccaacagccuggaggaacucggggauggacuggccaugggcaucaugauccucaagcugcuuaccgacuuccaaucccaccagcugugggccacacuccugagccugaccuuuauuaaaacgacacuuccccugcauugugcuuggaagaccauggccauggugcucucuaucgcuucccuguucccucucugccugagcaccacaucucagaagaccacauggcuuccggugcugcuggggucccucggauguaaaccccugacgauguuucuuauuaccgagacaaagaucuggggcagaaaaagcuggccucugaaugaaggcauuauggccgucggggugguuucuauccuccuguccagccuccugaagaacgaugugccccuugcgggaccucugaucgccggcgggaugcugauugcuugcuacgucaucuccggaagcucugccgaccucagccuggagaaagcugccgagguguccugggaagaggaagccgagcacucuggcgcuagccauaacauucuuguugugguccaggaugacgggaccaugaagaucaaagaugaggaacgggacgauacacugaccauucuccugaaggcgacgcuccuggccguguccggagucuauccccuuucuaucccugcuacccuguucgugugguacuuuuggcaaaagaaaaagcagcgcagcggcguucugugggacacacccuccccgccugagguggaaagagccguccucgaugacggcaucuaucggauuaugcagcgcgggcugcuuggaagaucucaggugggcguugggguguuccaagagaaugucuuccacaccauguggcacgugacacggggagccgugcugauguaccagggcaaacgccucgaacccagcugggcuuccguuaagaaagaccugaucagcuaugggggaggcuggagacuccagggcucuuggaacaccggggaggagguccaggugauugccguggaaccuggaaagaaucccaagaacguccaaacagcgccgggcacguuuaaaaccccugagggggaagugggagcuaucgcccuggauuucaagcccggcacauccgggagcccuauuguuaaucgggagggaaaaaucgugggccuuuacggcaacggggucgugaccaccucuggaacauacguuuccgccauugcucaggccaaggcgagccaggaaggcccccugcccgagaucgaggacgaaguguuuagaaaacgcaaucugacgaucauggaucuccauccuggguccggaaagacccggagauaucugccggcuauuguccgcgaggccaucaagcggaaacuuagaacacugauucucgcccccacccgcgugguugcuucugaaauggccgaggcucugaagggcaugccuauccgguaccaaacaaccgccgugaaaagcgaacacacggggaaggagauugucgaccugaugugucaugcgacauucaccaugagacuccuuucccccgugcgcgugccuaacuauaauaugaucaucauggaugaggcccacuuuaccgaccccagcucuauugcugcccggggcuacaucuccacaagagucggaaugggcgaagcugccgccauuuucaugaccgcuacaccuccggggagcguugaggcguuuccccagucuaacgccgugauccaggaugaggaacgggacauuccugaacgcagcuggaacuccggauaugaguggaucaccgauuuccccggcaaaacggugugguuugucccuucuaucaagagcgggaacgacauugcuaauugccugagaaagaacggaaaacgggugauccagcugucccgcaagacauucgauaccgaguaccagaagaccaagaauaacgacugggacuauguugugaccacggauauuucugaaaugggcgccaacuuuagagccgaccgggucaucgaucccagacgcugccucaaaccggugauucugaaggacgggccugagcggguuauccuugcuggccccaugcccgugaccgucgccagcgcggcucagagacgcggacggauuggcagaaaucauaacaaggaaggggaucaguacaucuacaugggacagccucugaauaacgacgaggaucacgcccacuggacagaggccaaaaugcuccuggacaauaucaacacccccgaaggcauuaucccugcucuguucgagccggaacgcgagaaguccgccgcgauugauggggaauaucggcucagaggagaggcccgcaaaacauucguggagcuuaugagacggggcgaccugcccgucuggcugagcuacaagguggcuucugaaggguuucaauauuccgaucgcagaugguguuucgacggcgagcggaauaaccagguucucgaagagaauauggauguggaaaucuggaccaaagagggagagcgcaagaaacugagaccucgguggcuugacgccagaacauacagcgacccccuggcucuccgcgaauuuaaggaguucgccgcuggccggagauccgugucuggggaucugauucuggaaaucggaaagcucccucagcaucuuacccagcgcgcccaaaacgcgcuggacaaucuggucaugcuccacaacagcgagcagggcgggcgggccuauagacaugcuauggaggaacugcccgauacgaucgagacacuuaugcugcucgcccugauugcuguucugaccggaggcgugacccucuuuuuccuuuccggccgggggcugggaaaaacaucuaucggccugcucugcgugauggccagcuccguccugcuuuggauggccagcguggaaccgcacuggauugcugcgucuaucauucuggaguuuuuccucaugguucugcugaucccugaacccgaccgccagagaaccccucaggauaaucaacucgccuacguggucaucgggcuucuguuuaugauucugacaguggcugccaacgagaugggacuccuggagacgaccaagaaagaccuuggcaucgggcacgucgccguggaaaaucaucaccaugcuacaaugcuggauguugaccuccaccccgccuccgcguggacccuguaugccguggcuacaaccauuaucacgccuaugaugcggcauaccauugagaacacaaccgccaacaucagccugacagcuauugccaaucaggcggccauccucaugggacuugauaagggcuggcccaucucuaaaauggacauuggcgucccgcugcuggcucucggguguuacucccaggugaacccucugacccuuacggccgcuguucugaugcucguggcccacuacgcuaucauuggacccggccugcaagccaaggcgacacgcgaagcccagaagagaaccgcugccgggaucaugaaaaaucccacagucgauggaauuguggcuaucgaccuggauccugugguuuaugacgccaaguucgagaaacagcucggccagaucaugcuucugauucugugcaccagccaaauccuccugaugcggaccacaugggcccuuugugaaucuauuacgcuggcgaccgggccgcucacaacccugugggagggaagccccggcaaguuuuggaacacaaccaucgcugucuccauggccaauauuuuccgcggcucuuaccuggcuggggccggacucgccuuuagccuuaugaaaucccugggcgggggaagacggggcacgggggcucagggagagacacugggcgaaaaguggaagcgccagcucaaccagcugagcaaauccgaguucaauaucuauaagagaucuggcaucauggaaguggaccggagcgaggccaaagaagggcuuaagagaggagagaccacccgccacgcggugucccggggcacagccaaacugagaugguucgucgagcgcaaccucguuaagccugaagggaaggugauugaucugggaugcggcagagggggauggucuuacuauugugcuggccugaaaaaggugaccgaggucaaaggcuacacaaaagggggacccggccaugaggagccuauccccauggccacguauggguggaaucucgugaaacuucacagcggaaaggacgucuuuuucaccccuccggaaaaaugcgauacacugcugugugacauuggcgaguccucucccaacccuaccaucgaggaagggagaacacuccgcgugcugaagauggucgagcccuggcuucggggaaaucaauuuugcauuaagauccugaacccuuacaugcccagcgugguugaaacccucgagcagaugcagagaaaacauggcggcaugcuggugcgcaauccgcugucccggaacagcacgcacgagauguacugggucucuugugggaccggaaauauuguguccgcugugaacaugacaagcagaaugcuccugaaucgcuucaccauggcccaccggaagccuacauaugaaagagaugucgaccuuggcgcggggacccgccauguugccguggagcccgaaguggcuaaccuggauaucaucggacagagaauugagaacaucaaacacgaacauaagucuacauggcacuacgacgaggauaaucccuauaaaaccugggccuaccauggcuccuaugaggucaagccuagcgggucugcuuccagcauggugaacggaguugugaagcuccugacgaaacccugggacgucauuccuauggugacacaaaucgccaugaccgauaccacaccguuuggccagcagcggguuuucaaggaaaaaguggacacgcgcacccccaaggcuaaaagaggcacagcccaaauuauggaggucaccgcgcgguggcuuuggggguuucuguccagaaauaagaagccucggaucugcacacgcgaagaguucaccagaaaagugcggagcaacgccgcuaucggagccguuuuuguggacgaaaaucaguggaacucugcuaaggaggccgucgaggaugaacgcuucugggaccucgugcagaaagagagagaacugcacaagcagggcaaaugcgccacaugugucuacaauaugauggggaagcgggagaagaaacugggagaauuuggcaaggcgaaagggagccgcgcuauuugguauauguggcucggcgccagauuccuggaguuugaggcccuuggauucaugaacgaagaucacugguucucccgggaaaauucucugagcggcguggaaggggagggacuccauaagcugggcuacauccuucgcgacauuuccaaaauccccgggggaaacauguacgcugaugacaccgccggcugggauacgagaauuaccgaggacgaucugcaaaaugaagcuaagaucacagacaucauggagccugaacacgcccuccuggcgaccucuauuuuuaaacugacauaucagaacaagguugugcggguccagcgccccgccaagaaugggaccgugauggaugugaucagcagacgggaccagcgcggcuccggacaaguuggcacguacgggcucaacacauucaccaauauggaggcucagcugauuagacagauggaaucugagggaaucuuucuuccgagcgagcuggaaacaccuaaccucgccgagcgggugcuggauuggcuugaaaaauauggcgucgagagacugaagcgcauggcuauuuccggggacgacugcgugguuaaacccaucgaugaccgguucgccaccgcgcucacggcccugaacgauaugggaaaggugagaaaagacaucccucagugggaacccagcaagggcuggaaugauuggcaacaggucccuuuuuguucucaucacuuccaccagcugauuaugaaggacgggcgcgagaucgugguccccugccggaaccaggaugagcucgugggcagagcucgcguuucccaaggagccggcuggagccugcgggaaaccgcuugucuugggaaaucuuacgcccagauguggcagcugauguauuuucauagacgcgaccuccggcuggcugccaaugcgauuugcuccgccgugccggucgauugggugccuacaagcagaaccacaugguccauccacgcucaucaccaauggaugaccacagaggacaugcuuucuguuuggaaccgcguguggauugaagagaaucccuggauggaagauaagacccaugucagcuccuggggagacgugcccuaccugggcaaacgggaggaccaguggugugggagccucaucggacugacggccagagccacaugggcuucuaacauucagguggccaucaaucagguucggagacugaucggcaacgagaauuaucucgauuacaugaccuccaugaagcgcuucaaaaacgaaggggacccugagggcgcgcugugguga

SEQ ID NO: 19123 - RNA, 9879 nt, Artificial Sequence
  derived and/or modified CDS sequence (opt5) from DENV-1__FJ898415__SS-prME
agcgugaccaugcugcucaugcugaugcccaccgcccuugcuuuccaccugacgaccagaggcggggaaccucauaugaucgucacaaagcaggaacggggaaagucccuucuguuuaagaccucugccggcguuaacaugugcacacuuauugcgauggaccugggggaacucugugaagauaccaugacauacaagugcccgcgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaagcagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaagcccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuuccugacccaagaugaaaaggggguuacacagaacggacggcuuaucacggcuaaucccauugugaccgacaaagagaagccugucaacaucgaagccgagccgcccuuuggcgaguccuauauugugaucggggccggagaaaaagcucucaagcugagcugguucaagaaaggcucuaauauugggaagauguuugaggccacagcuagaggcgcccgccggauggcgauccugggagauaccgccugggacuucggcagcaucgggggaguguuuacauccguuggcaaacucguccaucagauuuucgggaccgcuuacggagugcuguuuucuggcgugagcuggacgaugaagaucgggauuggcguccuucugaccuggcucggacugaacuccagaagcacaucucuguccaugaccuguaucgccgugggccuuguuacacucuaccugggggugaugguccaggcugauagcggaugcgugauuaauuggaaaggccgcgaacugaagugugggucuggaaucuucguuaccaacgaggugcacacauggaccgaacaauauaaguuucaggccgacuccccuaaacggcucagcgcggccauuggcaaggcuugggaggagggggucugcggcaucagauccgccacgcgccuggaaaacaucauguggaaacagauuucuaaugagcuuaaccauauccugcucgaaaaugacaugaaguucacagugguugugggagaugucgugggcauucuggcucaggggaaaaagaugauccggccgcaacccauggagcacaaauacagcuggaaguccuggggaaaggccaaaauuaucggcgccgacgugcagaacaccaccuuuaucauugaugggccuaauacacccgaauguccugacgaucagagagcuuggaacaucugggaggucgaggacuauggauucggcauuuuuaccacgaauaucuggcugaaacuucgcgauucuuacacacagguuugcgaccaccggcucaugagcgcggccauuaaagauuccaaggcugugcaugccgacaugggcuauuggaucgaaagcgagaaaaacgaaaccuggaagcuggccagagcuucuuucaucgaggugaagacauguauuuggcccaaaucccacacccuguggagcaaugggguccucgaaucugagaugaucauuccgaagaucuacggaggcccuauuucccaacauaacuaucgccccggguacuucacacagaccgccggaccuuggcaccugggcaaacuugagcuggauuuugaccucugcgaagggacgaccgugguuguggaugagcacugcggaaaucggggccccagccugagaacaaccacagucaccggcaagacgauccaugaaugguguugccggucuuguacacugccuccccuucgcuucaaaggggaggacggaugcugguacggcauggagaucagaccggugaaggaaaaggaggaaaaccucguuaaaagcaugguguccgcggggagcggagaggucgacucuuuuucccugggccugcucuguauuagcaucaugauugaagaggugaugcgguccagauggucucgcaagaugcugaugaccgggacacuugcuguuuuccugcuccugaucaugggacagcugaccuggaaugaucuuauucggcugugcaucauggugggcgccaacgccagcgacagaaugggcauggggaccacauaucucgcucugauggccacguuuaaaaugcgcccuauguucgcggucggacuccuguuuagacggcuuaccucccgcgaggugcugcuccugacaauuggccugucucuuguggcuagcgucgaacugcccaauucccucgaggaacugggggauggacucgccaugggcaucaugauccugaaacuucugaccgacuuccaaucucaccagcucugggccacacugcugagccuuaccuuuauuaaaacgacacugucccuccauuacgcuuggaagaccauggccaugguucugagcaucgugucucucuucccccugugucuuuccaccacaagccagaagaccacauggcugccugugcugcucgggucucugggaugcaaaccgcuuacgauguuucugauugcugagaacaagaucuggggcagaaaauccuggccccucaacgaaggcauuauggccgucggggugguuagcauccugcucucuucccugcuuaagaaugaugugccucuggcgggaccccugaucgccggcgggaugcucauugcuuguuaugucaucagcggauccagcgccgaccugucucuugagaaagcugccgaggugagcugggaagaggaagccgagcacuccggcgcuucucauaacauucugguugaagugcaggaugacgggaccaugaagaucaaagaugaggagcgggacgauacacucaccauucugcucaaggcgacacugcuugccgucagcggaguguacccucuguccauccccgcuacccuguucgucugguauuuuuggcaaaagaaaaagcagcgcucuggcgugcucugggacacgccuagcccucccgaaguugagagagccgugcuggaugacggcaucuaccggauuaugcagcgcgggcuucugggaagaucccaggucggcguggggguuuuccaagaaaauguguuccacaccauguggcacgucacacggggagccgugcucauguaucagggcaaacgccuggagcccucuugggcuagcgugaagaaagaccucaucuccuacgggggaggcuggagacugcagggcagcuggaacaccggggaggaaguucaggucauugccguggagcccggaaagaauccuaagaacgugcaaacagcgcccggcaccuuuaaaacaccggaaggggaggucggagcuaucgcccuugauuucaagccuggcacgucugggucccccauugugaaucgggaaggaaaaaucguuggccuguacggcaacgggguggucaccacaagcggaaccuaugugucugccauugcucaggccaaggcgucccaggagggcccucugcccgagaucgaagacgagguuuuuagaaaacgcaaucucaccaucauggaucugcaucccgggagcggaaagacacggagauaccuuccugcuauugugcgcgaagccaucaagcggaaacugagaacgcucauucuggccccgacccgcgucguggcuuccgagauggccgaagcucugaagggcaugcccauccgguaucaaacaaccgccguuaaaucugagcacacagggaaggagauuguggaccucaugugccaugcgaccuucacgaugagacuucugagcccuguccgcgugcccaacuacaauaugaucaucauggaugaagcccacuuuacagacccuuccagcauugcugcccggggcuauaucucuaccagagugggaaugggcgaggcugccgccauuuucaugaccgcuacacccccuggguccgucgaagcguuuccgcagagcaacgccguuauccaggaugaggaacgggacauucccgagcgcucuuggaauagcggauacgaguggaucaccgauuucccuggcaaaacagugugguuugugcccuccaucaagucugggaacgacauugcuaauugucugagaaagaacggaaaacgggucauccagcucagccgcaagaccuucgauacggaauaucagaagaccaagaacaaugacugggacuacgugguuaccacagauauuuccgagaugggcgccaacuuuagagccgaccgggugaucgauccuagacgcugccugaaacccgucauucuuaaggacgggccggaacgggugauccuggcuggcccuaugcccguuaccguggccucugcggcucagagacgcggacggauuggcagaaaucauaacaaggagggggaucaguacaucuauaugggacagccccucaauaacgacgaggaucacgcccacuggacggaagccaaaaugcugcuggacaauaucaacaccccugagggcauuauccccgcucucuucgaaccugagcgcgaaaagagcgccgcgauugauggggaguaccggcuuagaggagaggcccgcaaaacauucgucgaacugaugagacggggcgaccugccgguguggcucuccuauaaggucgcuagcgagggguuucaauacucugaucgcagauggugcuucgacggcgaacggaauaaccaggugcuggaggaaaauauggauguugagaucuggaccaaagagggagaacgcaagaaacuuagaccccgguggcuggacgccagaacauauuccgacccucucgcucugcgcgaguuuaaggaguucgccgcuggccggagaagcguguccggggaucugauucucgagaucggaaaacuuccccagcaucugacccagcgcgcccaaaacgcgcuggacaaucucgugaugcugcacaacucugaacagggcgggcgggccuacagacaugcuauggaggagcuuccugauacaaucgaaacccugaugcuccuggcccugauugcuguccucacgggaggcguuacacucuuuuuccugagcggccgggggcugggaaaaaccuccaucggccuccugugugugauggccucuagcgugcuucuguggauggccuccgucgagccccacuggauugcugcgagcaucauucucgaauuuuuccugauggugcugcucaucccggagccugaccgccagagaacaccccaggauaaucaacuugccuauguugugaucgggcugcuguuuaugauucucacagucgcugccaacgagaugggacugcuugaaaccacaaagaaagaccugggcaucgggcacguggccgucgagaaccaucaccaugcuacgaugcucgauguggaccugcacccugccucugcguggacccuguacgccguugcuacaaccauuaucacacccaugaugcggcauaccauugaaaauacgaccgccaacaucucccucacagcuauugccaaucaggcggccauccuuaugggacuggauaagggcuggccuaucagcaaaauggacauuggcgugccccugcucgcucuggggugcuacucucaggucaacccgcuuacccugacagccgcugugcucaugcugguugcccacuaugcuaucauuggaccuggccugcaagccaaggcgacccgcgaggcccagaagagaacggcugccgggaucaugaaaaaucccacaguggauggaauugucgcuaucgaccucgaucccgugguguacgacgccaaguucgaaaaacagcuuggccagaucaugcugcugauucucuguaccucccaaauccugcuuaugcggacaaccugggcccugugcgagagcauuacccucgcgacagggccucugacgacccugugggagggaucuccgggcaaguuuuggaacacaaccaucgcuguuagcauggccaauauuuuccgcggcuccuaucucgcuggggccggacuugccuuuucucugaugaaaagccugggcgggggaagacggggcacaggggcucagggagaaacccucggcgagaaguggaagcgccagcugaaccagcuuuccaaaagcgaguucaauaucuacaagagauccggcaucauggaggucgaccggucugaagccaaagaggggcugaagagaggagagacgacacgccacgcggugagccggggcaccgccaaacucagaugguucguggaacgcaaccuggucaagcccgaggggaagguuauugaucugggauguggcagagggggaugguccuauuacugcgcuggccucaaaaaggugaccgaagugaaaggcuauacaaaagggggaccuggccaugaggaacccaucccuauggccaccuacggguggaaucuugucaaacugcacucuggaaaggacguguuuuucacacccccugagaaaugugauacgcugcucugcgacauuggcgagagcuccccgaaccccaccaucgaagaggggagaacacugcgcguucuuaagaugguggaaccuuggcugcggggaaaucaauuuuguauuaagauccucaaccccuacaugccuucugucguggagacccuggagcagaugcagagaaaacauggcggcaugcugguucgcaauccccucagccggaacuccacacacgaaauguauugggugagcugcgggaccggaaauauugucucugcugugaacaugacguccagaaugcugcuuaaccgcuucaccauggcccaccggaagccgacauacgagagagauguggaccugggcgcggggacccgccaugucgccguugaaccugagguggcuaaucucgauaucaucggacagagaauugaaaacaucaaacacgagcauaagagcacauggcacuaugacgaggauaaucccuacaaaaccugggccuaucauggcucuuacgaagugaagcccuccgggagcgcuucuuccauggucaacggagugguuaagcugcuuacaaaaccuugggacgugauucccauggucacccaaaucgccaugacggauacaaccccuuuuggccagcagcggguguucaaggagaaaguugacacccgcacaccgaaggcuaaaagaggcacggcccaaauuauggaagugaccgcgcgguggcuguggggguuucucagcagaaauaagaagccccggaucuguacacgcgaggaguucaccagaaaaguccgguccaacgccgcuaucggagccguguuuguugacgagaaucaguggaacagcgcuaaggaggccguggaagaugagcgcuucugggaccugguccagaaagaaagagagcugcacaagcagggcaaaugcgccacaugcguguauaauaugauggggaagcgggaaaagaaacucggagaguuuggcaaggcgaaagggucucgcgcuauuugguacauguggcugggcgccagauuccuugaguuugaagcccugggauucaugaacgaggaucacugguucagccgggaaaauucccucucuggcgucgagggggagggacugcauaaacuuggcuacauccugcgcgacauuagcaaaaucccugggggaaacauguaugcugaugacaccgccggcugggauacaagaauuaccgaagacgaucuccaaaaugaggcuaagaucacggacaucauggaacccgagcacgcccugcuggcgaccuccauuuuuaaacucacauaccagaacaaggugguucgggugcagcgcccugccaagaaugggaccgucauggaugugaucucuagacgggaccagcgcggcagcggacaagugggcacauaugggcugaacaccuucacgaacauggaagcucagcuuauuagacagauggaguccgagggaaucuuuucucccagcgaacuggagauuccgaaucucgccgaacggguucuggauuggcuugagaaauacggcguggaaagacugaagcgcauggcuaucuccggggacgacugugucgugaaaccuaucgaugaccgguucgccacagcgcucaccgcccugaacgauaugggaaagguuagaaaagacgugccccagugggagccuagcaagggcuggaaugauuggcaacagguccccuuuugcucucaucacuuccaccagcugauuaugaaggacgggcgcgagaucguggucccuugucggaaccaggaugaacucgugggcagagcucgcguuucccaaggagccggcuggagccugcgggagacagcuugccuugggaaaucuuaugcccagauguggcagcugauguacuuucauagacgcgaccuccggcuggcugccaaugcgauuuguuccgccgugcccgucgauugggugccgaccagcagaacgaccugguccauccacgcucaucaccaauggaugacaaccgaagacaugcuuucuguuuggaaccgcguguggauugaggaaaauccuuggauggaggauaagacacaugucagcuccuggggagacgugcccuaucugggcaaacgggaggaccaguggugcgggagccucaucggacugaccgccagagccacaugggcuucuaacauucagguggccaucaaucagguucggagacugaucggcaacgaaaauuaccucgauuacaugaccuccaugaagcgcuucaaaaacgagggggaccccgaaggcgcgcugugguga

SEQ ID NO: 19124 - RNA, 9879 nt, Artificial Sequence
  derived and/or modified CDS sequence (opt5) from DENV-1__FJ898416__SS-prME
agcgugaccaugcugcucaugcugaugcccaccgcccuugcuuuccaccugacgaccagaggcggggagccucauaugaucgugacaaagcaggaacggggaaaaucccuccuguuuaagaccucugccggcguuaauaugugcacccuuauugcgauggaccugggggagcucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuuguuacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaggaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacguccagaauaccaccuuuaucaucgaugggccuaacacacccgaauguccugacgaucagagagcuuggaauauuugggagguugaggacuauggauucggcaucuuuaccacgaacauuuggcugaagcugcgcgauuccuacacacaggugugcgaccaccggcuuaugagcgcggccaucaaagauucuaaggcugugcaugccgacaugggcuauuggauugaauccgagaaaaaugaaaccuggaagcucgccagagcuagcuucaucgaggucaagacauguaucuggcccaaaucucacacccugugguccaacggggugcuggaaagcgagaugauuaucccgaagauuuacggaggcccuaucucucaacauaauuaucgccccggguacuucacacagaccgccggaccuuggcaccucggcaaacuggagcuugauuuugaccugugcgaagggacgaccguuguggucgaugagcacugcggaaaccggggccccagccucagaacaaccacagugaccggcaagauuauccaugaaugguguugccgguccuguacgcugccuccccugcgcuucaaaggggaggacggaugcugguacggcauggagaucagaccgguuaaggaaaaggaggaaaaucuugugaaaagcauggucucugcgggguccggagagguggacagcuuuucccucggccugcuguguauuucuaucaugauugaagagguuaugcggagcagauggucccgcaagaugcucaugacagggacccuggcuguguuccuucugcucaucaugggacagcugacauggaacgaucugauucggcuuugcaucauggucggcgccaaugccucugacagaaugggcauggggaccaccuaucuggcucucauggccacauuuaaaaugcgcccuauguucgcggugggacugcucuuuagacggcugacgagccgcgaggugcuucugcucaccauuggccugucccuggucgcuucuguugaacuucccaacagccuggaggaacucggggauggacuggccaugggcaucaugauccucaagcugcuuacagacuuccaaucccaccagcugugggccacccuccugagccugacauuuauuaaaaccacgcuuucucugcauuacgcuuggaagacaauggccauggugcucuccaucgcuagccuguucccccucugucugucuaccaccucccagaagacaaccuggcuuccugugcugcuggggagccucggaugcaaaccgcugacaauguuucuuauuacggagaccaagaucuggggcagaaaaucuuggccccugaaugaaggcauuauggccgucggggugguuuccauccuccugagcucccuccugaagaacgaugugccucuugcgggaccccugaucgccggcgggaugcugauugcuuguuaugucaucagcggaucuagcgccgaccucucccuggagaaagcugccgaggugucuugggaagaggaagccgagcacagcggcgcuucccauaacauucuuguugugguccaggaugacgggacaaugaagaucaaagaugaggaacgggacgauacccugacaauucuccugaaggcgacccuccuggccgugucuggagucuacccucuuagcauccccgcuacgcuguucgugugguauuuuuggcaaaagaaaaagcagcgcuccggcguucugugggacaccccuucucccccggagguggaaagagccguccucgaugacggcaucuaccggauuaugcagcgcgggcugcuuggaagaagccaggugggcguugggguguuccaagagaaugucuuccacacaauguggcacgugacccggggagccgugcugauguaucagggcaaacgccucgaaccuuccugggcuagcguuaagaaagaccugaucucuuacgggggaggcuggagacuccagggcuccuggaacacaggggaggagguccaggugauugccguggaacccggaaagaauccuaagaacguccaaaccgcgcccggcacauuuaaaacgccggagggggaagugggagcuaucgcccuggauuucaagccuggcaccagcgggucucccauuguuaaucgggagggaaaaaucgugggccuuuacggcaacggggucgugacaaccuccggaaccuauguuagcgccauugcucaggccaagacaucccaggaaggcccucugcccgagaucgaggacgaaguguuuagaaaacgcaaucugacgaucauggaucuccaucccgggucuggaaagacccggagauaccugccugcgauuguccgcgaggcuaucaagcggaaacuuagaacacugauucucgccccgacccgcgugguugccagcgaaauggcugaggcccugaagggcaugcccauccgguaucaaacaaccgcugugaaauccgaacacacggggaaggagauugucgaccugaugugccaugccacauucaccaugagacuccuuagcccugugcgcgugcccaacuacaauaugaucaucauggaugaggcgcacuuuaccgacccuucuuccauugccgcucggggcuauaucagcacaagagucggaaugggcgaagccgcugccauuuucaugaccgccacacccccugggucuguugaggcuuuuccgcagagcaacgcggugauccaggaugaggaacgggacauucccgaacgcuccuggaacucuggauacgaguggaucaccgauuucccuggcaaaacggugugguuuguccccagcaucaaguccgggaacgacauugccaauugucugagaaagaacggaaaacgggugauccagcugucucgcaagacauucgauaccgaguaucagaagaccaagaauaacgacugggacuacguugugaccacggauauuagcgaaaugggcgcuaacuuuagagccgaccgggucaucgauccuagacgcugccucaaacccgugauucugaaggacgggccggagcggguuauccuugccggcccuaugcccgugaccgucgcuuccgccgcgcagagacgcggacggauuggcagaaaucauaacaaggaaggggaucaguacaucuauaugggacagccccugaauaacgacgaggaucacgcucacuggacagaggccaaaaugcuccuggacaauaucaacaccccugaaggcauuauccccgcccuguucgagccugaacgcgaaaagagcgcugccauugauggggaauaccggcucagaggagaggcgcgcaaaacauucguggagcuuaugagacggggcgaccugccggucuggcugucuuauaagguggccuccgaaggguuucaauacagcgaucgcagauggugcuucgacggcgagcggaauaaccagguucucgaagagaauauggauguggaaaucuggaccaaagagggagagcgcaagaaacugagaccccgguggcuugacgcuagaacauauuccgacccucuggcccuccgcgaauuuaaggaguucgcugccggccggagaucugugagcggggaucugauucuggaaaucggaaagcucccccagcaucuuacccagcgcgcucaaaacgcccuggacaaucuggucaugcuccacaacuccgagcagggcgggcgggcguacagacaugccauggaggaacugccugauacgaucgagacacuuaugcugcucgcucugauugccguucugaccggaggcgugacccucuuuuuccuuucuggccgggggcugggaaaaacaagcaucggccugcucugugugauggcuuccagcguccugcuuuggauggccucuguggaaccccacuggauugccgcuuccaucauucuggaguuuuuccucaugguucugcugaucccggaaccugaccgccagagaacaccccaggauaaucaacucgcguauguggucaucgggcuucuguuuaugauucugacaguggccgcuaacgagaugggacuccuggagacgaccaagaaagaccuuggcaucgggcacgucgccguggaaaaucaucaccaugccacaaugcuggauguugaccuccacccugcuagcgccuggacccuguacgcgguggccacaaccauuaucacgcccaugaugcggcauaccauugagaacacaaccgcuaacaucucucugacagccauugcuaaucaggccgcgauccucaugggacuugauaagggcuggccuaucuccaaaauggacauuggcgucccccugcuggcccucgggugcuacagccaggugaacccgcugacccuuacggcugccguucugaugcucguggcucacuaugccaucauuggaccuggccugcaagcuaaggccacacgcgaagcgcagaagagaaccgccgcugggaucaugaaaaaucccacagucgauggaauuguggccaucgaccuggaucccgugguuuacgacgcuaaguucgagaaacagcucggccagaucaugcuucugauucuguguaccucucaaauccuccugaugcggaccacaugggcccuuugcgaaagcauuacgcuggccaccgggccucucacaacccugugggagggauccccgggcaaguuuuggaacacaaccaucgcggucucuauggcuaauauuuuccgcggcagcuaucuggccggggcuggacucgccuuuucccuuaugaaaagccugggcgggggaagacggggcacgggggcccagggagagacacugggcgaaaaguggaagcgccagcucaaccagcuguccaaaucugaguucaauaucuacaagagaagcggcaucauggaaguggaccgguccgaggcuaaagaagggcuuaagagaggagagaccacccgccacgccgugucucggggcacagcgaaacugagaugguucgucgagcgcaaccucguuaagcccgaagggaaggugauugaucugggauguggcagagggggauggagcuauuacugcgccggccugaaaaaggugaccgaggucaaaggcuauacaaaagggggaccuggccaugaggagcccaucccuauggcuacguacggguggaaucucgugaaacuucacuccggaaaggacgucuuuuucacacccccugaaaaaugugauacacugcugugcgacauuggcgagucuagcccgaaccccaccaucgaggaagggagaacacuccgcgugcugaagauggucgagccuuggcuucggggaaaucaauuuuguauuaagauccugaaccccuacaugccuuccgugguugaaacccucgagcagaugcagagaaaacauggcggcaugcuggugcgcaauccccugagccggaacucuacgcacgagauguauugggucuccugcgggaccggaaauauugugagcgccgugaacaugacaucuagaaugcuccugaaucgcuucaccauggcucaccggaagccgacauacgaaagagaugucgaccuuggcgccgggacccgccauguugcgguggagccugaaguggccaaccuggauaucaucggacagagaauugagaacaucaaacacgaacauaaguccacauggcacuaugacgaggauaaucccuacaaaaccugggcuuaucauggcagcuacgaggucaagcccucuggguccgccagcuccauggugaacggaguugugaagcuccugacgaaaccuugggacgucauucccauggugacacaaaucgcuaugaccgauaccacaccuuuuggccagcagcggguuuucaaggaaaaaguggacacgcgcaccccgaaggccaaaagaggcacagcucaaauuauggaggucaccgcccgguggcuuuggggguuucugagcagaaauaagaagccccggaucuguacacgcgaagaguucaccagaaaagugcggucuaacgcggccaucggagcuguuuuuguggacgaaaaucaguggaacagcgccaaggaggcugucgaggaugaacgcuucugggaccucgugcagaaagagagagaacugcacaagcagggcaaaugcgccacaugcgucuauaauaugauggggaagcgggagaagaaacugggagaauuuggcaaggccaaagggucccgcgcgauuugguacauguggcucggcgcuagauuccuggaguuugaggcccuuggauucaugaacgaagaucacugguucucucgggagaauagccuguccggcguggaaggggagggacuccauaagcugggcuacauccuucgcgacauuucuaaaaucccugggggaaacauguaugccgaugacaccgcuggcugggauacgagaauuaccgaggacgaucugcaaaaugaagccaagaucacagacaucauggagcccgaacacgcucuccuggccaccagcauuuuuaaacugacauaccagaacaagguugugcggguccagcgcccugcgaagaaugggaccgugauggaugugaucuccagacgggaccagcgcggcucuggacaaguuggcacguaugggcucaacacauucaccaauauggaggcccagcugauuagacagauggaaagcgagggaaucuuucuucccuccgagcuggaaacaccgaaccucgcugagcgggugcuggauuggcuugaaaaauacggcgucgagagacugaagcgcauggccauuagcggggacgacugugugguuaaaccuaucgaugaccgguucgcuaccgcccucacggcgcugaacgauaugggaaaggugagaaaagacaucccccagugggaaccuucuaagggcuggaaugauuggcaacagguccccuuuugcucccaucacuuccaccagcugauuaugaaggacgggcgcgagaucguggucccuugucggaaccaggaugagcucgugggcagagcccgcguuagccaaggagcuggcuggucucugcgggaaaccgccugccuugggaaauccuaugcucagauguggcagcugauguacuuucauagacgcgaccuccggcuggccgcuaaugccauuuguagcgcggugcccgucgauugggugccgacauccagaaccacauggucuauccacgcccaucaccaauggaugaccacagaggacaugcuuagcguuuggaaccgcguguggauugaagagaauccuuggauggaagauaagacccaugucuccagcuggggagacgugcccuaucugggcaaacgggaggaccaguggugcgggucucucaucggacugacggcuagagccacaugggccuccaacauucagguggcuaucaaucagguucggagacugaucggcaacgagaauuaccucgauuacaugaccagcaugaagcgcuucaaaaacgaaggggaccccgagggcguccugugguga

SEQ ID NO: 19125 - RNA, 9879 nt, Artificial Sequence
  derived and/or modified CDS sequence (opt5) from DENV-1__FJ898417__SS-prME
agcgugaccaugcugcugaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacagaacaguauaaauuccaagccgacucuccuaagcggcugagcgcggccauuggcaaggcuugggaggagggggugugcggcaucagauccgccacccgccuggaaaacaucauguggaagcagauuucuaacgagcucaaucauauccugcuugaaaacgacaugaaauuuacgguuguggucggagauguggcuggcauucuggcccaggggaagaaaaugauccggccgcagcccauggaguacaaguauagcuggaaguccuggggaaaagccaagauuaucggcgcugacgugcaaaauacaaccuucaucauugaugggccuaacacccccgaauguccugacgaucagagagcguggaauaucugggaggucgaggacuacggauuuggcauuuucacaaccaacaucuggcucaaacugcgcgauagcuauacgcagguuugcgaccaccggcugaugucugccgcuauuaaggauuccaaagccgugcacgccgacaugggcuacuggaucgaaagcgagaagaaugaaacauggaaacuugcuagagccucuuucaucgaggugaaaaccuguauuuggcccaagucccauacacucuggagcaacgggguccuggaaucugagaugaucauuccgaaaaucuauggaggcccuauuagccagcacaauuaccgccccggguacuuuacccaaacagcgggaccuuggcaucugggcaagcucgagcuggauuucgaccuuugcgaagggaccacggugguuguggaugagcacugcggaaaccggggccccucccugagaaccacaaccgucacaggcaaaaucauccacgaaugguguugccggagcuguacccucccuccccugcgcuuuaagggggaggacggaugcugguauggcauggagauuagaccggugaaggaaaaagaggaaaaucugguuaagucuaugguguccgcugggagcggagaggucgacuccuucucucuuggccuccuguguaucagcauuaugaucgaagaggugaugcgguccagauggucucgcaaaaugcugaugacggggacacucgccgucuuuuuccugcuuauuaugggacagcugaccuggaacgaucucauccggcugugcauuauggugggcgccaaugcuagcgacagaaugggcauggggacaaccuaccuggcccuuauggcgaccuuuaagaugcgcccuauguucgcugucggacugcucuuuagacggcugacaucccgcgaggugcuccugcuuacgaucggccugucucucguggccagcgucgaacugcccaacucccuggaggaacuuggggauggacuggccaugggcaucaugauucucaaacugcucaccgacuuccagagccaucaacugugggcuacacuucugucucucaccuuuaucaagacaaccuucucccugcacuaugccuggaagacgauggcuaugguucugagcauugugucucuuuuuccccugugucucuccacaaccagccagaaaaccacauggcugccugugcuccuggggucucuuggaugcaagccgcugaccauguuccugaucgccgagaauaaaauuuggggcagaaaguccuggccccucaacgaaggcaucauggcggucgggaucgugagcauucugcuuuccgcccugcucaaaaacgauguuccucuggcuggaccccucaucgccggcgggaugcugauugcuuguuacgugaucagcggaucuagcgccgaccuuucccuggagaaggccgcugaggucucuugggaagaggaagcggagcauagcggcgccucccacaauauucugguggaaguucaggaugacgggacaaugaaaaucaaggaugaggagcgggacgauacgcucaccauccugcuuaaggcuacacugcucgccgugucuggagucuauccucugagcauucccgccacccucuucgugugguacuuuuggcagaaaaagaaacaacgcuccggcguccugugggacacaccuucucccccggaaguggagagagcuguucuugaugacggcaucuaucggauuaugcagcgcgggcugcugggaagaagccaggugggcgucgggguguuccaggaaaacguuuuucauaccauguggcacgugacgcggggagccguccucauguaccaaggcaagcgccuggagccuuccugggcgagcgugaaaaaggaccuuaucucuuacgggggaggcuggagacugcagggcuccuggaauaccggggaggaagugcagguuauugcugucgagcccggaaagaacccuaaaaaugugcagacagcccccggcaccuucaagacaagcgaaggggaggugggagccaucgcucucgauuuuaaaccgggcaccucuggguccccuauugucaaccgggaaggaaagaucgugggccuguauggcaaugggguugugacaacgagcggaaccuacgucuccgccaucgcgcaagcuaaagccucucaggagggcccccucccugagauugaagacgagguguucagaaagcgcaaccugacaaucauggaucuucaccccgggagcggaaagacccggagauaucugcccgccauuguucgcgaagcuaucaaacggaagcugagaacccucauucuggccccuacacgcguggucgcuuccgagauggccgaagcgcuuaaaggcaugccgauccgguaccagacgaccgccgugaaguccgagcauacagggaaagagaucguugaccugaugugccacgcuaccuuuacaaugagacuccugucucccgugcgcgucccuaauuauaacaugauuaucauggaugaagcccauuucaccgaccccuccagcauugcugcccggggcuacaucucuacgagagugggaaugggcgaggccgcugcgauuuuuaugacagccaccccucccgggagcguggaggcuuucccucaauccaaugccgucauccaggaugaagaacgggacaucccggagcgcucuuggaacagcggauaugaguggauuaccgauuuucccggcaagacaguuugguucgugccuuccaucaagucugggaaugacauugccaacugucugcgcaagaauggaaagcgggugauccagcucagccgcaaaaccuucgauacagaauaccagaagaccaaaaacaacgacugggacuacgucgugacgacagauauuuccgagaugggcgcuaauuuuagagccgaccggguuaucgaucccagacgcugccuuaagccugugauucugaaggacgggcccgaacgggucauccuggcgggcccgaugccugugaccguugcuagcgccgcccaaagacgcggacggaucggcagaaaccacaauaaagagggggaucaguauauuuacaugggacagccccucaacaaugacgaggaucaugcucacuggacagaagccaagaugcugcuugacaacaucaauacccccgagggcauuaucccugcgcuguucgaacccgagcgcgaaaaaucugccgcuauugauggggaguaucggcucagaggagaggcccgcaagacguuuguggaacugaugagacggggcgaccugccugucuggcucuccuacaaaguggcuagcgagggguuccaguauuccgaucgcagauggugcuuugacggcgaacggaacaaucaaguccuugaggaaaacauggauguggagaucuggaccaaggagggagaacgcaaaaagcugagaccgcgguggcuggacgccagaacauacucugacccccucgcucugcgcgaguucaaggaauuugccgcgggccggagaagcguuuccggggaucuuauccuggagauuggaaaacucccucagcaccugacccagcgcgcccagaaugcucuggacaaccucgugaugcuucauaauucugaacaaggcgggcgggccuauagacacgcuauggaggagcugcccgauacaaucgaaacccugaugcuccuggcccuuauugccgugcugacaggaggcgucacccucuucuuucugagcggccgggggcugggaaagacguccaucggccuccuuuguguuauggcuagcucugugcugcuguggauggcguccguggagccucauuggauugccgcuagcaucauccucgaguucuuucugaugguccuucugauucccgagccggaccgccagagaacaccucaggauaaccagcucgccuacgugguuaucgggcugcuguucaugauucucaccguggccgcuaaugagaugggacuucuggaaaccaccaagaaggaccugggcaucgggcacgucgccguggagaaccaccaucacgcggccaugcucgaugucgaccugcaucccgcuucugccuggacccuuuacgcuguggccacaacgauuaucaccccuaugaugcggcacacaauugaaaacaccacagcgaauaucucccugaccgccaucgcuaaccaagccgcuauucucaugggacuggauaaaggcuggcccaucagcaagauggacauuggcguuccucugcucgcccuugggugcuauucucaggugaauccccugacgcugaccgcugccguccucaugcugguggcgcauuacgccaucauuggaccgggccuucaggcuaaggccacacgcgaggcucagaagagaaccgccgccgggaucaugaagaacccuacaguugauggaaucguggcgauugaccuggaucccgucguguaugacgcuaaauuugaaaagcagcucggccagaucaugcugcugauucucuguaccagccagauccuucugaugcggacgacaugggcccugugcgaguccauuacccucgcuacagggccccugaccacccuuugggagggaucuccuggcaaauucuggaauacaacgaucgccgugagcauggccaacaucuuccgcggcuccuaccuggcuggggccggacucgcguuuagccugaugaagucccugggcgggggaagacggggcaccggggcccaaggagaaacacucggcgagaaguggaaacgccagcuuaaucagcugucuaagagcgaguucaacaccuauaaaagauccggcauuauggagguugaccggucugaagcuaaggaggggcugaaaagaggagagacaaccaagcacgccgucagccgcggcacggcuaagcuccggugguuuguggaaagaaaucuggugaaaccggaggggaaggucaucgaucuuggauguggccgcgggggaugguccuacuauugcgccggccugaaaaagguuacagaagugaaaggcuacaccaaagggggacccggccacgaggaaccuauucccauggcgaccuacggguggaaccucgugaaacugcauucuggaaaggacgucuucuuuaucccucccgagaagugugauacacugcucugcgacauuggcgagagcuccccuaauccgaccaucgaagaggggcggacacuuagagugcugaaaaugguugaacccuggcugcgcggaaaccaguucuguauuaagauccucaauccuuauaugcccagcguggucgagacgcuggagcaaaugcagcggaaacacggcggcaugcuugugagaaacccucugucucgcaauuccacccaugaaauguacuggguuagcugcgggacaggaaacaucgugucugccgucaauaugaccucccggaugcuccugaacagauuuacaauggcucaccgcaagcccaccuaugagcgggauguggaccugggcgccgggacgagacacguggcugucgaaccggagguugccaaccucgauauuaucggacagcgcauugaaaauaucaaacaugagcacaagagcaccuggcauuacgacgaggauaacccuuauaagacaugggcuuaccacggcucuuaugaagugaaacccuccgggagcgccuccagcauggugaauggagucgugaagcugcuuaccaaacccugggacguuauuccuauggugacacagaucgcgaugaccgauacaacccccuucggccaacagagagucuuuaaggagaaaguggacacgcggacaccuaaggccaagcgcggcaccgcucagaucauggaaguuaccgccaaauggcuguggggguuccucucuagaaacaagaaaccgcggauuuguacaagagaggaauuuacgcggaaggugcgcagcaaugcugccaucggagccgucuucguggacgagaaccaauggaacuccgcgaaagaggcuguugaagaugagagauuuugggaccuggugcaucgggaacgcgagcuucacaagcagggcaagugcgccacaugcgucuacaacaugauggggaaaagagaaaagaaacugggagaguucggcaaggccaaagggucucgggcuauuugguacauguggcucggcgcccgcuuccuggaguuugaagcucugggauucaugaaugaggaucacugguuuagcagagaaaacucccucucuggcguggagggggagggacugcauaaacuuggcuauauccugcgggacauuagcaaaauccccgggggaaauauguacgccgaugacacagcgggcugggauacccgcaucacagaagacgaucuccagaacgaggccaagauuaccgacaucauggaaccugagcacgcucugcuugccaaguccauuuucaaacugacauaucagaauaaggucgugagaguucaacggcccgcuaaaaacgggaccgugauggaugucaucucucgcagagaccagcggggcagcggacaggugggcacguacgggcucaauaccuuuacaaacauggaagcccagcugauucgccaaauggaguccgagggaaucuucagcccuucugaacuggagacccccaaccucgcgggcagagugcuggauuggcuugaaaagcaugggguugagcggcugaaaagaauggccaucuccggagacgacuguguggucaagccgauugaugaccgcuuugcuacagcccucaccgcucugaaugauaugggcaaggugcggaaagacaucccucagugggaacccagcaagggguggaacgauuggcagcagguuccuuucugcucucaccacuuucaucaacuuauuaugaaagacggcagagagaucgugguccccugucgcaaucaggaugagcuggugggacgggccagagucucccagggcgcuggguggagccuccgcgaaacggccugccugggaaaguccuaugcgcagauguggcaacugauguacuuccaccggagagaccuccgccuggccgcuaacgccauuuguucugccgauccuguggacuggguucccacaagccggaccacaugguccauccaugcucaccaucaguggaugaccacggaggauaugcuuagcguguggaauagagucuggauugaagagaacccguggauggaagacaaaacccacaucucuuccuggggcgacgugccuuaucuggggaagcgcgaggaucaguggugcggaagccucaucggccugacagcccgggcgaccugggcuacaaauauucaaguugccaucaaccaggugagacggcuuauugggaaugagaacuaccuggacuacaugaccucuaugaagagauuuaaaaaugaaagcgaucccgagggcgcccucugguga

SEQ ID NO: 19126 - RNA, 9879 nt, Artificial Sequence
  derived and/or modified CDS sequence (opt5) from DENV-1__GQ868612__SS-prME
agcgugaccaugcugcugaugcugaugcccaccgcccuugcuuuccaccugacgaccagaggaggggaaccucauaugaucgucuccaagcaggaacggggaaagucucuccuguuuaagaccagcgccggcguuaacaugugcacccuuauugcgauggaccugggggaacucugugaagauacaaugaccuacaaaugcccccgcaucacagaagcugaacccgacgauguggacuguuggugcaaugccaccgauacgugggugaccuauggaacauguucccaaaccggcgaacacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggcuaugguccaggccgauuccggaugcgugauuaacuggaaaggccgcgaacugaagugugggagcggaaucuucguuaccaaugaggugcacacauggaccgaacaauauaaguuucaggcggacuccccuaaacggcugucugccgcuauuggcaaggccugggaggagggggucugcggcaucagaagcgcuacgcgccucgaaaacaucauguggaaacagauuuccaacgagcugaaucauauccuucuggaaaacgacaugaagcucacagugguugugggagaugucgccggcauucuggggcagggcaagaagaugauccggccgcaacccauggaguacaaauauucuuggaaaagcuggggcaaggccaagauuaucggggcugacgcgcagaauaccaccuucaucauugauggaccuaacacacccgaauguccugacgaucagagagccuggaauaucugggagguggaggacuacggcuuuggcauuuucaccacgaacaucuggcugaaacuucgcgauuccuauacacaggugugcgaccaccggcucaugagcgcugccauuaaagauucuaaggccguccacgcugacaugggguacuggaucgaauccgagaaaaaugaaaccuggaagcuggccagagcgagccugaucgagguuaagacauguauuuggcccaaaucucauacccucugguccaacggagugcuggaaagcgagaugaucauuccgaagaucuauggcgggccuauuucucaacacaauuaccgccccggauacuuuacacagaccgcuggcccuuggcaucuugggaaacuggagcucgauuucgaccugugcgaaggaacgaccguggucguggaugagcacugcggcaaccggggccccagccugagaacaaccacaguuaccgggaagaucauccacgaaugguguugccgguccuguacgcuuccuccccuccgcuucagaggagaggacggcugcugguaugggauggagauucggccggugaaagaaaaggaggaaaaucuggucaagagcauggugucugccggauccggcgagguugacagcuuuucccuggggcuccuguguaucucuauuaugaucgaagaggugaugagaagccgcuggucccggaaaaugcuuaugacaggaacccuggccgucuucuuucuccugauuaugggccagcugacauggaacgaucuuaucagacugugcauuauggugggcgcuaaugccucugaccgcauggggaugggaaccaccuaccucgcgcugauggcuacauucaagaugagaccuauguuugccguuggccuccuguuccggcgccuuacgagcagagaggugcugcuccugaccaucgggcugucccuugucgccucuguggaacugcccaacagccucgaggaacugggagauggccucgcuauggggaucaugauucugaaacuucugacagacuuucaaucccaucagcucugggccacccugcugagccuuacauucaucaagaccacguuuucucugcacuaugcuuggaaaacaauggccauggugcucuccauugucagccuguucccccucugucugucuaccaccucccagaagacaaccuggcuuccuguucugcugggaagccucggcugcaagccgcugacaauguuucuuaucgcggagaauaaaauuuggggccggaagucuuggccccugaacgaagggaucauggccgugggaaucguguccauucuccugagcucccuccugaaaaacgaugucccucuugcuggcccccugaucgccgggggaaugcugauugcuuguuacgugaucagcggcucuagcgccgaccucucccuggagaaggccgcugagguuucuugggaagaggaagcggagcauagcggggccucccacaauauucuuguggaaguccaggaugacggaacgaugaaaaucaaggaugaggagcgcgacgauacccugacaauccuccugaaagcuacccuccuggccgugucuggcguuuauccucuuagcauucccgccacacuguucgugugguacuuuuggcaaaagaagaaacagagauccggcguccugugggacaccccuucucccccggaaguggagcgggcuguccucgaugacgggaucuaucgcauuaugcagagaggacugcuuggccggagccagguggggguuggaguguuccaagaaaacgucuuccauacgauguggcacgugacccgcggcgccguucugauguaccaggggaagagacucgagccuuccugggcgagcgugaaaaaggaccugaucucuuacggaggcggcuggcggcucagaggguccuggaauacaggagaggaaguccaggugauugcuguggagcccggcaaaaacccuaagaauguucagaccgcccccgggacauuuaagaccccggaaggagaggucggcgccaucgcucuggauuucaaaccugggacaagcggaucucccauugugaaccgcgaaggcaagaucgugggccuuuaugggaauggagucgugacgaccuccggcacauacguuagcgccaucgcgcaagcuaaagccucccaggaggggccucugcccgagauugaagacgagguguuucggaagagaaaccugaccaucauggaucuccaccccggaucuggcaaaacccgccgguaucugccugccauugucagagaagcuaucaagcgcaaacuucggacacugauucucgccccgacgagagugguugcuagcgagauggccgaagcgcugaaagggaugcccauccgcuaccagaccacagccgugaaguccgagcauaccggcaaagagaucgucgaccugaugugccacgcuacauucaccaugcggcuccuuagcccugugagaguucccaauuauaacaugauuaucauggaugaagcccauuuuacggacccuucuuccauugcugcccggggauacaucagcacacgcgugggcaugggggaggccgcugcgauuuucaugaccgccacacccccuggaucugucgaggcuuuuccgcaaagcaaugccgugauccaggaugaggaaagagacauccccgagcgguccuggaacucuggcuaugaguggauuacagauuucccugggaagaccgugugguuuguccccagcaucaaauccggaaaugacauugccaacugucugcgcaagaauggcaagagaguuauccagcugucucggaaaacauucgauaccgaauaccagaagacgaaaaacaacgacugggacuacguggugacaaccgauauuagcgagaugggggcuaauuuuagagccgaccgcgucaucgauccucggagaugccucaagcccgugauucugaaagacggcccggaacgcguuauccuugcgggaccuaugcccgugacagucgcuuccgccgcccaacggagaggccgcaucgggcggaaccacaauaaggagggagaucaguauauuuacaugggccagccccugaacaaugacgaggaucaugcucacuggaccgaagccaagaugcuccuggacaacaucaauacgccugaggggauuauccccgcgcuguucgaaccugagagagaaaagagcgccgcuguggauggagaguaucgccucagaggcgaggcccggaagaccuucguugagcuuaugcgcagaggggaccugccgguguggcugucuuacaaagucgcuuccgagggcuuucaguauagcgaucggcgcuggugcuucgacggagaaagaaacaaucaagugcucgaggaaaacauggaugucgagauuuggacaaaggagggcgaacggaaaaagcugagaccccgcuggcuugacgcccggaccuacuccgacccucuggcucucagagaguuuaaagaguucgccgcggggcgccggucugugagcggagaucugauccuggagaucggcaagcucccccagcaccuuacacagagagcccagaaugcucuggacaaccugguuaugcuccauaauuccgaacaagggggacgggccuaucgccacgcuauggaggagcugccugauaccauugaaacacuuaugcugcucgcccugaucgccgugcugaccggcggcgugacgcucuuuuuccuuucugggagaggacugggcaagacaagcauugggcugcucugugucauggcuuccagcguucugcuuuggauggcgucuguggagccccauuggaucgccgcuuccauuauccuggaauuuuuccucauggugcugcugaucccggagccugaccggcagcgcacaccccaggauaaccagcucgccuacgucgugauuggacuucuguuuaugauccugaccguugccgcuaaugagaugggccuccuggaaacaaccaaaaaggaccuugggauuggacacguggccgucgagaaccaccaucacgcggccaugcuggauguggaccuccauccugcuagcgccuggacacuguacgcugucgccacgaccaucauuacacccaugaugagacacaccaucgaaaacacaaccgcgaauauuucucugacggccaucgcuaaccaagccgcuauccucaugggccuugauaaaggcuggccuauuuccaagauggacaucggggugccccugcuggcccucggaugcuauagccagguuaauccgcugacccuuacagcugccgugcugaugcucgucgcgcauuacgccauuaucggcccugggcugcaggcuaaagccacccgggaggcucaaaagcgcacagccgccggaauuaugaagaaccccaccguggauggcaucguugcgaucgaccuggaucccguggucuaugacgcuaaauucgaaaagcagcucgggcagauuaugcuucugauccuguguacgucucagauucuccugaugagaacaaccugggcccuuugcgagagcaucacacuggcuaccggaccucucaccacacugugggagggcuccccgggcaaauuuuggaauacgaccauugccgugucuauggccaacaucuuccgggggagcuaccuggcuggagccggccucgcguuuucccuuaugaaaagccucgggggaggccgcagagggacaggagcccaaggcgaaacccugggcgagaaauggaagcggcagcucaaucagcuguccaagucugaguucaacacauauaaaagaagcgggaucauggagguggaccgcuccgaagcuaaggagggacuuaaacggggcgagaccacgaagcacgccguuucuagagggacagcuaaacugcgcugguucgucgaacggaaucucgugaagcccgagggaaaggugauugaucugggcugugggagaggaggcuggagcuacuauugcgccggccugaaaaaggucaccgaaguuaaaggguacaccaagggaggcccugggcacgaggaacccaucccuauggcgacauacggauggaaccucgugaaacuucauuccggcaaggacguguuuuucauucccccugagaaaugugauacccugcugugcgacaucggggagucuagcccgaaucccacaauugaagagggacgcacgcuccggguccugaagaugguggaaccuuggcuuagaggcaaccaguuuuguaucaagauucugaaucccuauaugccuuccguuguggagacccucgagcaaaugcagcgcaaacacggcgggaugcugguccggaacccccugagcagaaauucuacacaugaaauguacuggguguccugcggaaccggcaacaucguuagcgccgugaauaugacaucucgcaugcuccugaaccgguucaccauggcucacagaaagccgacguaugagcgcgaugucgaccuugggaccggaacaagacacguggccguggaaccugaggucgcuaaccuggauaucauuggccagcggaucgaaaauauuaaacaugagcacaaguccaccuggcauuacgacgaggauaaccccuauaaaacaugggccuaccacgggagcuaugaaguuaagcccucuggauccgcuagcuccauggugaauggcguggucaagcuccugaccaaaccuugggacgugauccccaugguuacacagauugccaugaccgauacgacaccuuuuggccaacagcgcguguucaaggagaaagucgacaccagaaccccgaaggcgaaacgggggacagcccagaucauggaagugacggcuagauggcuuuggggauuucugagccggaacaagaagccccgcaucuguaccagagaggaguucacacggaaaguucgcucuaaugccgcuauuggcgccguguuugucgacgagaaccaauggaauagcgccaaggaggcgguggaagaugagagauucugggaccucguucaucgggaacgcgagcugcacaaacaggggaagugcgcuaccugcguguacaacaugaugggaaaaagagaaaagaagcugggcgaguuugggaaagccaagggcucccgggccaucugguacauguggcucggagcucgcuuccuggaguuugaagcccuuggcuucaugaaugaggaucacugguucucuagagaaaacagccuguccggggucgagggagagggccuccauaaacugggguauauucuucgggacaucucuaagauuccuggaggcaauauguacgcugaugacacagccgggugggauacccgcaucacagaagacgaucugcagaacgaggcgaaaaucaccgacauuauggaacccgagcacgcccuccuggcuaaggccaucuuuaaacugacguaucagaauaagguggucagagugcaacggccugcuaagaacggcaccguuauggaugugauuagccgcagagaccagcggggauccggccaggucgggacauacggacucaauaccuucacaaacauggaagcccagcugaucagacaaauggagucugagggcauuuuuagccccuccgaacuugagaccccgaaccuggcggaacgcgcccucgauuggcuggagaaauaugggguggaacggcuuaagagaauggcuaucagcggagacgacugugugguuaaaccuaucgaugaccgcuucgccacggcucugacagcccucaaugauaugggcaaggugcggaaagacauuccccagugggagccuucuaagggguggaacgauuggcagcagguccccuuuugcucccaucacuuccaccaacugaucaugaaggacggcagagagauugugguuccuugucgcaaucaggaugaacuggugggacgggcuagagucagccagggcgccggguggucucuccgcgagaccgcgugccugggaaaauccuacgcccagauguggcaacuuauguauuuucaucggagagaccugcgccucgcugccaacgccaucuguagcgcugugcccgucgauugggugccgacaucccggaccacguggucuauucacgcccaucaccaguggaugaccacagaagacaugcugagcguuuggaauagaguguggaucgaggaaaacccuuggauggaggauaagacccauauuuccagcugggaggacguccccuaccuuggcaaacgggaagaccaguggugcgggucucugaucggacucacagcgagagcuaccugggccacaaauauccaaguggccauuaaccagguucgccggcugaucggcaaugagaacuaccuggauuauaugaccuccaugaagagauucaaaaaugaaagcgaccccgagggggcucucugguga

SEQ ID NO: 19127 - RNA, 9879 nt, Artificial Sequence
  derived and/or modified CDS sequence (opt5) from DENV-1__FJ898419__SS-prME
agcgugaccaugcugcugaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugccccagaaucacagaggcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacagaacaguauaaauuccaagccgacucuccuaagcggcugagcgcggccauuggcaaggcuugggaggagggggugugcggcaucagauccgccacccgccuggaaaacaucauguggaagcagauuucuaacgagcucaaucauauccugcuugaaaacgacaugaaauuuacgguuguggucggagauguggcuggcauucuggcccaggggaagaaaaugauccggccgcagcccauggaguacaaguauagcuggaaguccuggggaaaagccaagauuaucggcgcugacgugcaaaauacaaccuucaucauugaugggccuaacacccccgaauguccugacgaucagagagcguggaauaucugggaggucgaggacuacggauuuggcauuuucacaaccaacaucuggcucaaacugcgcgauagcuauacgcagguuugcgaccaccggcugaugucugccgcuauuaaggauuccaaagccgugcacgccgacaugggcuacuggaucgaaagcgagaagaaugaaacauggaaacuugcuagagccucuuucaucgaggugaaaaccuguauuuggcccaagucccauacacucuggagcaacgggguccuggaaucugagaugaucauuccgaaaaucuauggaggcccuauuagccagcacaauuaccgccccggguacuuuacccaaacagcgggaccuuggcaucugggcaagcucgagcuggauuucgaccuuugcgaagggaccacggugguuguggaugagcacugcggaaaccggggccccucccugagaaccacaaccgucacaggcaaaaucauccacgaaugguguugccggagcuguacccucccuccccugcgcuuuaagggggaggacggaugcugguauggcauggagauuagaccggugaaggaaaaagaggaaaaucugguuaagucuaugguguccgcugggagcggagaggucgacuccuucucucuuggccuccuguguaucagcauuaugaucgaagaggugaugcgguccagauggucucgcaaaaugcugaugacggggacacucgccgucuuuuuccugcuuauuaugggacagcugaccuggaacgaucucauccggcugugcauuauggugggcgccaaugcuagcgacagaaugggcauggggacaaccuaccuggcccuuauggcgaccuuuaagaugcgcccuauguucgcugucggacugcucuuuagacggcugacaucccgcgaggugcuccugcuuacgaucggccugucucucguggccagcgucgaacugcccaacucccuggaggaacuuggggauggacuggccaugggcaucaugauucucaaacugcucaccgacuuccagagccaucaacugugggcuacacuucugucucucaccuuuaucaagacaaccuucucccugcacuaugccuggaagacgauggcuaugguucugagcauugugucucuuuuuccccugugucucuccacaaccagccagaaaaccacauggcugccugugcuccuggggucucuuggaugcaagccgcugaccauguuccugaucgccgagaauaaaauuuggggcagaaaguccuggccccucaacgaaggcaucauggcggucgggaucgugagcauucugcuuuccgcccugcucaaaaacgauguuccucuggcuggaccccucaucgccggcgggaugcugauugcuuguuacgugaucagcggaucuagcgccgaccuuucccuggagaaggccgcugaggucucuugggaagaggaagcggagcauagcggcgccucccacaauauucugguggaaguucaggaugacgggacaaugaaaaucaaggaugaggagcgggacgauacgcucaccauccugcuuaaggcuacacugcucgccgugucuggagucuauccucugagcauucccgccacccucuucgugugguacuuuuggcagaaaaagaaacaacgcuccggcguccugugggacacaccuucucccccggaaguggagagagcuguucuugaugacggcaucuaucggauuaugcagcgcgggcugcugggaagaagccaggugggcgucgggguguuccaggaaaacguuuuucauaccauguggcacgugacgcggggagccguccucauguaccaaggcaagcgccuggagccuuccugggcgagcgugaaaaaggaccuuaucucuuacgggggaggcuggagacugcagggcuccuggaauaccggggaggaagugcagguuauugcugucgagcccggaaagaacccuaaaaaugugcagacagcccccggcaccuucaagacaagcgaaggggaggugggagccaucgcucucgauuuuaaaccgggcaccucuggguccccuauugucaaccgggaaggaaagaucgugggccuguauggcaaugggguugugacaacgagcggaaccuacgucuccgccaucgcgcaagcuaaagccucucaggagggcccccucccugagauugaagacgagguguucagaaagcgcaaccugacaaucauggaucuucaccccgggagcggaaagacccggagauaucugcccgccauuguucgcgaagcuaucaaacggaagcugagaacccucauucuggccccuacacgcguggucgcuuccgagauggccgaagcgcuuaaaggcaugccgauccgguaccagacgaccgccgugaaguccgagcauacagggaaagagaucguugaccugaugugccacgcuaccuuuacaaugagacuccugucucccgugcgcgucccuaauuauaacaugauuaucauggaugaagcccauuucaccgaccccuccagcauugcugcccggggcuacaucucuacgagagugggaaugggcgaggccgcugcgauuuuuaugacagccaccccucccgggagcguggaggcuuucccucaauccaaugccgucauccaggaugaagaacgggacaucccggagcgcucuuggaacagcggauaugaguggauuaccgauuuucccggcaagacaguuugguucgugccuuccaucaagucugggaaugacauugccaacugucugcgcaagaauggaaagcgggugauccagcucagccgcaaaaccuucgauacagaauaccagaagaccaaaaacaacgacugggacuacgucgugacgacagauauuuccgagaugggcgcuaauuuuagagccgaccggguuaucgaucccagacgcugccuuaagccugugauucugaaggacgggcccgaacgggucauccuggcgggcccgaugccugugaccguugcuagcgccgcccaaagacgcggacggaucggcagaaaccacaauaaagagggggaucaguauauuuacaugggacagccccucaacaaugacgaggaucaugcucacuggacagaagccaagaugcugcuugacaacaucaauacccccgagggcauuaucccugcgcuguucgaacccgagcgcgaaaaaucugccgcuauugauggggaguaucggcucagaggagaggcccgcaagacguuuguggaacugaugagacggggcgaccugccugucuggcucuccuacaaaguggcuagcgagggguuccaguauuccgaucgcagauggugcuuugacggcgaacggaacaaucaaguccuugaggaaaacauggauguggagaucuggaccaaggagggagaacgcaaaaagcugagaccgcgguggcuggacgccagaacauacucugacccccucgcucugcgcgaguucaaggaauuugccgcgggccggagaagcguuuccggggaucuuauccuggagauuggaaaacucccucagcaccugacccagcgcgcccagaaugcucuggacaaccucgugaugcuucauaauucugaacaaggcgggcgggccuauagacacgcuauggaggagcugcccgauacaaucgaaacccugaugcuccuggcccuuauugccgugcugacaggaggcuggacccucuucuuucugagcggccgggggcugggaaagacguccaucggccuccuuugugucauggcuagcucuguucugcuguggauggcguccguggagccucauuggauugccgcuagcaucauccucgaguucuuucugauggugcuucugauucccgagccggaccgccagagaacaccucaggauaaccagcucgccuacgucgugaucgggcugcuguucaugauucucaccguugccgcuaaugagaugggacuucuggaaaccaccaagaaggaccugggcaucgggcacguggccgucgagaaccaccaucacgcggccaugcucgauguggaccugcaucccgcuucugccuggacccuuuacgcugucgccacaacgauuaucaccccuaugaugcggcacacaauugaaaacaccacagcgaauaucucccugaccgccaucgcuaaccaagccgcuauucucaugggacuggauaaaggcuggcccaucagcaagauggacauuggcgugccucugcucgcccuugggugcuauucucagguuaauccccugacgcugaccgcugccgugcucaugcuggucgcgcauuacgccaucauuggaccgggccuucaggcuaaggccacacgcgaggcucagaagagaaccgccgccgggaucaugaagaacccuacaguggauggaaucguugcgauugaccuggaucccguggucuaugacgcuaaauuugaaaagcagcucggccagaucaugcugcugauucucuguaccagccagauccuucugaugcggacgacaugggcccugugcgaguccauuacccucgcuacagggccccugaccacccuuugggagggaucuccuggcaaauucuggaauacaacgaucgccgugagcauggccaacaucuuccgcggcuccuaccuggcuggggccggacucgcguuuagccugaugaagucccugggcgggggaagacggggcaccggggcccaaggagaaacacucggcgagaaguggaaacgccagcuuaaucagcugucuaagagcgaguucaacaccuauaaaagauccggcauuauggagguggaccggucugaagcuaaggaggggcugaaaagaggagagacaaccaagcacgccguuagccgcggcacggcuaagcuccggugguuugucgaaagaaaucuggugaaaccggaggggaaggugaucgaucuuggauguggccgcgggggaugguccuacuauugcgccggccugaaaaaggucacagaaguuaaaggcuacaccaaagggggacccggccacgaggaaccuauucccauggcgaccuacggguggaaccucgugaaacugcauucuggaaaggacguguucuuuaucccucccgagaagugugauacacugcucugcgacauuggcgagagcuccccuaauccgaccaucgaagaggggcggacacuuagaguccugaaaaugguggaacccuggcugcgcggaaaccaguucuguauuaagauccucaauccuuauaugcccagcguuguggagacgcuggagcaaaugcagcggaaacacggcggcaugcuugucagaaacccucugucucgcaauuccacccaugaaauguacugggugagcugcgggacaggaaacaucguuucugccgugaauaugaccucccggaugcuccugaacagauuuacaauggcucaccgcaagcccaccuaugagcgggaugucgaccugggcgccgggacgagacacguggcuguggaaccggaggucgccaaccucgauauuaucggacagcgcauugaaaauaucaaacaugagcacaagagcaccuggcauuacgacgaggauaacccuuauaagacaugggcuuaccacggcucuuaugaaguuaaacccuccgggagcgccuccagcauggugaauggaguggucaagcugcuuaccaaacccugggacgugauuccuaugguuacacagaucgcgaugaccgauacaacccccuucggccaacagagaguguuuaaggagaaagucgacacgcggacaccuaaggccaagcgcggcaccgcucagaucauggaagugaccgccaaauggcuguggggguuccucucuagaaacaagaaaccgcggauuuguacaagagaggaauuuacgcggaagguucgcagcaaugcugccaucggagccguguucgucgacgagaaccaauggaacuccgcgaaagaggcuguggaagaugagagauuuugggaccugguucaucgggaacgcgagcuucacaagcagggcaagugcgccacaugcguguacaacaugauggggaaaagagaaaagaaacugggagaguucggcaaggccaaagggucucgggcuauuugguacauguggcucggcgcccgcuuccuggaguuugaagcucugggauucaugaaugaggaucacugguuuagcagagaaaacucccucucuggcgucgagggggagggacugcauaaacuuggcuauauccugcgggacauuagcaaaauccccgggggaaauauguacgccgaugacacagcgggcugggauacccgcaucacagaagacgaucuccagaacgaggccaagauuaccgacaucauggaaccugagcacgcucugcuugccaaguccauuuucaaacugacauaucagaauaagguggucagagugcaacggcccgcuaaaaacgggaccguuauggaugugaucucucgcagagaccagcggggcagcggacaggucggcacguacgggcucaauaccuuuacaaacauggaagcccagcugauucgccaaauggaguccgagggaaucuucagcccuucugaacuggagacccccaaccucgcgggcagagugcuggauuggcuugaaaagcaugggguggagcggcugaaaagaauggccaucuccggagacgacuguguugugaagccgauugaugaccgcuuugcuacagcccucaccgcucugaaugauaugggcaagguccggaaagacaucccucagugggaacccagcaagggguggaacgauuggcaacaggugccuuucugcucucaccacuuucaucaacuuauuaugaaagacggcagagagaucguugugcccugucgcaaucaggaugagcuggucggacgggccagagugucccagggcgcuggguggagccuccgcgaaacggccugccugggaaaguccuaugcgcagauguggcaacugauguacuuccaccggagagaccuccgccuggccgcuaacgccauuuguucugccgucccuguggauuggguucccacaagccggaccacaugguccauccaugcucaccaucaguggaugaccacggaggacaugcuuagcguguggaauagagucuggauugaagagaacccguggauggaagauaaaacccacaucucuuccuggggcgacgugccuuaucuggggaagcgcgaggaccaguggugcggaagccucaucggccugacagcccgggcgaccugggcuacaaauauucaaguugccaucaaccaggugagacggcuuauugggaaugagaacuaccuggauuacaugaccucuaugaagagauuuaaaaaugaaagcgaccccgagggcgcccucugguga

SEQ ID NO: 19128 - RNA, 9879 nt, Artificial Sequence
  derived and/or modified CDS sequence (opt5) from DENV-1__FJ898420__SS-prME
agcgugaccaugcugcucaugcugaugcccacagcccuugcuuuccaccugacgaccagaggaggggaaccucauaugaucgucuccaagcaggaacggggaaaaucucuccuguuuaagaccagcgccggaguuaacaugugcacccuuauugcgauggaccugggggaacucugugaagauacaaugaccuacaaaugccccagaaucacagaagcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggcuaugguccaggccgauuccggaugcgugauuaacuggaaaggccgcgaacugaagugugggagcggaaucuucguuaccaaugaggugcacacauggaccgaacaauauaaguuucaggcggacuccccuaaacggcugucugccgcuauuggcaaggccugggaggagggggucugcggcaucagaagcgcuacgcgccucgaaaacaucauguggaaacagauuuccaacgagcugaaucauauccuucuggaaaacgacaugaagcucacagugguugugggagaugucgccggcauucuggggcagggcaagaagaugauccggccgcaacccauggaguacaaauauucuuggaaaagcuggggcaaggccaagauuaucggggcugacgcgcagaauaccaccuucaucauugauggaccuaacacacccgaauguccugacgaucagagagccuggaauaucugggagguggaggacuacggcuuuggcauuuucaccacgaacaucuggcugaaacuucgcgauuccuauacacaggugugcgaccaccggcucaugagcgcugccauuaaagauucuaaggccguccacgcugacaugggguacuggaucgaauccgagaaaaaugaaaccuggaagcuggccagagcgagcuuuaucgagguuaagacauguauuuggcccaaaucucauacccugugguccaacggagugcucgaaagcgagaugaucauuccgaagaucuauggcgggccuauuucucaacacaauuaccgccccggauacuucacacagaccgcuggcccuuggcaucuggggcggcuugagcuggauuucgaccucugcgaaggaacgaccguggucguggaugagcacugcggcaacagaggccccagccugcggacaaccacaguuaccgggaaaaucauccacgaaugguguugccgcuccuguacgcugccuccccuuagauuucggggagaggacggcugcugguaugggauggagauuagaccggugaaggaaaaagaggaaaaucucgucaagagcauggugucugccggauccggcgagguugacagcuucucccuggggcugcucuguaucucuauuaugaucgaagaggugaugcgcagccggugguccagaaagaugcugaugacaggaacccuugccgucuuuuuccugcucauuaugggccagcugacauggaacgaucugauccgccuuugcauuauggugggcgcuaaugccucugacagaauggggaugggaaccaccuaccuggcgcucauggcuacauuuaaaaugcggccuauguucgccguuggccugcucuuucgcagacugacgagccgggaggugcuucugcucaccaucgggcugucccuggucgccucuguggaacuucccaacagccuggaggaacucggagauggccuggcuauggggaucaugauucucaagcugcuuacagacuuccaaucccaucagcugugggccacccuccugagccugacauuuaucaaaaccacguucucucuucacuaugcuuggaagacaauggccauggugcuguccauugucagccucuuuccccugugucucucuaccaccucccagaaaacaaccuggcugccuguucuucugggaagccugggcugcaagccgcucacaauguuccugaucgcggagaauaagauuuggggccgcaaaucuuggccccuuaacgaagggaucauggccgugggaaucguguccauucugcucagcucccugcucaagaacgaugucccucuggcuggcccccuuaucgccgggggaaugcugauugcuuguuacgugaucagcggcucuagcgccgaccugucccucgagaaagccgcugagguuucuugggaagaggaagcggagcauagcggggccucccacaauauucugguggaaguccaggaugacggaacgaugaagaucaaagaugaggagagagacgauacccuuacaauccugcucaaggcuacccugcucgccgugucuggcguuuauccucugagcauucccgccacacuuuuugugugguacuucuggcagaagaagaagcagcgguccggcguccugugggacaccccuucucccccggaaguggagcgcgcuguccuggaugacgggaucuauagaauuaugcagcggggacuccugggccgcagccagguggggguuggaguguuccaagaaaacgucuuucauacgauguggcacgugaccagaggcgccguucuuauguaccaggggaaacggcuggagccuuccugggcgagcgugaagaaagaccucaucucuuacggaggcggcuggagacugcgcggguccuggaauacaggagaggaaguccaggugauugcuguggagcccggcaagaacccuaaaaauguucagaccgcccccgggacauucaagaccccggaaggagaggucggcgccaucgcucucgauuuuaagccugggacaagcggaucucccauugugaaccgggaaggcaaaaucgugggccuguaugggaauggagucgugacgaccuccggcacauacguuagcgccaucgcgcaagcuaaggccucccaggaggggccucuucccgagauugaagacgagguguucagaaaacgcaaccugaccaucauggaucugcaccccggaucuggcaagacccggagauaucucccugccauuguccgcgaagcuaucaaacggaagcugagaacacuuauucuggccccgacgcgcgugguugcuagcgagauggccgaagcgcucaaggggaugcccauccgguaccagaccacagccgugaaauccgagcauaccggcaaggagaucgucgaccugaugugccacgcuacauuuaccaugagacugcucagcccugugcggguucccaauuauaacaugauuaucauggaugaagcccauuucacggacccuucuuccauugcugcccgcggauacaucagcacaagagugggcaugggggaggccgcugcgauuuuuaugaccgccacacccccuggaucugucgaggcuuucccgcaaagcaaugccgugauccaggaugaggaacgggacauccccgagcgcuccuggaacucuggcuaugaguggauuacagauuuuccugggaaaaccgugugguucguccccagcaucaaguccggaaaugacauugccaacugucuucgcaaaaauggcaagcggguuauccagcugucuagaaagacauuugauaccgaauaccagaaaacgaagaacaacgacugggacuacguggugacaaccgauauuagcgagaugggggcuaauuuccgcgccgaccgggucaucgauccuagacgcugccugaaacccgugauucucaaggacggcccggaacggguuauccuggcgggaccuaugcccgugacagucgcuuccgccgcccaaagacgcggccggaucgggagaaaccacaauaaagagggagaucaguauauuuacaugggccagccccuuaacaaugacgaggaucaugcucacuggaccgaagccaagaugcugcucgacaacaucaauacgccugaggggauuauccccgcgcuguucgaaccugagcgcgaaaagagcgccgcuguggauggagaguauagacugcggggcgaggcccgcaaaaccuuuguugaacucaugagaagaggggaccuuccgguguggcugucuuacaaggucgcuuccgagggcuuccaguauagcgaucgcagauggugcuuugacggagaacggaacaaucaagugcuggaggaaaacauggaugucgagauuuggacaaaagagggcgaaagaaagaaacuccgcccccgguggcuggacgccagaaccuacuccgacccucuugcucugcgcgaguucaaggaauuugccgcggggcggagaucugugagcggagaucucauccuggagaucggcaaacugccccagcaccucacacagcgggcccagaaugcucuugacaaccugguuaugcugcauaauuccgaacaagggggacgcgccuauagacacgcuauggaggagcucccugauaccauugaaacacugaugcuucuggcccucaucgccgugcugaccggcggcgugacgcuguucuuucucucugggcggggacuuggcaagacaagcauugggcugcugugugucauggcuuccagcguucuccuguggauggcgucuguggagccccauuggaucgccgcuuccauuauccuugaguucuuucugauggugcuccugaucccggagccugaccgccagagaacaccccaagauaaccagcuggccuacgucgugauuggacuccuuuucaugauccugaccguugccgcuaaugagaugggccugcucgaaaccaccaagaaagaccuggggauuggacacguggccgucgagaaccaccaucacgcggccaugcuugauguggaccugcauccugcuagcgccuggacacucuacgcugucgccacgaccaucauuacacccaugaugcggcacaccaucgaaaacacaaccgcgaauauuucucugacggccaucgcuaaccaagccgcuauccugaugggccucgauaagggcuggccuauuuccaaaauggacaucggggugccccuucuggcccugggaugcuauagccagguuaauccgcucacccugacagcugccgugcuuaugcuggucgcgcauuacgccauuaucggcccugggcuccaggcuaaggccacccgcgaggcucagaaacggacagccgccggaauuaugaagaaccccaccguggauggcaucguugcgaucgaccuggaucccguggucuaugacgcuaaguuugaaaaacagcuggggcagauuaugcuccuuauccuguguacgucucagauucugcucaugcggacaaccugggcccugugcgagagcaucacacuugcuaccggaccucugaccacacucugggagggcuccccgggcaaguucuggaauacgaccauugccgugucuauggccaacaucuuucgcgggagcuaccuggcuggagccggccuggcguucucccucaugaaaagccuugggggaggcagacgggggacaggagcccaaggcgaaacccugggcgagaaguggaaaagacagcugaaucagcucuccaagucugaguucaacacauauaagcgcagcgggaucauggagguggaccgguccgaagcuaaagagggacugaagagaggcgagaccacgaaacacgccguuucucgcgggacagcuaaacuucggugguuugucgaaagaaaucuggugaaacccgagggaaaggugauugaucucggcugugggcgcggaggcuggagcuacuauugcgccggccugaagaaagucaccgaaguuaagggguacaccaaaggaggcccugggcacgaggaacccaucccuauggcgacauacggauggaaccuggugaagcuccauuccggcaaagacguguucuuuauucccccugagaagugugauacccuucugugcgacaucggggagucuagcccgaaucccacaauugaagagggacggacgcugagaguccucaaaaugguggaaccuuggcugcgcggcaaccaguucuguaucaagauucuuaaucccuauaugccuuccguuguggagacccuggagcaaaugcagcggaagcacggcgggaugcucgucagaaacccccugagccgcaauucuacacaugaaauguacuggguguccugcggaaccggcaacaucguuagcgccgugaauaugacaucucggaugcugcucaacagauuuaccauggcucaccgcaaaccgacguaugagagagaugucgaccuggggaccggaacacggcacguggccguggaaccugaggucgcuaaccuugauaucauuggccagcgcaucgaaaauauuaagcaugagcacaaauccaccuggcauuacgacgaggauaaccccuauaagacaugggccuaccacgggagcuaugaaguuaaacccucuggauccgcuagcuccauggugaauggcguggucaagcugcucaccaagccuugggacgugauccccaugguuacacagauugccaugaccgauacgacaccuuucggccaacagagaguguuuaaagagaaggucgacacccggaccccgaaagcgaagagagggacagcccagaucauggaagugacggcucgguggcuguggggauuccuuagccgcaacaaaaagcccagaaucuguacccgggaggaauuuacacgcaagguuagaucuaaugccgcuauuggcgccguguucgucgacgagaaccaauggaauagcgccaaagaggcgguggaagaugagcgguuuugggaccugguucaucgcgaaagagagcuccacaagcaggggaaaugcgcuaccugcguguacaacaugaugggaaagcgggagaaaaagcugggcgaguucgggaaggccaaaggcucccgcgccaucugguacauguggcugggagcuagauuucucgaguucgaagcccugggcuucaugaaugaggaucacugguuuucucgggaaaacagccuuuccggggucgagggagagggccugcauaagcucggguauauucugcgcgacaucucuaaaauuccuggaggcaauauguacgcugaugacacagccgggugggauaccagaaucacagaagacgaucuucagaacgaggcgaagaucaccgacauuauggaacccgagcacgcccugcucgcuaaagccaucuucaagcugacguaucagaauaaagugguccgggugcaacgcccugcuaagaacggcaccguuauggaugugauuagcagacgggaccagagaggauccggccaggucgggacauacggacugaauaccuuuacaaacauggaagcccagcucauccgccaaauggagucugagggcauuuucagccccuccgaacuggagaccccgaaccuugcggaacgggcccuggauuggcucgagaaguaugggguggaaagacugaaacgcauggcuaucagcggagacgacugugugguuaagccuaucgaugaccgguuugccacggcucuuacagcccugaaugauaugggcaaagugagaaaggacauuccccagugggagccuucuaaaggguggaacgauuggcagcagguccccuucugcucccaucacuuucaccaacucaucaugaaggacggccgcgagauugugguuccuugucggaaucaggaugaacuggugggcagagcucgcgucagccagggcgccggguggucucugcgggagaccgcgugccucggaaaguccuacgcccagauguggcaacugauguauuuccauaaaagagaccuucgccuggcugccaacgccaucuguagcgcugugcccgucgauugggugccgacaucccggaccacguggucuauucacgcccaucaccaguggaugaccacagaagacaugcucagcguuuggaauagaguguggaucgaggaaaacccuuggauggaggauaagacccauauuuccagcugggaggacguccccuaccugggcaaacgggaagaccaguggugcgggucucuuaucggacugacagcgagagcuaccugggccacaaauauccaaguggccauuaaccagguucgccggcucaucggcaaugagaacuaccuggauuauaugaccuccaugaagagauuuaaaaaugaaagcgaccccgagggggcucugugguga

SEQ ID NO: 19129 - RNA, 9879 nt, Artificial Sequence
  derived and/or modified CDS sequence (opt5) from DENV-1__FJ898421__SS-prME
agcgugaccaugcugcucaugcugaugcccaccgcccuugcuuuccaccugacgaccagaggaggggaaccucauaugaucguguccaagcaggaacggggaaaaucucuccuguuuaagaccagcgccggcguuaauaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaagcucacaguuguggucggagauguggcuggcauucuggggcagggcaagaaaaugauccggccgcaacccauggaguacaaauauucuuggaaaagcuggggcaaggccaagauuaucggggccgacgcucagaauaccaccuucaucauugauggaccuaacacacccgaauguccugacgaucagagagcguggaauaucugggagguggaggacuacggcuuuggcauuuucaccacgaacaucuggcugaaacuucgcgauuccuauacacaggucugcgaccaccggcucaugagcgccgcuauuaaagauucuaaggccguucacgccgacaugggguacuggaucgaauccgagaaaaaugaaaccuggaagcuggcuagagccagcuuuaucgaggugaagacauguauuuggcccaaaucucauacccugugguccaacggagugcucgaaagcgagaugaucauuccgaagaucuauggcgggccuauuucucaacacaauuaccgccccggauacuucacacagaccgcgggcccuuggcaucuggggaaacuugagcuggauuucgaccucugcgaaggaacgaccgucgugguugaugagcacugcggcaaccggggccccagccugagaacaaccacagugaccgggaagaucauccacgaaugguguugccgguccuguacgcugccuccccuucgcuuuagaggagaggacggcugcugguaugggauggagauucggccggucaaagaaaaggaggaaaaucucgucaagagcaugguuucugcuggauccggcgagguggacagcuucucccuggggcugcucucuaucagcauuaugaucgaagaggucaugagaucccgcuggucucggaaaaugcugaugacaggaacccuugccguguuuuuccugcucauuaugggccagcugacauggaacgaucugaucagacuuuguauuaugguuggcgccaaugcuagcgaccgcauggggaugggaaccaccuaccuggcccucauggcgacauuuaagaugagaccuauguucgcugugggccugcucuuucggcgccugacguccagagagguccuucugcucaccaucgggcugucucugguggccagcguggaacuucccaacucccuggaggaacucggagauggccuggccauggggaucaugauucucaaacugcuuacagacuuccaaagccaucagcugugggcuacccuccugucucugacauuuaucaagaccacguucucccuucacuaugccuggaaaacaauggcuaugguccugagcauuguuucucucuuuccccugugccucuccaccaccagccagaagacaaccuggcugccugugcuucugggaucucugggcuguaagccgcucacaauguuccugaucgccgagaauaaaauuuggggccggaaguccuggccccuuaacgaagggaucauggcggugggaaucgucagcauucugcucuccagccugcucaaaaacgaugugccucuggccggcccccuuaucgcugggggaaugcugauugccugcuacguuaucucuggcagcuccgcugaccugucucucgagaaggccgccgaggugagcugggaagaggaagcugagcauuccggggcgucucacaauauucuggucgaagugcaggaugacggaacgaugaaaaucaaggaugaggagcgcgacgauacccuuacaauccugcucaaagccacccugcucgcuguuagcggcguguauccucuguccauucccgccacacuuuuugucugguacuucuggcaaaagaagaaacagagaucuggcgugcugugggacaccccuagcccucccgaagucgagcgggccgugcuggaugacgggaucuaucgcauuaugcagagaggacuccugggccggucccagguuggggugggagucuuccaagaaaacguguuucauacgauguggcacguuacccgcggcgcugugcuuauguaccaggggaagagacuggagcccagcugggccucugucaaaaaggaccucaucuccuacggaggcggcuggcggcugagagggagcuggaauacaggagaggaaguccaggugauugcgguugagcccggcaaaaacccuaagaauguccagaccgcucccgggacauucaagaccccggaaggagaggugggcgccaucgcccucgauuuuaaaccugggacaucuggaucccccauugugaaccgcgaaggcaagaucgucggccuguaugggaauggagugguuacgaccagcggcacauacguguccgcuaucgcccaagcgaaggcuucucaggaggggccucuucccgagauugaagacgaggucuuccggaagagaaaccugaccaucauggaucugcaccccggaagcggcaaaacccgccgguaucucccugccauugugagagaagccaucaagcgcaagcugcggacacuuauucuggcuccgacgagaguuguggccuccgagauggcugaagcccucaaagggaugcccauccgcuaccagaccacagcggucaagagcgagcauaccggcaaagagaucguggaccugaugugucacgccacauuuaccaugcggcugcucucuccuguuagagugcccaauuauaacaugauuaucauggaugaagcucauuucacggacccuuccagcauugccgcucggggauacaucucuacacgcgucggcaugggggaggccgccgcuauuuuuaugaccgcgacacccccuggaagcguggaagccuucccgcaauccaaugcugugauccaggaugaggaaagagacauccccgagcggucuuggaacagcggcuaugaguggauuacagauuuuccugggaagaccgucugguucguucccuccaucaaaucuggaaaugacauugccaacugccuucgcaagaauggcaagagagugauccagcugagccggaaaacauuugauaccgaauaccagaagacgaaaaacaacgacugggacuacguggucacaaccgauauuuccgagaugggggccaauuucagagcugaccgcgugaucgauccucggagaugucugaagcccguuauucucaaagacggcccggaacgcgugauccuggccggaccuaugcccgucacaguggcgagcgcugcccaacggagaggccgcaucgggcggaaccacaauaaggagggagaucaguauauuuacaugggccagccccuuaacaaugacgaggaucaugcccacuggaccgaagcuaagaugcugcucgacaacaucaauacgccugaggggauuauccccgcccuguucgaaccugagagagaaaaaucugcggccguugauggagaguaucgccugagaggcgaggcucggaagaccuuuguggaacucaugcgcagaggggaccuuccggucuggcuguccuacaaaguggccagcgagggcuuccaguauuccgaucggcgcuggugcuuugacggagaaagaaacaaucaaguccuggaggaaaacauggauguggagauuuggacaaaggagggcgaacggaaaaagcucagaccccgcuggcuggacgcucggaccuacucugacccucuugcccugagagaguucaaagaauuugcugccgggcgccggagcguuuccggagaucucauccuggagaucggcaagcugccccagcaccucacacagagagcgcagaaugcccuugacaaccuggugaugcugcauaauucugaacaagggggacgggcuuaucgccacgccauggaggagcucccugauaccauugaaacacugaugcuucuggcucucaucgccgugcugaccggcggcgucacgcuguucuuucucagcgggagaggacuuggcaagacauccauugggcugcugugcguuauggccagcucugugcuccuguggauggcuuccguggagccccauuggaucgcggccagcauuauccuugaguucuuucugaugguccuccugaucccggagccugaccggcagcgcacaccccaggauaaccagcuggcuuacgugguuauuggacuccuuuucaugauccugaccguggccgccaaugagaugggccugcucgaaacaaccaaaaaggaccuggggauuggacacgucgcuguggagaaccaccaucacgccgcgaugcuugaugucgaccugcauccugccucugcuuggacacucuacgccguggcuacgaccaucauuacacccaugaugagacacaccaucgaaaacacaaccgccaauauuucccugacggcgaucgccaaccaagcugccauccugaugggccucgauaaaggcuggccuauuagcaagauggacaucgggguuccccuucuggcucugggauguuauucucaggugaauccgcucacccugacagccgcuguccuuaugcugguggcccauuacgcgauuaucggcccugggcuccaggccaaagcuacccgggaggcccaaaagcgcacagcugccggaauuaugaagaaccccaccguugauggcaucguggccaucgaccuggaucccgucguguaugacgcgaaauuugaaaagcagcuggggcagauuaugcuccuuauccugugcacgagccagauucugcucaugagaacaaccugggcucugugugaguccaucacacuugccaccggaccucugaccacacucugggagggcucuccgggcaaauucuggaauacgaccauugcugugagcauggccaacaucuuucggggguccuaccuggccggagcuggccuggccuucagccucaugaagucccuugggggaggccgcagagggacaggagcgcaaggcgaaacccugggcgagaaauggaagcggcagcugaaucagcucucuaagagcgaguucaacacauauaaaagauccgggaucauggagguugaccgcucugaagccaaggagggacugaaacggggcgagaccacgaagcacgcugucagcagagggacagccaaacuucgcugguuuguggaacggaaucuggugaagcccgagggaaaggucauugaucucggcugcgggagaggaggcugguccuacuauugugcuggccugaaaaagguuaccgaagugaaaggguacaccaagggaggcccugggcacgaggaacccaucccuauggccacauacggauggaaccuggugaaacuccauucuggcaaggacgucuucuuuauucccccugagaaaugcgauacccuucugugugacaucggggagagcuccccgaaucccacaauugaagagggacgcacgcugcgggugcucaagaugguugaaccuuggcugagaggcaaccaguucugcaucaagauucuuaaucccuauaugccuagcguggucgagacccuggagcaaaugcagcgcaaacacggcgggaugcucgugcggaacccccugucuagaaauuccacacaugaaauguacuggguuagcuguggaaccggcaacaucgugucugcggucaauaugacaucccgcaugcugcucaaccgguuuaccauggcccacagaaagccgacguaugagcgcgauguggaccuggggaccggaacaagacacguggcugucgaaccugagguugccaaccuugauaucauuggccagcggaucgaaaauauuaaacaugagcacaagagcaccuggcauuacgacgaggauaaccccuauaaaacaugggcuuaccacgggucuuaugaagugaagcccuccggaagcgccuccagcauggugaauggcgucgugaagcugcucaccaaaccuugggacguuauccccauggugacacagauugcuaugaccgauacgacaccuuucggccaacagcgcgucuuuaaggagaaaguggacaccagaaccccgaaggccaaacgggggacagcgcagaucauggaaguuacggccagauggcuguggggauuccuuucucggaacaagaagccccgcaucugcaccagagaggaauuuacacggaaagugcgcagcaaugcugccauuggcgcugucuucguggacgagaaccaauggaacuccgccaaggaggccguugaagaugagagauuuugggaccuggugcaucgggaacgcgagcuccacaaacaggggaagugugcgaccugcgucuacaacaugaugggaaaaagagaaaagaagcugggcgaguucgggaaagcuaagggcucucgggccaucugguacauguggcugggagcccgcuuucucgaguucgaagcucugggcuucaugaaugaggaucacugguuuagcagagaaaacucccuuucugggguggagggagagggccugcauaaacucggguauauucugcgggacaucagcaagauuccuggaggcaauauguacgccgaugacacagcugggugggauacccgcaucacagaagacgaucuucagaacgaggccaaaaucaccgacauuauggaacccgagcacgcgcugcucgccaaggcuaucuucaaacugacguaucagaauaaggucgugagaguucaacggccugccaagaacggcaccgugauggaugucauuucccgcagagaccagcggggaucuggccagguggggacauacggacugaauaccuuuacaaacauggaagcucagcucaucagacaaauggagagcgagggcauuuucucccccagcgaacuggagaccccgaaccuugccgaacgcgcgcuggauuggcucgagaaauaugggguggaacggcugaagagaauggccaucucuggagacgacugcguugugaaaccuaucgaugaccgcuuugcuacggcccuuacagcucugaaugauaugggcaagguccggaaagacauuccccagugggagccuuccaagggguggaacgauuggcaacaggugcccuucuguagccaucacuuucaccaacucaucaugaaggacggcagagagauuguugugccuugccgcaaucaggaugaacuggucggacgggccagagugucucagggcgcuggguggucccugcgcgagaccgccugucucggaaaaagcuacgcgcagauguggcaacugauguauuuccaucggagagaccuucgccuggccgcuaacgccaucugcuccgccguccccguggauuggguuccgacaucucggaccacguggagcauucacgcucaucaccaguggaugaccacagaagacaugcucuccguguggaauagagucuggaucgaggaaaacccuuggauggaggauaagacccauauuagcucuugggaggacgugcccuaccugggcaaacgggaagaccaguggugugggucccuuaucggacugacagccagagcgaccugggcuacaaauauccaaguugccauuaaccaggugcgccggcucaucggcaaugagaacuaccuggauuauaugaccagcaugaagagauuuaaaaaugaaucugggcccgagggcgcccugugguga

SEQ ID NO: 19130 - RNA, 9879 nt, Artificial Sequence
  derived and/or modified CDS sequence (opt5) from DENV-1__FJ898423__SS-prME
agcgugaccaugcugcucaugcugaugcccacggcccuugcuuuccaccugacgaccagaggcggggaaccucauaugaucgucuccaagcaggaacggggaaagucucuccuguuuaagaccagcgccggcguuaauaugugcacccuuaucgcgauggaccugggggaacucugugaagauacaaugaccuacaaaugcccgagaaucacagagguggaacccgacgauguggacuguuggugcaauaccacggauaccugggucacauauggaaccuguucccaaacaggcgagcacagacgggacaagcgcucuguggcucuggccccucauguugggcugggacucgagaccagagccgaaacguggaugagcuccgagggcgcuuggaaacagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaagauaagcccacacuggacaucgaacugcucaaaaccgagguuacaaacccugcugugcugcggaaacuuugcauugaagccaaaaucuccaauaccacgacagauagccgcuguccgacccaaggagaggcgacccugguggaagaacaggacgccaacuucgucugcagacggacauuuguggaucgcggcuggggcaauggguguggacucuucggcaaggggucucugauuaccugcgcuaaguuuaaaugcguuacaaaacuugagggaaaaaucauccaguacgaaaaccugaaguauuccgugauugucacggugcacaccggcgaccagcaucaaguugggaaugagagcacagaacacggaaccaucgccacaauuacaccccaggcuccuacgucugagauccagcucaccgacuacggcgcccugacacuggauuguucccccagaaccggccucgacuucaacgaaauggugcugcuuacaaugaaagaaaagagcuggcugguccauaaacagugguuucucgaucugccucuucccuggaccuccggggccucuacgagccaagagacauggaaucggcaggaccugcucgugaccuucaagacagcucacgcgaagaaacaggaagucgugguucugggaucccaagagggcgccaugcacaccgcucugaccggggccacagaaauucagacgaccggaacaaccacaaucuuugccggccaucucaagugccgccugaaaauggauaaacuuacccugaaagggaugagcuaugugauguguacgggcucuuucaagcucgagaaggaagucgcugagacacagcacggaaccgugcugguucagaucaaauacgagggcaccgacgccccgugcaagauuccuuucuccacacaagaugaaaaaggggugacccagaacggaagacugaucacagcgaaucccauugucacggacaaggagaaaccugugaacaucgaagcugagccgcccuuuggcgagagcuauauugugaucggggccggagaaaaggcccuuaagcucucuugguucaaaaagggcagcuccaucgggaaaauguuugaggcuaccgcccggggcgcuagacgcauggccauucugggagauacagcgugggacuucggcucuaucgggggaguuuuuaccagcgucggcaagcuggugcaucagauuuucgggacagccuacggagugcucuuuuccggcgucagcuggaccaugaaaaucgggauuggcgugcugcuuacguggcugggacucaauucucgguccaccagccugucuaugacauguaucgcuguuggccugauuacccuuuaccucggggugaugguccaggccgauuccggaugcgugaucaacuggaagggcagagaacugaagugugggagcggaaucuucguuacaaaugaggugcacaccuggacagaacaauauaaauuucaggcugacuccccuaagcgccugucugccgcgauuggcaaagccugggaggagggggucugcggcauccggagcgcuaccagacucgaaaacauuauguggcgccagaucuccaacgagcugaaucauauucuucuggaaaacgacaugaaguucacggugguugugggagaugucgugggcauccucgcccaggggaaaaagauggugcggccgcaacccauggagcacaaauacucuuggaaaagcuggggaaaggcuaagaucauuggcgccgacguccagaauacaaccuuuaucauugaugggccuaacacccccgaauguccugacgaucagagagccuggaauaucugggagguugaggacuauggauucggcauuuuuacaaccaacaucuggcugaagcugcgcgauuccuacacacaggugugcgaccaccggcuuaugagcgcugcgaucaaagauucuaaggccgugcaugcugacaugggcuauuggauugaauccgagaaaaaugaaacauggaagcucgccagagccagcuucaucgaggucaagaccuguauuuggcccaaaucucacacacugugguccaacggggugcuggaaagcgagaugaucauuccgaagaucuacggaggcccuaucucucaacauaauuaucgccccggguacuucacccagacagcuggaccuuggcaccucggcaaacuggagcuugauuuugaccugugcgaagggaccacgguuguggucgaugagcacugcggaaaccggggccccagccucagaaccacaaccgugacaggcaagauuauccaugaaugguguugccgguccuguacccugccuccccugcgcuucaaaggggaggacggaugcugguacggcauggagauuagaccgguuaaggaaaaggaggaaaaucuugugaaaagcauggucucugccggguccggagagguggacagcuuuucccucggccugcuguguaucucuauuaugaucgaagagguuaugcggagcagauggucccgcaagaugcucaugacggggacacuggcgguguucuuucuucugauuaugggacagcucaccuggaacgaucugauccggucuugcaucauggucggcgcuaaugccagcgacagaaugggcauggggacaaccuaucuggcccuuauggcuaccuucaaaaugcgcccuauguuugccgugggacuccuguucagacggcugacaucccgcgaggugcuccugcuuacgauuggccugucucucgucgcgagcguugaacugcccaacucccuggaggaacuuggggauggacuggcuaugggcaucaugauucucaagcugcucaccgacuuucaaagcuaccagcugugggccacacuucugucucucaccuucaucaaaacaaccuuuucccugcacuaugccuggaagacgauggcuauggugcugagcauugugucucuucugccccucugucuguccacaaccagccagaagaccacauggcucccuguccugcuugggucucugggaugcaaaccgcugaccauguuccucaucgccgagaauaagaucuggggcagaaaauccuggccccugaacgaaggcauuauggcuguggggaucguuagcauucuucuguccagccuccugaagaacgaugugccucucgccggaccccugaucgcgggcgggaugcuuauugccuguuacgucaucucuggaagcuccgcugaccugucucuggagaaagccgcugaggugagcugggaagaggaagccgagcauuccggcgccucucacaauauccucguugaagugcaggaugacgggacaaugaagauuaaagaugaggagcgggacgauacgcugaccauccuucugaaggcuacacuccuggcggucagcggaguguauccucucuccauucccgccacccuguuugucugguacuucuggcaaaagaaaaagcagcgcucuggcgugcuuugggacacaccuagcccucccgaaguugagagagcugugcuggaugacggcaucuaucggauuaugcagcgcgggcugcucggaagaucccaggucggcguggggguuuuccaagaaaacguguuucauaccauguggcacgucacgcggggagccgugcugauguaccagggcaaacgccuugagcccagcugggccucugugaagaaagaccugaucuccuacgggggaggcuggagacuccagggcagcuggaauaccggggaggaaguucaggucauugcuguggagcccggaaagaacccuaagaaugugcaaacagcccccggcaccuucaaaacaccggaaggggaggucggagcgaucgcucuggauuuuaagccuggcaccucugggucccccaucgugaaccgggaaggaaaaauuguuggccucuauggcaaugggguggucacaacgagcggaaccuacguguccgccaucgcccaggcuaaggccucucaggagggcccucugcccgagauugaagacgagguuuucagaaaacgcaaccuuacaaucauggaucugcaccccgggagcggaaagacccggagauaucugccugcgauugugcgcgaagcuaucaagcggaaacucagaacccugauccuugccccgacacgcgucguggccuccgagauggcugaagcccugaagggcaugcccauucgguaccaaacgaccgcuguuaaaagcgagcauacagggagagagaucguggaccucaugugccacgccaccuuuacaaugcgccugcugucuccuguccgggugcccaauuauaacaugauuaucauggaugaagcgcauuucaccgacccuuccagcauugccgcuagaggcuacaucucuacgcgggugggaaugggcgaggccgcugccaucuuuaugacagccacacccccugggagcgucgaggcuuucccgcaguccaaugcgguuauucaggaugaggaacgcgacauccccgagagaucuuggaacagcggauaugaguggauuaccgauuuuccuggcaagacagugugguucgugcccuccaucaaaucugggaaugacauugccaacugucuccggaagaauggaaagcgcgucauccagcuuagcagaaaaaccuuugauacagaauaccaaaagaccaaaaacaacgacugggacuacgugguuacgacagauauuuccgagaugggcgcuaauuuccgggccgacagagugaucgauccucgccggugccugaagcccgucauccugaaagacgggccggaaagagugauucucgccggcccuaugcccguuaccguggcuagcgccgcgcagcgccggggaagaaucggccgcaaccacaauaaggagggggaucaguauauuuacaugggacagccccugaacaaugacgaggaucaugcucacuggacagaagccaagaugcuucuggacaacaucaauaccccugagggcauuauccccgcccucuucgaaccugagcgggaaaaaucugcugccaucgauggggaguauagacugcgcggagaggcgagaaagacguuugucgaacugaugcggcgcggcgaccucccgguguggcuuuccuacaaagucgccagcgagggguuccaauauuccgauagacgguggugcuuugacggcgaacgcaacaaucaggugcuggaggaaaacauggauguugagauuuggaccaaggagggagaacgcaagaagcugcggcccagauggcucgacgcucgcacauacucugacccucuggcccuucgggaguucaaagaauuugcugccggcagacgcagcguguccggggaucugauccucgagauuggaaagcugccccagcaccugacccagcgggcucaaaaugcccucgacaaccuugugaugcugcauaauucugaacagggcgggagagcguaucggcacgccauggaggagcugccugauacaaucgaaacccucaugcugcuugcucugauugccguccucacaggaggcguuacccuguucuuucugagcggccgcgggcucggaaagacguccaucggccuucugugugugauggcuagcucugcccugcucuggauggccuccguggagccccauuggaucgcugcgagcauuauccuggaguucuuucuuaugguccugcucauuccggagccugacagacagcggacaccccaggauaaccaacuggccuacgugguuaucgggcuccuguucaugauucuuaccguggcugccaaugagaugggacugcuggaaaccaccaagaaggaccucggcaucgggcacgucgccguggagaaccaccaucacgcuaccaugcuggaugucgaccuucauccugccucugcguggacacuguacgccguggcuacgaccauuaucacacccaugaugcgccacaccaucgaaaacacaaccgccaauauuucccucacggcuaucgccaaccaggcggccauucugaugggacuggauaaaggcuggccuaucagcaagauggacauuggcguuccccuccuugcucuggggugcuauucucaggugaauccgcugacccucacagccgcuguccugaugcuuguggcccauuacgcuaucaucggaccuggccugcaagccaaagcgaccagagaggcccagaagcggacagcugccgggauuaugaagaaccccaccguugauggaaucguggcuauugaccucgaucccgucguguaugacgccaaauuugaaaagcagcugggccagaucaugcugcucauucuuuguacgagccaaauccugcugaugcgcacaaccugggcccucugcgaguccaucacacuggcgaccgggccucuuaccacacugugggagggaucuccgggcaaauucuggaauacgaccauugcugugagcauggccaacaucuuuagaggcuccuaccucgcuggggccggacuggccuucagccugaugaagucccucggcgggggacggcgcggcacaggggcucagggagaaacccuuggcgagaaauggaagagacagcugaaucagcugucuaagagcgaguucaacacauauaaacgguccggcauuauggagguugacagaucugaagccaaggaggggcuccgccggggagagaccacgaaacacgcggucagcagaggcacagccaagcugcgcugguuuguggaacggaaucuugugaaacccgaggggaaggucaucgaucugggauguggcagagggggaugguccuacuauugcgcuggccucaagaaaguuaccgaagugaagggcuacaccaaagggggaccuggccacgaggaacccauuccuauggccacauacggguggaaccuggugaagcugcauucuggaaaagacgucuucuuuauucccccugagaagugugauacccuccuuugcgacauuggcgagagcuccccgaaucccacaaucgaagaggggcgcacgcugcgggugcugaaaaugguugaaccuuggcucagaggaaaccaauucuguaucaagauucugaaucccuauaugccuagcguggucgagacccuugagcacaugcagcgcaagcauggcggcaugcuggugcggaacccccucucuagaaauuccacacacgaaauguacuggguuagcugcgggaccggaaacaucgugucugcugucaauaugacaucccgcaugcugcugaaccgguuuaccauggcccacagaaaaccgacguaugagcgcgauguggaccucggcgcggggaccagacauguggccgucgaaccugagguugcuaaccuggauauuaucggacagcggauugaaaauaucaagcacgagcauaaaagcacauggcacuacgacgaggauaaccccuauaagaccugggccuaccauggcucuuaugaagugaaacccuccgggagcgcuuccagcauggugaauggagucgugaaacuucugacaaagccuugggacguuauccccauggugacccagauugccaugacagauaccacgccuuucggccaacagcgcgucuuuaaagagaagguggacacaagaaccccgaaagcuaagcggggcaccgcccagaucauggaaguuacagcgagauggcucuggggguuccugucucggaacaaaaagccccgcauuuguacgagagaggaauuuacccggaaggugcgcagcaaugccgcuaucggagccgucuucguggacgagaaccaauggaacuccgcuaaagaggccguugaagaugagagauuuugggaccuugugcaccgggaacgcgagcugcacaagcagggcaaaugcgccacaugcgucuacaacaugauggggaagagagagaagaagcucggagaguucggcaaggcgaaagggucucgggcuauuugguacauguggcugggcgcccgcuuucuggaguucgaagcccucggauucaugaaugaggaucauugguuuagcagagaaaacucccugucuggcguggagggggagggacuucacaagcugggcuauauccuccgggacaucagcaaaauuccugggggaaauauguacgcugaugacaccgccggcugggauacacgcaucaccgaagacgaucugcagaacgaggcuaagauuacagacaucauggaacccgagcaugcccuucuggcgaccuccauuuucaaacucacguaucagaauaaggucgugagaguucaacggccugccaaaaacgggaccgugauggaugucaucucucgcagagaccagcggggcagcggacaggugggcacauacgggcugaauaccuuuacaaacauggaagcucagcugaucagacaaauggaguccgagggaauuuucagccccucugaacucgagaccccgaaccuggccgaacgcgugcuugauuggcuggagaaguauggcguugaacggcucaagagaauggcuaucuccggggacgacuguguggucaaaccuauugaugaccgcuuugccacggcgcugacagcccuuaaugauaugggaaaggugcggaaagacaucccccagugggagccuagcaagggcuggaacgauuggcagcagguucccuucugcucucaccacuuucaucaacugauuaugaaagacgggagagagaucguggucccuugucgcaaucaggaugaacucgugggccgggcuagagucucccagggagccggcuggagccugcgcgagaccgcuugccuggggaaguccuacgcccagauguggcaacucauguauuuccaccggagagaccugcgccuugcugccaacgcgauuuguucugccgugcccguugauugggugccgacaagccggaccacgugguccauccaugcucaccaucaguggaugaccacagaagacaugcugagcgucuggaauagaguguggaucgaggaaaacccuuggauggaggauaagacccacauuucuuccuggggagacguucccuaccucggcaaacgggaggaccaguggugcgggagccugaucggacuuacagccagagccaccugggcuacaaauauucaaguggccaucaaccagguccgccggcugauuggcaaugaaaacuaccucgauuauaugaccucuaugaagagauuuaaaaaugagagcgaccccgaaggggcgcugugguga

SEQ ID NO: 19131 - RNA, 9879 nt, Artificial Sequence
  derived and/or modified CDS sequence (opt5) from DENV-1__FJ898424__SS-prME
agcgugaccaugcugcucaugcugaugcccaccgcucuugcuuuccaccugacgaccagaggcggggaaccucauaugaucgucuccaagcaggaacggggaaagucucuccuguuuaagaccagcaccggcguuaauaugugcacccuuaucgccauggaccugggggagcucugugaagauaccaugacauacaagugcccgagaaucaccgagguggaacccgacgauguggacuguuggugcaauacgaccgauacaugggucaccuauggaacauguucccaaaccggcgagcacagacgggacaagcgcucuguggcgcuggcuccucauguugggcugggacucgagacgagagccgaaacauggaugagcuccgagggcgccuggaaacagauucagaagguggaaaccugggcucugcggcaccccggcuucacagucaucgcccuuuuucuggcucaugccauugggaccucuaucacccagaagggaaucauuuucauccuccugaugcuugugacaccuagcauggcgaugcgcugcguuggcauuggguccagagauuuuguggagggacugagcggcgccacgugggucgacguggugcucgagcacgggucuugugucaccacaauggcuaaagauaagcccacccuggacaucgaacugcucaaaacagagguuaccaacccugccgugcugcggaaacuuugcauugaagcuaaaaucuccaauacgacaaccgauagccgcuguccgacccaaggagaggccacacugguggaagaacaggacgcgaacuucgucugcagacggaccuuuguggaucgcggcuggggcaauggguguggacucuucggcaaggggucucugauuacaugcgccaaguuuaaaugcguuacgaaacuugagggaaaaaucgugcaguacgaaaaccugaaguauuccgucaucgugaccguucacacaggcgaccagcaucaaguggggaaugagagcaccgaacacggaacaaccgcuacgauuacaccccaggccccuacaucugagauccagcucaccgacuacggcgcucugacacuggauuguucccccagaaccggccucgacuucaacgaaaugguccugcuuacgaugaaagaaaaguccuggcuggugcauaaacagugguuucucgaucugccucuucccuggacauccggggccucuaccagccaagagacauggaaucggcaggaccugcucgucaccuucaagaccgcccacgcuaagaaacaggaagugguugugcugggaucccaagagggcgcgaugcacacagcccugacgggggcuaccgaaauucagacaagcggaaccacaaccaucuuugccggccaucucaagugccgccugaaaauggauaaacuuacgcugaaagggaugucuuaugucauguguacaggcuccuucaagcucgagaaggaaguggccgagacccagcacggaaccguucuggugcagauuaaauacgagggcacagacgcuccgugcaagaucccuuucagcacccaagaugaaaaaggggucacacagaacggaagacugaucacggccaaucccauugugaccgacaaggagaaaccugugaacaucgaagcggagccgcccuuuggcgagucuuauauuguuaucggggcuggagaaaaggcccuuaagcucagcugguucaaaaagggcuccucuauugggaaaauguuugaggccacagcucggggcgccagacgcauggcuauccugggagauaccgccugggacuucggcagcaucgggggagucuuuacauccgugggcaagcuggugcaucagauuuucgggaccgcguacggaguccucuuuagcggcgugucuuggacgaugaaaaucgggauuggcguucugcuuaccuggcugggacucaauucccggagcacaucucuguccaugaccuguaucgccgugggccuggucacacuuuaccucggggugaugguucaggcugauagcggaugcgugauuaacuggaagggcagagaacugaaguguggguccggaaucuucgucaccaaugaggugcacacauggaccgaacaauauaaauuucaggccgacucuccuaagcgccugagcgcugccauuggcaaagcgugggaggaggggguuugcggcauccgguccgccacgagacucgaaaacaucauguggcgccagauuucuaacgagcugaaucauauccuucuggaaaacgacaugaaguucacaguggucgugggagauguggucggcauucucgcucaggggaaaaagaugauccggccgcaacccauggagcacaaauacagcuggaaguccuggggaaaggccaaaauuaucggcgcugacguucagaauaccaccuuuaucauugaugggccuaacacacccgaauguccugacgaucagagagccuggaauaucugggagguggaggacuauggauucggcauuuuuaccacgaacaucuggcugaagcugcgcgauagcuacacacaggugugcgaccaccggcuuaugucugccgcuauuaaagauuccaaggcgguccaugccgacaugggcuauuggaucgaaagcgagaaaaaugaaaccuggaagcucgcuagagccucuuucaucgaggugaagacauguauuuggcccaaaucccacacccuguggagcaacgggguucuggaaucugagaugaucauuccgaagaucuacggaggcccuauuagccaacauaauuaucgccccggguacuucacacagaccgccggaccuuggcaccucggcaaacuggagcuugauuuugaccugugcgaagggacgaccguggucguggaugagcacugcggaaaccggggccccucccucagaacaaccacaguuaccggcaagaucauccaugaaugguguugccggagcuguacgcugccuccccugcgcuucaaaggggaggacggaugcugguacggcauggagauuagaccggugaaggaaaaggaggaaaaucuugucaaaucuaugguguccgcugggagcggagagguugacuccuuuucucucggccugcuguguaucagcauuaugaucgaagaggugaugcgguccagauggucucgcaagaugcucaugacagggacccuggccgucuucuuucuucugauuaugggacagcucacauggaacgaucugauccggagcugcauuauggugggcgcgaaugcuuccgacagaaugggcauggggaccaccuaucuggcccuuauggccacauucaaaaugcgcccuauguuugcugugggacuccuguucagacggcugacgucucgcgagguccuccugcuuaccaucggccugagccucguugccuccguggaacugcccaacagccuggaggaacuuggggauggacuggcgaugggcaucaugauucucaagcugcucacagacuuucaaucuuaccagcugugggcuacccuucugucccucacauucaucaaaaccacguuuagccugcacuaugccuggaagacaauggccauggugcugucuauugucucccuucugccccucugucugagcaccaccucucagaagacaaccuggcucccugugcugcuugggucccugggaugcaaaccgcugacaauguuccucaucgcugagaauaagauuuggggcagaaaaagcuggccccugaacgaaggcaucauggccguugggaucguguccauucuucugagcucucuccugaagaacgaugucccucucgcuggaccccugaucgccggcgggaugcuuauugcguguuacgugaucagcggauccucugccgaccugagccuggagaaagcugccgagguuuccugggaagaggaagcugagcauucuggcgccagccacaauauucucguggaaguccaggaugacgggacgaugaagaucaaagaugaggagcgggacgauacccugacaauccuucugaaggccacccuccuggcuguguccggagucuauccucucucuauucccgcgacacuguuugugugguacuucuggcaaaagaaaaagcagcgcagcggcguucuuugggacaccccuagcccucccgaaguggagagagccguccuggaugacggcaucuaucggauuaugcagcgcgggcugcucggaagaagccaggugggcguugggguguuccaagaaaacgucuuucauacgauguggcacgugacccggggagcugugcugauguaccagggcaaacgccuugagcccucuugggccuccguuaagaaagaccugaucagcuacgggggaggcuggagacuccagggcucuuggaauacaggggaggaaguccaggugauugccguggagcccggaaagaacccuaagaauguccaaaccgcucccggcacauucaaaaccccggaaggggaggugggagccaucgcgcuggauuuuaagccuggcacauccgggagccccauuguuaaccgggaaggaaaaaucgugggccucuauggcaauggggucgugacgaccuccggaacauacguuucugcuaucgcccaggccaaggcuagccaggagggcccucugcccgagauugaagacgagguguucagaaaacgcaaccuuaccaucauggaucugcaccccggguccggaaagacccggagauaucugccugccauuguccgcgaagcgaucaagcggaaacucagaacacugauucuugcuccgacgcgcgugguugccagcgagauggccgaagcucugaagggcaugcccauccgguaccaaaccacagccgugaaaucugagcauaccgggagagagaucgucgaccucaugugccacgcuacauuuaccaugcgccugcuguccccugugcgggugcccaauuauaacaugauuaucauggaugaagcccauuucacggacccuagcucuauugcggccagaggcuacaucagcacacgggucggaaugggcgaggcugccgcuauuuuuaugaccgccacacccccuggguccguugaagccuucccgcagucuaaugcugugauccaggaugaggaacgcgacauccccgagagaagcuggaacuccggauaugaguggauuacagauuuuccuggcaagaccgugugguucguccccucuaucaaaagcgggaaugacauugcgaacugucuccggaagaauggaaagcgcgugauccagcuuuccagaaaaacauuugauaccgaauaccaaaagacgaaaaacaacgacugggacuacguugugacaaccgauauuagcgagaugggcgccaauuuccgggcugacagagucaucgauccucgccggugccugaagcccgugauucugaaagacgggccggaaagaguuauccucgccggcccuaugcccgugacagucgccucugcugcccagcgccggggaagaaucggccgcaaccacaauaaggagggggaucaguauauuuacaugggacagccccugaacaaugacgaggaucaugcgcacuggaccgaagcuaagaugcuucuggacaacaucaauacgccugagggcauuauccccgcccucuucgaaccugagcgggaaaaauccgccgcuauugauggggaguauagacugcgcggagaggccagaaagaccuuuguggaacugaugcggcgcggcgaccucccggucuggcuuagcuacaaaguggcguccgagggguuccaauauucugauagacgguggugcuuugacggcgaacgcaacaaucagguucuggaggaaaacauggauguggagaucuggacaaaggagggagaacgcaagaagcugcggcccagauggcucgacgcccgcaccuacagcgacccucuggcccuucgggaguucaaagaauuugccgcuggcagacgcuccgugucuggggaucugauccucgagauuggaaagcugccccagcaccugacacagcgggcccaaaaugcucucgacaaccuugucaugcugcauaauagcgaacagggcgggagagccuaucggcacgcgauggaggagcugccugauaccaucgaaacacucaugcugcuugcccugauugcuguucucaccggaggcgugacgcuguucuuucuguccggccgcgggcucggaaagacaagcaucggccuucugugugugauggccucuuccgcucugcucuggauggccagcgucgagccccauuggauugccgcuucuaucauccuggaguucuuucuuauggugcugcucauuccggagccugacagacagcggacaccccaggauaaccaacuggcguacguugugaucgggcuccuguucaugauucuuaccgucgccgcuaaugagaugggacugcuggaaacaaccaaaaaggaccucggcaucgggcacguggccgucgagaaccaccaucacgccacaaugcuggauguggaccuucauccugcuuccgccuggacgcuguacgcgguugccaccacaauuaucacccccaugaugcgccacacaauugaaaacaccacggcuaauaucagccucaccgccaucgcuaaccaggccgcgauucugaugggacuggauaaaggcuggccuaucucuaagauggacauuggcgugccccuccuugcccuggggugcuauagccaggucaauccgcugacacucaccgcugccgugcugaugcuuguugcucauuacgccaucauuggaccuggccugcaagcuaaagccacaagagaggcgcagaagcggaccgccgcugggaucaugaagaaccccacgguggauggaaucgucgccauugaccucgaucccgugguguaugacgcuaaauuugaaaagcagcugggccagaucaugcugcucauucuuuguacaucccaaauccugcugaugcgcaccacaugggcccucugcgagucuauuacccuggccaccgggccucuuacaacgcugugggagggaagcccgggcaaauucuggaauaccacaaucgcgguuuccauggcuaacaucuuuagaggcagcuaccucgccggggcuggacuggccuucucccugaugaagucucucggcgggggacggcgcggcaccggggcccagggagaaacacuuggcgagaaauggaagagacagcugaaucagcugagcaaguccgaguucaacaccuauaaacggucuggcauuauggaggucgacagaagcgaagcuaaggaggggcuccgccggggagagacgacaaaacacgccguguccagaggcaccgcgaagcugcgcugguuuguggaacggaaucuugucaaacccgaggggaagguuaucgaucugggauguggcagagggggauggucuuacuauugcgccggccucaagaaagugaccgaagugaagggcuacacaaaagggggaccuggccacgaggaacccauuccuauggcuaccuacggguggaaccuggucaagcugcauagcggaaaagacguguucuuuauucccccugagaagugugauacacuccuuugcgacauuggcgaguccagcccgaaucccacgaucgaagaggggcgcacccugcggguucugaaaaugguggaaccuuggcucagaggaaaccaauucuguauuaagauccugaaucccuauaugccuucugucguggagacacuugagcagaugcagcgcaagcacggcggcaugcugguucggaacccccucuccagaaauagcacccaugaaauguacugggugucuugcgggacaggaaacaucgucuccgccgugaauaugaccagccgcaugcugcugaaccgguuuacgauggcucacagaaaaccgaccuaugagcgcgauguggaccucggcgccgggacaagacacgucgcgguugaaccugagguggccaaccuggauauuaucggacagcggauugaaaauaucaagcaugagcacaaaucuaccuggcauuacgacgaggauaaccccuauaagacaugggcuuaccacggcuccuaugaagugaaacccagcggguccgccagcucuauggucaauggagugguuaaacuucugaccaagccuugggacgugauucccauggucacacaaaucgcuaugaccgauacgacaccuuucggccagcagcgcguguuuaaagagaagguugacaccagaaccccgaaagccaagcggggcacagcucaaaucauggaagugacggccagauggcucuggggguuccugagccggaacaaaaagccccgcauuuguaccagagaggaauuuacacggaagguccgcuccaaugcggccaucggagcuguguucguugacgagaaccaguggaacucugccaaagaggcuguggaagaugagagauuuugggaccuuguccaucgggaacgcgagcugcacaagcagggcaaaugcgcuaccugcguguacaacaugauggggaagagagagaagaagcucggagaguucggcaaggccaaagggagccgggcgauuugguacauguggcugggcgcucgcuuucuggaguucgaagcccucggauucaugaaugaggaucacugguuuuccagagaaaacucucugagcggcgucgagggggagggacuucauaagcugggcuauauccuccgggacauuuccaaaaucccugggggaaauauguacgccgaugacacagcuggcugggauacccgcaucacagaagacgaucugcagaacgaggccaagauuaccgacaucauggaacccgagcacgcccuucuggccacgucuauuuucaaacucaccuaucaaaauaaggugguuagagugcagcggccugcgcgcaacgggacagucauggaugugaucagcagacgggaccagagaggcuccggacaggugggcaccuacgggcugaauacauuuaccaacauggaagcccaacugauucgccagauggagagcgagggaaucuucucucccuccgaacucgagacgccgaaccuggcugaacggguucuugauuggcuggagaaacauggcguggaaagacucaagcgcauggccaucagcggggacgacugugucgugaagccuauugaugaccgguuugcuacagcccugucugcgcuuaaugauaugggaaaaguuagaaaggacaucccccagugggagccuuccaaaggcuggaacgauuggcagcaagugcccuucugcagccaccacuuucaucagcugauuaugaaggacgggcgcgagaucgucgugccuugucggaaucaggaugaacucgucggcagagcccgcgugucccagggagcuggcuggucucugcgggagaccgccugccuggggaaaagcuaugcucaaauguggcagcucauguacuuccacagacgcgaccugcggcuugccgcuaacgccauuuguuccgcgguucccguggauugggucccgacaagcagaaccacguggucuauccaugcccaccaucaguggaugaccacagaagacaugcuguccguguggaaucggguuuggauugaggaaaacccuuggauggaggauaagacccacaucagcucuuggggagacgugcccuaucucggcaagagagaggaccaauggugcgggagccugaucggacuuacagcucgcgccaccugggccacaaauauucaggucgcuaucaaccaggugcggagacugauuggcaaugaaaacuaccucgauuacaugaccuccaugaaacgcuuuaagaaugagucugaccccgaaggggcccugugguga

SEQ ID NO: 19132 - RNA, 9879 nt, Artificial Sequence
  derived and/or modified CDS sequence (opt5) from DENV-1__FJ898425__SS-prME
agcgugaccaugcugcucaugcugaugcccaccgcccuugcuuuccaccugacgacccggggcggggaaccucauaugaucgucaccaagcaggaacggggaaaaucccuccuguuuaagaccucugccggcguuaacaugugcacccuuauugccauggaccugggggagcucugugaagauaccaugacauacaaaugcccccgcaucaccgaggcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcauuggcaaacugguucaucagaucuucgggaccgcuuacggaguccucuuuuccggcgugagcuggacgaugaagauugggaucggcgugcugcuuaccuggcugggacucaauucuagauccacaagccugucuaugaccuguauugccgucggccuggugacacuuuaccucgggguuauggugcaggcugauuccggaugcgucaucaacuggaaaggccgcgaacugaagugugggagcggaauuuucgugaccaaugagguucacacauggaccgaacaauauaaguuucaggccgacuccccuaaacggcugucugcggccaucggcaaggcuugggaggagggggugugcggcaucagaagcgccacgcgccucgaaaacauuauguggaaacagaucuccaacgagcugaaucauauucuucuggaaaacgacaugaaguucacagucgugguuggagauguggucggcauccucgcucaggggaaaaagaugauucggccgcaacccauggagcacaaauacucuuggaaaagcuggggaaaggccaagaucaucggcgccgacgugcagaauaccaccuuuauuaucgaugggccuaacacacccgaauguccugacgaucagagagcuuggaauauuugggagguggaggacuauggauucggcaucuuuaccacgaacauuuggcugaagaugcgcgauuccuacacacaggucugcgaccaccggcugaugagcgcggccaucaaagauucuaaggcuguucaugccgacaugggcuauuggaucgaauccgagaaaaaugaaaccuggaaacuugccagagcuagcuucauugaggugaagacauguaucuggcccaaaucucacacccucugguccaacggggugcuggaaagcgagaugauuaucccgaagauuuacggaggcccuaucucucaacauaauuaucgccccggguacuucacacagaccgccggaccuuggcaccugggcaaacucgagcuggauuuugaccuuugcgaagggacgaccgucgugguugaugagcacugcggaaaccggggccccagccugagaacaaccacagugaccggcaagaucauucaugaaugguguugccgguccuguacgcucccuccccugcgcuucaaaggggaggacggaugcugguacggcauggagaucagaccggucaaggaaaaggaggaaaaucuggugaaaagcaugguuucugcgggguccggagagguggacagcuuuucccuuggccuccuguguauuucuaucaugauugaagaggucaugcggagcagauggucccgcaagaugcugaugacagggacccucgcuguguuccugcuucugaucaugggacagcucacauggaacgaucugauucggcugugcaucaugguuggcgccaaugccucugacagaaugggcauggggaccaccuaucuugcucugauggccacauuuaaaaugcgcccuauguucgcggugggacuccuguuuagacggcucacgagccgcgagguccugcuucugaccaucggccucucccugguggcuucuguggaacugcccaacagccuugaggaacugggggauggacucgccaugggcauuaugauccugaagcuccugacagacuuccaaucccaccagcuuugggccacccugcucagccugacauuuauuaaaaccacgcugucucuucauuacgcuuggaagacaauggccaugguccuguccaucguuagccucauuccccugugucucucuaccaccucccagaagacaaccuggcugccugugcuucuggggagccugggaugcaaaccgcucacaauguuccugaucgcugagaauaagaucuggggcagaaaaucuuggccccuuaacgaaggcauuauggccgugggggucguguccauccugcucagcucccugcucaagaacgauguuccucuggcgggaccccuuauugccggcgggaugcugaucgcuuguuaugugauuagcggaucuagcgccgaccugucccucgagaaagcugccgaggucucuugggaagaggaagccgagcacagcggcgcuucccauaauauccugguggaaguucaggaugacgggacgaugaagaucaaagaugaggagcgggacgauacccuuacaauucugcucaaggcgacccugcucgccgugucuggagucuacccucugagcauccccgcuacacuuuuugugugguauuucuggcaaaagaaaaagcagcgcuccggcguccugugggacaccccuucucccccggaaguggagagagccguucuggaugacggcauuuaccggaucaugcagcgcgggcuccugggaagaagccaggugggcgucgggguguuucaagaaaacguuuuccacacgauguggcacgugacccggggagccguccuuauguaucagggcaaacgccuggagccuuccugggcuagcgugaagaaagaccucauuucuuacgggggaggcuggagacugcagggcuccuggaauacaggggaggaagugcagguuaucgccgucgagcccggaaagaacccuaagaaugugcaaaccgcgcccggcacauucaaaaccccggaaggggaggugggagcuauugcccucgauuuuaagccuggcacaagcgggucucccaucgucaaccgggaaggaaaaaucgugggccuguacggcaaugggguugugacgaccuccggaacauaugucagcgccauugcucaggccaaggcgucccaggagggcccucuucccgagaucgaagacgagguguucagaaaacgcaaccugaccauuauggaucugcaucccgggucuggaaagacccggagauaccucccugcuaucguucgcgaagccauuaagcggaaacugagaacacuuauccuggccccgacgcgcguggucgcuagcgagauggccgaagcucucaagggcaugcccauccgguaucaaaccacagccgugaaauccgagcacaccgggaaggagauuguugaccugaugugccaugcgacauuuaccaugagacugcucagcccugugcgcguccccaauuacaacaugaucauuauggaugaagcccacuucacggacccuucuuccaucgcugcccggggcuauauuagcacaagagugggaaugggcgaggcugccgccaucuuuaugaccgcuacacccccugggucuguggaagcguucccgcagagcaaugccgucauccaggaugaggaacgggacauucccgagcgcuccuggaacucuggauacgaguggaucacagauuuuccuggcaaaaccguuugguucgugcccagcauuaaguccgggaaugacaucgcuaacugucuuagaaagaauggaaaacgggugauucagcugucucgcaagacauuugauaccgaauaucagaagacgaagaacaacgacugggacuacgucgugacaaccgauaucagcgagaugggcgccaauuucagagccgaccggguuauugauccuagacgcugccugaaacccgugauccucaaggacgggccggaacgggucauccuggcuggcccuaugcccgugacaguugccuccgcggcucagagacgcggacggauuggcagaaaccauaauaaggagggggaucaguacaucuauaugggacagccccuuaacaaugacgaggaucacgcccacuggaccgaagccaaaaugcugcucgacaacauuaauacgccugagggcaucauucccgcucuguuugaaccugagcgcgaaaagagcgccgcgaucgauggggaguaccggcugagaggagaggcccgcaaaaccuucguggaacucaugagacggggcgaccuuccggucuggcugucuuauaagguggcuuccgagggguuccaauacagcgaucgcagauggugcuuugacggcgaacggaacaaucagguccuggaggaaaacauggauguggagaucuggacaaaagagggagaacgcaagaaacucagaccccgguggcuggacgccagaaccuauuccgacccucuugcucugcgcgaguucaaggaauuugccgcuggccggagaucuguuagcggggaucucauucuggagaucggaaagcugccccagcaucucacacagcgcgcccaaaaugcgcuugacaaccuggugaugcugcacaauuccgaacagggcgggcgggccuacagacaugcuauggaggagcucccugauaccauugaaacacugaugcuucuggcccucaucgcugugcugaccggaggcgucacgcuguucuuucucucuggccgggggcuuggaaaaacaagcauuggccugcuguguguuauggccuccagcgugcuccuguggauggccucuguggagccccacuggaucgcugcguccaucauucuugaguucuuucugaugguccuccugaucccggagccugaccgccagagaacaccccaggauaaccaacuggccuaugugguuauugggcuccuuuucaugauccugaccguggcugccaaugagaugggacugcucgaaacaaccaagaaagaccugggcauugggcacgucgccguggagaaccaucaccaugcuacaaugcuugaugucgaccugcacccugccagcgcguggacgcucuacgccguggcuaccacaaucauuacccccaugaugcggcauacaaucgaaaacaccacggccaauaucucucugaccgcuauugccaaccaggcggccauccugaugggacucgauaagggcuggccuauuuccaaaauggacaucggcguuccccuucuggcucuggggugcuacagccaggugaauccgcucacacugaccgccgcuguccuuaugcugguggcccacuaugcuauuaucggaccuggccuccaagccaaggcgacacgcgaggcccagaagagaaccgcugccgggaucaugaaaaaccccacgguugauggaauuguggcuaucgaccuggaucccgucguguacgacgccaaguuugaaaaacagcugggccagauuaugcuccuuauccuguguacaucucaaauucugcucaugcggaccacaugggcccugugcgagagcaucacccuugcgaccgggccucugacaacgcucugggagggauccccgggcaaguucuggaauaccacaaucgcugugucuauggccaacauuuuucgcggcagcuaucuggcuggggccggacuggccuucucccucaugaaaagccuuggcgggggaagacggggcaccggggcucagggagaaacacugggcgagaaguggaagcgccagcugaaucagcucuccaaaucugaauuuaacaucuacaagagaagcggcauuauggagguugaccgguccgaagccaaagaggggcugaagagaggagagaccacgcgccacgcggucucucggggcacagccaaacuuagaugguucguggaacgcaaucuggugaagcccgaggggaaggucaucgaucucggauguggcagagggggauggagcuauuacugcgcuggccugaaaaagguuaccgaagugaaaggcuauaccaaagggggaccuggccaugaggaacccauuccuauggccacauacggguggaaccuggugaaacuccacuccggaaaggacgucuucuuuacacccccugagaaaugugauacacuucugugcgacaucggcgagucuagcccgaaucccacgauugaagaggggagaacccugcgcgugcucaagaugguugaaccuuggcugcggggaaaccaauucuguaucaagauccuuaaucccuacaugccuuccguggucgagacacuggagcagaugcagagaaaacauggcggcaugcucgugcgcaacccccugagcagaaauucuacccacgaaauguauuggguuuccugcgggacaggaaacauugugagcgcugucaauaugaccucuagaaugcugcucaaccgcuuuacgauggcccaccggaagccgaccuacgagaaagauguggaccugggcgcggggacaagacauguggccgucgaaccugagguugcuaaccuugauaucauuggacagcgcaucgaaaauauuaagcacgagcauaaauccaccuggcacuaugacgaggauaaccccuacaagacaugggccuaucauggcagcuacgaagugaagcccucuggguccgcuagcuccauggugaauggagucgugaaacugcucaccaagccuugggacguuauccccauggugacacaaaucgccaugaccgauacgacaccuuucggccagcagagagucuuuaaagagaagguggacacccggaccccgaaagcuaagcgcggcacaguucaaauuauggaagugacggccagauggcuguggggguuccuuagccggaacaagaaacccagaaucuguacccgggaggaauuuacacgcaaggucagaucuaaugcggccauuggagcuguguucguugacgagaaccaguggaauagcgccaaagaggcuguggaagaugagcgguuuugggaccugguccagaaggaacgcgagcuccacaaacagggcaagugcgcgaccugcguguauaacaugauggggaagagagagaagaagcugggagaguucggcaaagccaaggggucccgggcgaucugguacauguggcugggcgcucgcuuucucgaguucgaagcccugggauuuaugaaugaggaucacugguucucuagagaaaacagccuuuccggcgucgagggggagggacugcauaaacucggcuacauucugcgggacaucucuaagaucccugggggaaauauguaugccgaugacacagcuggcugggauacccgcauuacagaagacgaucuucaaaacgaggccaaaaucaccgacauuauggaacccgagcacgcucugcucgccacgagcaucuucaagcugaccuaccagaauaaggugguuagagugcagcggccugcgaaaaacgggacagucauggaugugauuucccgcagagaccagcggggcucuggacaagugggcaccuaugggcugaauacauuuaccaacauggaagcccagcucauccgccagauggagagcgagggaaucuuccugcccuccgaacuugagacgccgaaccuggcugaaagaguucucgauuggcuggagaaguacggcguggaacggcuuaaaagaauggccauuagcggggacgacugugucgugaagccuaucgaugaccgcuuugcuacagcccugaccgcgcucaaugauaugggaaaaguucggaaggacauuccccagugggagccuucuaagggcuggaacgauuggcaacaggugcccuucugcucccaucacuuucaccagcugaucaugaaagacgggagagagauugucgugccuugucgcaaucaggaugaacuggucggccgggccagagugagccaaggagcuggcuggucucuccgcgagacagccugccuggggaaguccuaugcucagauguggcagcuuauguacuuccaucggagagaccugcgccucgccgcuaacgccaucuguagcgcgguucccguggauugggucccgaccucccggacgaccuggucuauucacgcccaucaccaauggaugacaaccgaagacaugcugagcguguggaauagaguuuggaucgaggaaaacccuuggauggaggauaaaacacauguguccagcuggggagacguccccuaucuuggcaagcgcgaggaccaguggugcgggucucugaucggacucaccgcucgggccacaugggccuccaauauucagguggcuaucaaccaggugagacggcugauuggcaaugaaaacuaccuggauuacaugaccagcaugaaaagauuuaagaaugagggggaccccgaaggcgcccucugguga

SEQ ID NO: 19133 - RNA, 9879 nt, Artificial Sequence
  derived and/or modified CDS sequence (opt5) from DENV-1__FJ898426__SS-prME
agcgugaccaugcugcugaugcugaugcccacagcccuugcuuuccaccugacgaccagaggaggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgagaaucacagaagcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucgccaacccugcgguucuccgcaaacugugcauugaagccaagaucuccaauacaaccacggauagcagauguccgacacaaggagaggcuacccuuguggaagaacaagacgccaacuuugugugccggcgcaccuucgucgauagaggcuggggcaauggguguggacuguuuggcaaagggucucucauuacaugcgcuaaguucaagugcgugaccaaacuggagggaaagaucguucaguacgaaaaccuuaaauauuccgugaucgucacagugcacacgggcgaccagcaucaaguugggaaugagagcaccgaacacggaacaaccgccacaauuacaccccaggccccuucuacggagauccagcugaccgacuacggcgcucucacacuggauuguagcccccggaccggccuggacuuuaacgaaauggugcuccugacaaugaaggagaaaagcuggcuuguccauaagcagugguuccuggaucucccucugcccuggaccuccggggcgucuacgagccaagagacauggaaucgcaaagaccuucuggugaccuuuaagacagcccacgcuaagaaacaggaagucgugguucucggaucccaggagggcgccaugcacaccgcccugaccggggcuacagaaauucaaacgagcggaaccacaaccaucuucgccggccaucugaagugcagacucaaaauggauaagcugacacuuaaagggaugucuuaugugauguguaccggcuccuucaagcuggagaaggaagucgcggagacgcagcacggaacagugcucguucagauuaaauacgagggcaccgacgcuccgugcaagaucccuuuuagcacccaggaugaaaaaggggugacacaaaacggacggcugaucaccgccaaucccauugucacagacaaggagaaaccugugaacaucgaagccgagccgcccuucggcgagucuuauauugugaucggggcuggagaaaaggcccugaaacuuagcugguuuaaaaagggcuccucuauugggaaaauguucgaggcuacggccagaggcgcgcgccggauggccauccucggagauaccgcuugggacuuuggcagcaucgggggaguuuucacauccgucggcaagcuggugcaucagauuuuugggaccgccuacggagugcuguucagcggcgucucuuggacaaugaaaaucgggauuggcgugcuccugaccuggcuuggacucaauuccagaagcacgucucucuccaugaccuguaucgcuguuggccuggugacacuguaccuuggggucauggugcaggccgauagcggaugcguuauuaacuggaagggccgcgaacucaaguguggguccggaaucuuugugaccaaugagguccacacauggaccgaacaguauaaauuccaagcggacucuccuaagcggcugagcgccgcuauuggcaaagccugggaggagggggugugcggcaucagauccgcuacacgccuggaaaacaucauguggaagcagauuucuaacgagcucaaucauauccugcuugaaaacgacaugaaauuuaccguuguggucggagauguggccggcauucuggcccaggggaagaaaaugauccggccgcagcccauggaguacaaguauagcuggaaguccuggggaaaagcuaagauuaucggcgcggacgugcaaaauacgacauucaucauugaugggccuaacacccccgaauguccugacgaucagagagccuggaauaucugggaggucgaggacuacggauuuggcauuuucaccacaaacaucuggcucaaacugcgcgauagcuauacccagguuugcgaccaccggcugaugucugcugccauuaaggauuccaaagccgugcacgcugacaugggcuacuggaucgaaagcgagaagaaugaaacguggaaacuugccagagcgucuuucaucgaggugaaaacauguauuuggcccaagucccauacccucuggagcaacgggguccuggaaucugagaugaucauuccgaaaaucuauggaggcccuauuagccagcacaauuaccgccccggguacuuuacacaaaccgcuggaccuuggcaucugggcaagcucgagcuggauuucgaccuuugcgaagggacaaccgugguuguggaugagcacugcggaaaccggggccccucccugagaacgaccacagucaccggcaaaaucauccacgaaugguguugccggagcuguacacucccuccccugcgcuuuaagggggaggacggaugcugguauggcauggagauuagaccggugaaggaaaaagaggaaaaucugguuaagucuaugguguccgccgggagcggagaggucgacuccuucucucuuggccuccuguguaucagcauuaugaucgaagaggugaugcgguccagauggucucgcaaaaugcugaugaccgggacgcucgccgucuuuuuccugcuuauuaugggacagcugacauggaacgaucucauccggcugugcauuauggugggcgcuaaugccagcgacagaaugggcauggggaccacauaccuggcgcuuauggcuaccuuuaagaugcgcccuauguucgccgucggacugcucuuuagacggcugaccucccgcgaggugcuccugcuuacaaucggccugucucucguggccagcgucgaacugcccaacucccuggaggaacuuggggauggacuggcuaugggcaucaugauucucaaacugcucacggacuuccagagccaucaacugugggccacccuucugucucucacauuuaucaagaccacauucucccugcacuaugcuuggaagaccauggccaugguucugagcauugugucucuuuuuccccugugucucuccacgacaagccagaaaaccaccuggcugccugugcuccuggggucucuuggaugcaagccgcugacaauguuccugaucgcggagaauaaaauuuggggcagaaaguccuggccccucaacgaaggcaucauggccgucgggaucgugagcauucugcuuuccagccugcucaaaaacgauguuccucuggcuggaccccucaucgccggcgggaugcugauugcuuguuacgugaucucuggaagcuccgccgaccuuucucuggagaaggccgcugaggucagcugggaagaggaagcggagcauuccggcgccucucacaauauucugguggaaguucaggaugacgggaccaugaaaaucaaggaugaggagcgggacgauacacucacgauccugcuuaaggcuacccugcucgccgugagcggagucuauccucuguccauucccgccacacucuucgugugguacuuuuggcagaaaaagaaacaacgcucuggcguccugugggacaccccuuccccucccgaaguggagagagcuguucuugaugacggcaucuaucggauuaugcagcgcgggcugcugggaagaucccaggugggcgucgggguguuccaggaaaacguuuuucauacaauguggcacgugacccggggagccguccucauguaccaaggcaagcgccuggagcccagcugggcgucugugaaaaaggaccuuaucuccuacgggggaggcuggagacugcagggcagcuggaauacgggggaggaagugcagguuauugcugucgagcccggaaagaacccuaaaaaugugcagaccgcccccggcacauucaagaccucugaaggggaggugggagccaucgcucucgauuuuaaaccgggcacauccgggagcccuauugucaaccgggaaggaaagaucgugggccuguauggcaaugggguugugaccacauccggaacguacgucucugccaucgcgcaagcuaaagccagccaggagggcccccucccugagauugaagacgagguguucagaaagcgcaaccugaccaucauggaucuucaccccggguccggaaagacacggagauaucugcccgccauuguucgcgaagcuaucaaacggaagcugagaacccucauucuggccccuacccgcguggucgcuagcgagauggccgaagcgcuuaaaggcaugccgauccgguaccagacaacggccgugaagucugagcauaccgggaaagagaucguugaccugaugugccacgcuacauuuaccaugagacuccugucccccgugcgcgucccuaauuauaacaugauuaucauggaugaagcccauuucacagaccccagcucuauugcugcccggggcuacaucagcaccagagugggaaugggcgaggccgcugcgauuuuuaugacggccacaccucccggguccguggaggcuuucccucaaucuaaugccgucauccaggaugaagaacgggacaucccggagcgcagcuggaacuccggauaugaguggauuaccgauuuucccggcaagaccguuugguucgugccuucuaucaagagcgggaaugacauugccaacugucugcgcaagaauggaaagcgggugauccagcucucccgcaaaacauucgauaccgaauaccagaagaccaagaauaacgacugggacuacgucgugaccacggauauuagcgagaugggcgcuaauuuuagagccgaccggguuaucgaucccagacgcugccuuaagccugugauucugaaggacgggcccgaacgggucauccuggcgggcccgaugccugugacaguugcuucugccgcccaaagacgcggacggaucggcagaaaccacaauaaagagggggaucaguauauuuacaugggacagccccucaacaaugacgaggaucaugcucacuggaccgaagccaagaugcugcuugacaacaucaauacacccgagggcauuaucccugcgcuguucgaacccgagcgcgaaaaauccgccgcuauugauggggaguaucggcucagaggagaggcccgcaagaccuuuguggaacugaugagacggggcgaccugccugucuggcucagcuacaaaguggcuuccgagggguuccaguauucugaucgcagauggugcuuugacggcgaacggaacaaucaaguccuugaggaaaacauggauguggagaucuggacgaaggagggagaacgcaaaaagcugagaccgcgguggcuggacgccagaaccuacagcgacccccucgcucugcgcgaguucaaggaauuugccgcgggccggagauccguuucuggggaucuuauccuggagauuggaaaacucccucagcaccugacacagcgcgcccagaaugcucuggacaaccucgugaugcuucauaauagcgaacaaggcgggcgggccuauagacacgcuauggaggagcugcccgauaccaucgaaacacugaugcuccuggcccuuauugccgugcugaccggaggcgucacacucuucuuucuguccggccgggggcugggaaagaccagcaucggccuccuuuguguuauggcuucuuccgugcugcuguggauggcgagcguggagccucauuggauugccgcuucuaucauccucgaguucuuucugaugguccuucugauucccgagccggaccgccagagaacgccucaggauaaccagcucgccuacgugguuaucgggcugcuguucaugauucucacaguggccgcuaaugagaugggacuucuggaaaccaccaaaaaggaccugggcaucgggcacgucgccguggagaaccaccaucacgcggccaugcucgaugucgaccugcaucccgcuuccgccuggacacuuuacgcuguggccaccacaauuaucacgccuaugaugcggcacaccauugaaaacacaaccgcgaauaucagccugacagccaucgcuaaccaagccgcuauucucaugggacuggauaaaggcuggcccaucucuaagauggacauuggcguuccucugcucgcccuugggugcuauagccaggugaauccccugacccugacggcugccguccucaugcugguggcgcauuacgccaucauuggaccgggccuucaggcuaaggccacccgcgaggcucagaagagaacagccgccgggaucaugaagaacccuaccguugauggaaucguggcgauugaccuggaucccgucguguaugacgcuaaauuugaaaagcagcucggccagaucaugcugcugauucucuguacaucccagauccuucugaugcggaccacgugggcccugugcgagucuauuacacucgcuaccgggccccugacaacccuuugggagggaagcccuggcaaauucuggaauaccacaaucgccguguccauggccaacaucuuccgcggcagcuaccuggcuggggccggacucgcguuuucccugaugaagucucugggcgggggaagacggggcacgggggcccaaggagaaacccucggcgagaaguggaaacgccagcuuaaucagcugagcaaguccgaguucaacacauauaaaagaucuggcauuauggagguugaccggagcgaagcuaaggaggggcugaaaagaggagagaccacaaagcacgccgucucccgcggcaccgcuaagcuccggugguuuguggaaagaaaucuggugaaaccggaggggaaggucaucgaucuuggauguggccgcgggggauggucuuacuauugcgccggccugaaaaagguuacggaagugaaaggcuacacaaaagggggacccggccacgaggaaccuauucccauggcgaccuacggguggaaccucgugaaacugcauagcggaaaggacgucuucuuuaucccucccgagaagugugauacccugcucugcgacauuggcgaguccagcccuaauccgacaaucgaagaggggcggacccuuagagugcugaaaaugguugaacccuggcugcgcggaaaccaguucuguauuaagauccucaauccuuauaugcccucuguggucgagacacuggagcaaaugcagcggagacacggcggcaugcuugugcgcaacccucugucccggaauagcacgcaugaaauguacuggguuucuugcgggaccggaaacaucguguccgccgucaauaugacaagcagaaugcuccugaaccgcuuuaccauggcucaccggaaacccacauaugagagagauguggaccugggcgccgggacccgccacguggcugucgaaccggagguugccaaccucgauauuaucggacagagaauugaaaauaucaagcaugagcacaaaucuacguggcauuacgacgaggauaacccuuauaagaccugggcuuaccacggcuccuaugaagugaagcccagcggguccgccagcucuauggugaauggagucgugaaacugcuuacaaagcccugggacguuauuccuauggugacccagaucgcgaugacagauaccacacccuucggccaacagcgggucuuuaaagagaagguggacacccgcacgccuaaagccaagagaggcacagcucagaucauggaaguuaccgccaaguggcuguggggguuccucagccggaacaaaaagccgagaauuuguacccgggaggaauuuacacgcaaagugagauccaaugcugccaucggagccgucuucguggacgagaaccaauggaacucugcgaaggaggcuguugaagaugagcgguuuugggaccuggugcaucgcgaaagagagcuucacaaacagggcaagugcgccacgugcgucuacaacaugauggggaagcgggagaaaaagcugggagaguucggcaaagccaaggggagccgcgcuauuugguacauguggcucggcgccagauuccuggaguuugaagcucugggauucaugaaugaggaucacugguuuucccgggaaaacucucucagcggcguggagggggagggacugcauaaacuuggcuauauccugcgcgacauuuccaagauccccgggggaaauauguacgccgaugacaccgcgggcugggauacaagaaucaccgaagacgaucuccagaacgaggccaaaauuacagacaucauggaaccugagcacgcucugcuugccaagucuauuuucaagcugaccuaucagaauaaagucgugcggguucaacgccccgcuaagaacgggacagugauggaugucaucagcagacgggaccagcgcggcuccggacaggugggcaccuacgggcucaauacguuuaccaacauggaagcccagcugauuagacaaauggagagcgagggaaucuucucuccuuccgaacuggagacacccaaccucgcgggccgggugcuggauuggcuugaaaaacaugggguugagagacugaagcgcauggccaucagcggagacgacuguguggucaaaccgauugaugaccgguuugcuaccgcccucacagcucugaaugauaugggcaaggugagaaaggacaucccucagugggaacccucuaaaggguggaacgauuggcagcagguuccuuucugcucccaccacuuucaucaacuuauuaugaaggacggccgcgagaucgugguccccugucggaaucaggaugagcuggugggcagagcccgcgucagccagggcgcuggguggucccuccgggaaaccgccugccugggaaaaucuuaugcgcagauguggcaacugauguacuuccacagacgcgaccuccggcuggccgcuaacgccauuuguagcgccgugccuguugauugggugcccacguccagaacaaccuggagcauccaugcucaccaucaguggaugacaaccgaggacaugcuuucugucuggaaucgcguguggauugaagagaacccguggauggaagauaagacgcacaucuccagcuggggcgacguuccuuaucuggggaaacgggaggaccaguggugcggaucucucaucggccugaccgccagagcgacaugggcuaccaauauucaaguggccaucaaccagguccggagacuuauugggaaugagaacuaccuggauuacaugacaagcaugaagcgcuuuaagaaugaauccgaccccgagggcgcccucugguga

SEQ ID NO: 19134 - RNA, 9879 nt, Artificial Sequence
  derived and/or modified CDS sequence (opt5) from DENV-1__GQ199856__SS-prME
agcgugaccaugcugcucaugcugaugcccaccgcccuugcuuuccaccugacgaccagaggcggggaaccucauaugaucgucuccaagcaggaacggggaaaaucucuccuguuuaagacaagcgccggcguuaauaugugcacccuuguggcgauggaccugggggaguucugugaagauacaaugaccuacaaaugcccgcgcaucacagaagcugaacccgacgauguggacuguuggugcaaugccaccgauacgugggucaccuauggaacauguucccagaccggcgaacaccggcgggacaagcgcucuguggcccucgcuccucauguugggcugggacuggagacaagaaccgaaacguggaugagcuccgagggcgccuggaaacagauccagcggguggaaacaugggcucuccgccaccccggcuuuaccgucauugcccuguuccuugcgcaugccaucgggacaucuauuacccagaagggaaucaucuuuauucugcucaugcuggugaccccuagcauggcuaugagaugcguuggcaucgggucccgggauuucguggagggacuuagcggcgccacaugggucgacguggugcuggagcacgggucuugugucacgaccauggcuaaggauaaacccacacucgacauugaacugcugaagaccgagguuacaaacccugccgugcuccgcaaacugugcaucgaagcgaagauuuccaauaccacgacagauagcagauguccgacccaaggagaggccacccuuguggaagaacaggacgcuaacuuugucugccggcgcacauucguggauagaggcuggggcaauggguguggacuguuuggcaaagggucucucauuaccugcgccaaguucaagugcguuacaaaacuggagggaaagacggugcaguacgaaaaccuuaaauauuccgucauugugaccguucacacaggcgaccagcaucaaguggggaaugagagcaccgaacacggaacaaccgcuacgaucacaccccaggccccuucuacagagauccagcugaccgacuacggcgcccucacacuggauuguagcccccggaccggccuggacuuuaacgaaaugguccuccugacgaugaaggagaaaagcuggcuugugcauaagcagugguuccuggaucucccucugcccuggacauccggggcuucuaccagccaagagacauggaaucgcaaagaccuucuggucaccuuuaagaccgcgcacgccaagaaacaggaagugguugugcucggaucccaggagggcgcuaugcacacagcccugacgggggccaccgaaauucaaacaagcggaaccacaaccaucuucgcuggccaucugaagugcagacucaaaauggauaagcugacgcuuaaagggaugucuuaugucauguguacaggcuccuucaagcuggagaaggaaguggccgagacccagcacggaaccguucucgugcagauuaaauacgagggcacagacgcgccgugcaagaucccuuuuagcacccaggaugaaaaaggggucacacaaaacggacggcugauuacggcuaaucccaucgugaccgacaaggagaaaccugugaacaucgaagccgagccgcccuucggcgagucuuauauuguuaucggggccggagaaaaggcucugaaacuuagcugguuuaaaaagggcuccucuauugggaaaauguucgaggccacagcuagaggcgcccgccggauggcgauccucggagauaccgccugggacuuuggcagcauugggggagucuucacauccgugggcaagcuggugcaucagaucuuugggaccgcuuacggaguccuguucagcggcgugucuuggacgaugaaaaucgggauuggcguucuccugaccuggcuuggacucaauuccagaagcacaucucucuccaugaccuguaucgccgugggccuggucacacuguaccuuggggugaugguucaggcugauagcggaugcgugauuaacuggaagggccgcgaacucaaguguggguccggaaucuuugucaccaaugaggugcacacauggaccgaacaguauaaauuccaagccgacucuccuaagcggcugagcgcggccauuggcaaggcuugggaggaggggguuugcggcaucagauccgccacgcgccuggaaaacauuauguggaagcagaucucuaacgagcucaaucauauccugcuugaaaacgacaugaaauuuacaguggucgugggagauguggcuggcauucuggcccaggggaagaaaaugauccggccgcagcccauggaguacaaguauagcuggaaguccuggggaaaagccaagauuaucggcgcugacguccaaaauaccaccuucauuaucgaugggccuaacacacccgaauguccugacgaucagagagcguggaauaucugggagguugaggacuacggauuuggcauuuucaccacgaacaucuggcucaaacugcgcgauagcuauacacaggugugcgaccaccggcugaugucugccgcuauuaaggauuccaaagccgugcacgccgacaugggcuacuggaucgaaagcgagaagaaugaaaccuggaaacuugcuagagccucuuucauugaggucaagacauguaucuggcccaagucccauacccucuggagcaacggggugcuggaaucugagaugaucauuccgaaaaucuauggaggcccuauuagccagcacaauuaccgccccggguacuuuacacaaaccgcgggaccuuggcaucugggcaagcucgagcuggauuucgaccuuugcgaagggacgaccguuguggucgaugagcacugcggaaaccggggccccucccugagaacaaccacagugaccggcaaaaucauucacgaaugguguugccggagcuguacgcucccuccccugcgcuuuaagggggaggacggaugcugguauggcauggagaucagaccgguuaaggaaaaagaggaaaaucuggugaagucuauggucuccgcugggagcggagagguggacuccuucucucuuggccuccuguguaucagcauuaugaucgaagagguuaugcgguccagauggucucgcaaaaugcugaugacagggacccucgccguguuuuuccugcuuauuaucggacagcugacauggaacgaucucauucggcugugcaucauggucggcgccaaugcuagcgacagaaugggcauggggaccaccuaccuggcccuuauggcgacauuuaagaugcgcccuauguucgcugugggacugcucuuuagacggcugacgucccgcgaggugcuccugcuuaccauuggccugucucucgucgccagcguugaacugcccaacucccuggaggaacuuggggauggacuggccaugggcaucaugauccucaaacugcucacagacuuccagagccaucaacugugggcuacccuucugucucucacauuuauuaagaccacguucucccugcacuaugccuggaagacaauggcuauggugcugagcaucgugucucuuuuuccccugugucucuccaccaccagccagaaaacaaccuggcugccuguccuccuggggucucuuggaugcaagccgcugacaauguuccugauugccgagaauaaaaucuggggcagacgguccuggccccucaacgaaggcauuauggcgguggggaucguuagcauccugcuuuccagccugcucaagaacgaugugccucuggccggaccccucauugcuggcgggaugcugaucgccuguuacgucauuucuggaagcuccgcugaccuuucucuggagaaagccgccgaggugagcugggaagaggaagcugagcauuccggcgcgucucacaauauccugguugaagugcaggaugacgggacgaugaagauuaaagaugaggagcgcgacgauacccucacaauccugcuuaaggccacccugcucgcugucagcggaguguauccucuguccauccccgccacacucuucgucugguacuuuuggcagaagaaaaagcaaagaucuggcgugcugugggacaccccuuccccucccgaaguugagcgggccgugcuugaugacggcauuuaucgcaucaugcagagagggcugcugggacggucccaggucggcguggggguuuuccaggaaaacguguuucauacgauguggcacgucacccgcggagcugugcucauguaccaaggcaaaagacuggagcccagcugggccucugugaagaaagaccuuauuuccuacgggggaggcuggcggcugcagggcagcuggaauacaggggaggaaguucaggucaucgcgguggagcccggaaagaacccuaagaaugugcagaccgcucccggcacauucaaaaccucugaaggggaggucggagccauugcccucgauuuuaagccgggcacauccgggagcccuaucgugaacagagaaggaaaaauuguuggccuguauggcaaugggguggucacgaccuccggaacauacgugucugcuaucgcccaagcgaaggcuagccaggagggcccccucccugagaucgaagacgagguuuuccgcaaacggaaccugaccauuauggaucuucaccccggguccggaaagaccagacgcuaucugcccgccaucgugcgggaagccauuaagagaaaacugcgcacacucauccuggcuccuacgcgggucguggccagcgagauggcugaagcccuuaagggcaugccgauuagauaccagaccacagcgguuaaaucugagcauaccgggaaggagaucguggaccugaugugccacgccacauuuaccaugcgccuccugucccccguccgggugccuaauuauaacaugaucauuauggaugaagcucauuucacggaccccagcucuaucgccgcuagaggcuacauuagcacacgggugggaaugggcgaggccgccgcuaucuuuaugaccgcgaccccucccggguccgucgaagccuucccucaaucuaaugcuguuauucaggaugaggaacgcgacaucccggagagaagcuggaacuccggauaugaguggaucacagauuuucccggcaaaaccgugugguucgugccuucuauuaagagcgggaaugacaucgccaacugucugcggaagaauggaaaacgcgucauucagcucuccagaaagacauucgauaccgaauaccagaaaacgaagaacaacgacugggacuacgugguuacaaccgauaucagcgagaugggcgccaauuuucgggcugacagagugauugauccccgccggugccuuaaaccugucauccugaaggacgggcccgaaagagugauucuggccggcccgaugccuguuacaguggcgucugcugcccaacgccggggaagaaucggccgcaaccacaauaaggagggggaucaguauaucuacaugggacagccccucaacaaugacgaggaucaugcccacuggaccgaagcuaaaaugcugcuugacaacauuaauacgcccgagggcaucauuccugcccuguucgaacccgagcgggaaaaguccgcggccaucgauggggaguauagacuccgcggagaggcuagaaaaaccuuugucgaacugaugcggcgcggcgaccugccuguguggcucagcuacaaggucgccuccgagggguuccaguauucugauagacgguggugcuuugacggcgaacgcaacaaucaagugcuugaggaaaacauggauguugagauuuggacaaaagagggagaaagaaagaaacugcggccgagauggcuggacgcucgcaccuacagcgacccccucgcccugcgggaguucaaggaauuugcugccggcagacgcuccgugucuggggaucuuauccuggagaucggaaagcucccucagcaccugacacagcgggcgcagaaugcccuggacaaccucgugaugcuucauaauagcgaacaaggcgggagagcuuaucggcacgccauggaggagcugcccgauaccauugaaacacugaugcuccuggcucuuaucgccguccugaccggaggcguuacgcuguucuuucuguccggccgcgggcugggaaaaacaagcauuggccuccuuugugugauggccucuuccgugcugcuguggauggcuagcgucgagccucauuggaucgcggccucuauuauccucgaguucuuucugauggugcuucugauccccgagccggacagacagcggaccccucaggauaaccagcucgcuuacguugugauugggcugcuguucaugauccucaccgucgccgccaaugagaugggacuucuggaaacaaccaagaaagaccugggcauugggcacguggcugucgagaaccaccaucacgccgcgaugcucgauguggaccugcaucccgccuccgcuuggacacuuuacgccguugcuacgaccaucauuacaccuaugaugcgccacaccaucgaaaacacaaccgccaauauuagccugacggcgaucgccaaccaagcugccauccucaugggacuggauaagggcuggcccauuucuaaaauggacaucggcgugccucugcucgcucuugggugcuauagccaggucaauccccugacccugacagccgcugugcucaugcugguugcccauuacgcgauuaucggaccgggccuucaggccaaggcuaccagagaggcccaaaagcggacagcugccgggauuaugaaaaacccuaccguggauggaaucgucgccaucgaccuggaucccgugguguaugacgcgaaguuugaaaaacagcucggccagauuaugcugcugauccucuguacgucccagauucuucugaugcgcacaaccugggcucugugcgagucuaucacacucgccaccgggccccugaccacacuuugggagggaagcccuggcaaguucuggaauacgaccauugcuguuuccauggccaacaucuucagaggcagcuaccuggccggggcuggacucgccuuuucccugaugaaaucucugggcgggggacggcgcggcacaggggcgcaaggagaaacccucggcgagaaguggaagagacagcuuaaucagcugagcaaauccgaguucaacacauauaagcggucuggcaucauggaggucgacagaagcgaagccaaagaggggcugaagcgcggagagaccacgaaacacgcugugucccggggcacagccaagcucagaugguuuguggaacgcaauuucgucaagccggaggggaaaguuauugaucugggauguggcagagggggauggucuuacuauugcgcuggccuuaagaaagugaccgaagugaagggcuacaccaaagggggacccggccacgaggaaccuauccccauggccacauacggguggaaccuggucaagcuccauagcggaaaagacguguuuuucauuccucccgagaagugugauacccugcugugcgacaucggcgaguccagcccuaauccgacaauugaagaggggagaacgcuccgcguucuuaagaugguggaacccuggcugcggggaaaccaguuuuguaucaaaauucugaauccuuauaugcccucugucguggagacccucgagagaaugcaacgcaagcacggcggcaugcugguucggaacccucuuuccagaaauagcacacaugaaauguacugggugucuugcgggaccggaaacaucgucuccgcggugaauaugacaagccgcaugcugcucaaccgguucaccauggcccacagaaaacccacguaugagcgcgauguggaccugggcgcugggaccagacacgucgccguugaaccggagguggcuaaccuggauaucauuggacagcggaucgaaaauauuaagcaugagcacaaacucacauggcauuacgacgaggauaacccuuauaagaccugggccuaccacggcucuuaugaagugaagcccuccgggagcgcuuccagcauggucaauggagugguuaaacugcuuacaaagcccugggacgugaucccuauggucacccagauugccaugacagauaccacgcccuuuggccagcaacgcguguucaaagagaagguugacacaagaaccccuaaagcgaagcggggcaccgcccagaucauggaagugacagcuaaguggcuguggggguuucucucuagaaacaaaaagccgcggaucuguacgcgcgaggaguucaccagaaaaguccggagcaaugccgcuauuggagccguguuuguugacgagaaccaguggaacuccgccaaggaggcgguggaagaugagcgcuucugggaccugguccauagagaacgggagcuucacaaacaaggcaagugcgcuacaugcguguacaacaugauggggaagcgcgagaaaaagcugggagaguucggcaaagccaaggggucuagagccaucugguacauguggcucggcgcucgguuucuggaguucgaagcccugggauuuaugaaugaggaucacugguucagccgcgaaaacucccucucuggcgucgagggggagggacugcauaaacuuggcuauauucugagagacaucagcaagauucccgggggaaauauguacgcugaugacaccgccggcugggauacacggaucaccgaagacgaucuccagaacgaggcgaaaaucacagacauuauggaaccugagcacgcccugcuugcuaaguccaucuuuaagcugaccuaucagaauaaagugguucgcgugcagagacccgccaagaacgggacggucauggaugugauuucucggcgcgaccaaagaggcagcggacaggugggcaccuacgggcucaauacauucaccaacauggaagcucagcugauccggcagauggaguccgagggaauuuuuagcccuucugaacuggagacacccaaccucgccggcagaguucuggauuggcuugaaaaacaugggguggagcgccugaagcggauggcgaucuccggagacgacugugucgugaaaccgaucgaugacagauucgccaccgcucucacggcccugaaugauaugggcaagguucgcaaggacauuccucaaugggaacccagcaaaggguggaacgauuggcaacaggugccuuuuugcucucaccacuuccaucagcuuaucaugaaggacggccgggagauugucgugcccuguagaaaucaagaugagcuggucggacgcgcucgggugucccagggcgccggguggagccucagagaaacagcuugccugggaaaauccuaugcccagauguggcagcugauguacuuucaccgccgggaccucagacuggcggccaacgcuaucuguucugccguuccuguggauuggguccccaccagccgcacaaccugguccauucaugcccaccaucaauggaugacgaccgaggacaugcuuagcguguggaaucggguuuggaucgaagagaacccguggauggaagauaagacacacauuucuuccuggggcgacgugccuuaucuggggaaaagagaggaccaguggugcggaagccucaucggccugaccgcucgggccacaugggcgaccaauauccaggucgcuauuaaccaagugagacgccuuaucgggaaugagaacuaccuggauuacaugacaucuaugaagcgguucaagaaugaaagcgaccccgagggcgcccucugguga

SEQ ID NO: 19135 - RNA, 9879 nt, Artificial Sequence
  derived and/or modified CDS sequence (opt5) from DENV-1__FJ898427__SS-prME
agcgugaccaugcugcucaugcugaugcccaccgcccuugcuuuccaccugacgaccagaggcggggagccucauaugaucgugacaaagcaggaacggggaaaaucccuccuguuuaagaccucugccggcguuaauaugugcacccuuauugcgauggaccugggggagcucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuuguuacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaggaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacguccagaauaccaccuuuaucaucgaugggccuaacacacccgaauguccugacgaucagagagcuuggaauauuugggagguugaggacuauggauucggcaucuuuaccacgaacauuuggcugaagcugcgcgauuccuacacacaggugugcgaccaccggcuuaugagcgcggccaucaaagauucuaaggcugugcaugccgacaugggcuauuggauugaauccgagaaaaaugaaaccuggaagcucgccagagcuagcuucaucgaggucaagacauguaucuggcccaaaucucacacccugugguccaacggggugcuggaaagcgagaugauuaucccgaagauuuacggaggcccuaucucucaacauaauuaucgccccggguacuucacacagaccgccggaccuuggcaccucggcaaacuggagcuugauuuugaccugugcgaagggacgaccguuguggucgaugagcacugcggaaaccggggccccagccucagaacaaccacagugaccggcaagauuauccaugaaugguguugccgguccuguacgcugccuccccugcgcuucaaaggggaggacggaugcugguacggcauggagaucagaccgguuaaggaaaaggaggaaaaucuugugaaaagcauggucucugcgggguccggagagguggacagcuuuucccucggccugcuguguauuucuaucaugauugaagagguuaugcggagcagauggucccgcaagaugcucaugacagggacccuggcuguguuccuucugcucaucaugggacagcugacauggaacgaucugauucggcuuugcaucauggucggcgccaaugccucugacagaaugggcauggggaccaccuaucuggcucucauggccacauuuaaaaugcgcccuauguucgcggugggacugcucuuuagacggcugacgagccgcgaggugcuucugcucaccauuggccugucccuggucgcuucuguugaacuucccaacagccuggaggaacucggggauggacuggccaugggcaucaugauccucaagcugcuuacagacuuccaaucccaccagcugugggccacccuccugagccugacauuuauuaaaaccacgcuuucucugcauugugcuuggaagacaauggccauggugcucuccaucgcuagccuguucccccucugccugucuaccaccucccagaagacaaccuggcuuccugugcugcuggggagccucggauguaaaccgcugacaauguuucuuauuacggagaccaagaucuggggcagaaaaucuuggccccugaaugaaggcauuauggccgucggggugguuuccauccuccugagcucccuccugaagaacgaugugccucuugcgggaccccugaucgccggcgggaugcugauugcuugcuacgucaucagcggaucuagcgccgaccucucccuggagaaagcugccgaggugucuugggaagaggaagccgagcacagcggcgcuucccauaacauucuuguugugguccaggaugacgggacaaugaagaucaaagaugaggaacgggacgauacccugacaauucuccugaaggcgacccuccuggccgugucuggagucuauccucuuagcauccccgcuacgcuguucgugugguacuuuuggcaaaagaaaaagcagcgcuccggcguucugugggacaccccuucucccccggagguggaaagagccguccucgaugacggcaucuaucggauuaugcagcgcgggcugcuuggaagaagccaggugggcguugggguguuccaagagaaugucuuccacacaauguggcacgugacccggggagccgugcugauguaccagggcaaacgccucgaaccuuccugggcuagcguuaagaaagaccugaucucuuaugggggaggcuggagacuccagggcuccuggaacacaggggaggagguccaggugauugccguggaacccggaaagaauccuaagaacguccaaaccgcgcccggcacauuuaaaacgccggagggggaagugggagcuaucgcccuggauuucaagccuggcaccagcgggucucccauuguuaaucgggagggaaaaaucgugggccuuuacggcaacggggucgugacaaccuccggaaccuacguuagcgccauugcucaggccaaggcgucccaggaaggcccucugcccgagaucgaggacgaaguguuuagaaaacgcaaucugacaaucauggaucuccaucccgggucuggaaagacgcggagauaucugccugcuauuguccgcgaggccaucaagcggaaacuuagaacccugauucucgccccgacacgcgugguugcuagcgaaauggccgaggcucugaagggcaugcccauccgguaccaaaccacagccgugaaauccgaacacaccgggaaggagauugucgaccugaugugucaugcgacguucacaaugagacuccuuagcccugugcgcgugcccaacuauaauaugaucaucauggaugaggcccacuuuaccgacccuucuuccauugcugcccggggcuacaucagcaccagagucggaaugggcgaagcugccgccauuuucaugacagcuacacccccugggucuguugaggcguuuccgcagagcaacgccgugauccaggaugaggaacgggacauucccgaacgcuccuggaacucuggauaugaguggaucacagauuucccuggcaaaaccgugugguuuguccccagcaucaaguccgggaacgacauugcuaauugccugagaaagaacggaaaacgggugauccagcugucucgcaagacguucgauacagaguaccagaagaccaagaauaacgacugggacuauguugugacaaccgauauuagcgaaaugggcgccaacuuuagagccgaccgggucaucgauccuagacgcugccucaaacccgugauucugaaggacgggccggagcggguuauccuugcuggcccuaugcccgugacggucgccuccgcggcucagagacgcggacggauuggcagaaaucauaacaaggaaggggaucaguacaucuacaugggacagccccugaauaacgacgaggaucacgcccacuggaccgaggccaaaaugcuccuggacaauaucaacacaccugaaggcauuauccccgcucuguucgagccugaacgcgaaaagagcgccgcgauugauggggaauaucggcucagaggagaggcccgcaaaaccuucguggagcuuaugagacggggcgaccugccggucuggcugucuuacaagguggcuuccgaaggguuucaauauagcgaucgcagaugguguuucgacggcgagcggaauaaccagguucucgaagagaauauggauguggaaaucuggacaaaagagggagagcgcaagaaacugagaccccgguggcuugacgccagaaccuacuccgacccucuggcucuccgcgaauuuaaggaguucgccgcuggccggagaucugugagcggggaucugauucuggaaaucggaaagcucccccagcaucuuacacagcgcgcccaaaacgcgcuggacaaucuggucaugcuccacaacuccgagcagggcgggcgggccuauagacaugcuauggaggaacugccugauaccaucgagacgcuuaugcugcucgcccugauugcuguucugacaggaggcgugacccucuuuuuccuuucuggccgggggcugggaaaaaccagcaucggccugcucugcgugauggccuccagcguccugcuuuggauggccucuguggaaccccacuggauugcugcguccaucauucuggaguuuuuccucaugguucugcugaucccggaaccugaccgccagagaacaccccaggauaaucaacucgccuacguggucaucgggcuucuguuuaugauucugaccguggcugccaacgagaugggacuccuggagacaacgaagaaagaccuuggcaucgggcacgucgccguggaaaaucaucaccaugcuaccaugcuggauguugaccuccacccugccagcgcguggacacuguaugccguggcuaccacaauuaucacccccaugaugcggcauacgauugagaacaccacagccaacaucucucugaccgcuauugccaaucaggcggccauccucaugggacuugauaagggcuggccuaucuccaaaauggacauuggcgucccccugcuggcucucggguguuacagccaggugaacccgcugacacuuaccgccgcuguucugaugcucguggcccacuacgcuaucauuggaccuggccugcaagccaaggcgacgcgcgaagcccagaagagaacagcugccgggaucaugaaaaaucccaccgucgauggaauuguggcuaucgaccuggaucccgugguuuaugacgccaaguucgagaaacagcucggccagaucaugcuucugauucugugcacaucucaaauccuccugaugcggaccaccugggcccuuugugaaagcauuacacuggcgacggggccucucaccacacugugggagggauccccgggcaaguuuuggaacaccacaaucgcugucucuauggccaauauuuuccgcggcagcuaccuggcuggggccggacucgccuuuucccuuaugaaaagccugggcgggggaagacggggcaccggggcucagggagagacgcugggcgaaaaguggaagcgccagcucaaccagcuguccaaaucugaguucaauaucuauaagagaagcggcaucauggaaguggaccgguccgaggccaaagaagggcuuaagagaggagagacaacccgccacgcggugucucggggcaccgccaaacugagaugguucgucgagcgcaaccucguuaagcccgaagggaaggugauugaucugggaugcggcagagggggauggagcuacuauugugcuggccugaaaaaggugacagaggucaaaggcuacaccaaagggggaccuggccaugaggagcccaucccuauggccacauauggguggaaucucgugaaacuucacuccggaaaggacgucuuuuucacgcccccugaaaaaugcgauacccugcugugugacauuggcgagucuagcccgaaccccacaaucgaggaagggagaacccuccgcgugcugaagauggucgagccuuggcuucggggaaaucaauuuugcauuaagauccugaaccccuacaugccuuccgugguugaaacacucgagcagaugcagagaaaacauggcggcaugcuggugcgcaauccccugagccggaacucuacccacgagauguacugggucuccugugggacgggaaauauugugagcgcugugaacaugaccucuagaaugcuccugaaucgcuucacaauggcccaccggaagccgaccuaugaaagagaugucgaccuuggcgcggggacacgccauguugccguggagccugaaguggcuaaccuggauaucaucggacagagaauugagaacaucaaacacgaacauaaguccaccuggcacuacgacgaggauaaucccuauaaaacaugggccuaccauggcagcuaugaggucaagcccucuggguccgcuagcuccauggugaacggaguugugaagcuccugaccaaaccuugggacgucauucccauggugacgcaaaucgccaugacagauaccaccccuuuuggccagcagcggguuuucaaggaaaaaguggacacacgcacgccgaaggcuaaaagaggcaccgcccaaauuauggaggucacagcgcgguggcuuuggggguuucugagcagaaauaagaagccccggaucugcacccgcgaagaguucacaagaaaagugcggucuaacgccgcuaucggagccguuuuuguggacgaaaaucaguggaacagcgcuaaggaggccgucgaggaugaacgcuucugggaccucgugcagaaagagagagaacugcacaagcagggcaaaugcgccaccugugucuacaauaugauggggaagcgggagaagaaacugggagaauuuggcaaggcgaaagggucccgcgcuauuugguauauguggcucggcgccagauuccuggaguuugaggcccuuggauucaugaacgaagaucacugguucucucgggagaauagccuguccggcguggaaggggagggacuccauaagcugggcuacauccuucgcgacauuucuaaaaucccugggggaaacauguacgcugaugacacagccggcugggauaccagaauuacggaggacgaucugcaaaaugaagcuaagaucaccgacaucauggagcccgaacacgcccuccuggcgacaagcauuuuuaaacugaccuaucagaacaagguugugcggguccagcgcccugccaagaaugggacagugauggaugugaucuccagacgggaccagcgcggcucuggacaaguuggcaccuacgggcucaacacguucacaaauauggaggcucagcugauuagacagauggaaagcgagggaaucuuucuucccuccgagcuggaaaccccgaaccucgccgagcgggugcuggauuggcuugaaaaauauggcgucgagagacugaagcgcauggcuauuagcggggacgacugcgugguuaaaccuaucgaugaccgguucgccacagcgcucaccgcccugaacgauaugggaaaggugagaaaagacaucccccagugggaaccuucuaagggcuggaaugauuggcaacagguccccuuuuguucccaucacuuccaccagcugauuaugaaggacgggcgcgagaucguggucccuugccggaaccaggaugagcucgugggcagagcucgcguuagccaaggagccggcuggucucugcgggaaacggcuugucuugggaaauccuacgcccagauguggcagcugauguauuuucauagacgcgaccuccggcuggcugccaaugcgauuugcagcgccgugcccgucgauugggugccgaccuccagaacaaccuggucuauccacgcucaucaccaauggaugacaaccgaggacaugcuuagcguuuggaaccgcguguggauugaagagaauccuuggauggaagauaagacacaugucuccagcuggggagacgugcccuaccugggcaaacgggaggaccaguggugugggucucucaucggacugaccgccagagccacgugggcuuccaacauucagguggccaucaaucagguucggagacugaucggcaacgagaauuaucucgauuacaugacaagcaugaagcgcuucaaaaacgaaggggaccccgagggcgcgcugugguga

SEQ ID NO: 19136 - RNA, 9879 nt, Artificial Sequence
  derived and/or modified CDS sequence (opt5) from DENV-1__JF937599__SS-prME
agcgugaccaugcugcugaugcugaugcccacagcucuugcuuuccaccugacggccagaggaggggaaccucauaugaucgucuccaagcaggaacggggaaaaucucuccuguuuaagaccagcgcgggcguuaacaugugcacacuuauugcuauggaccugggggaguucugugaagauaccaugacauacaaaugcccgcgcaucaccgaggccgaacccgacgauguggacuguuggugcaaugccacagauaccugggugacguauggaaccuguucccaaacaggcgagcacagacgggacaagcgcucugucgcucucgccccucauguggggcugggacuggagaccagaacagaaaccuggaugagcuccgagggcgcuuggaaacagauucagcggguugaaacgugggcccuccgccaccccggcuuuacagugaucgcgcuguuccuugcccaugcuauugggaccucuaucacacagaagggaaucauuuuuauccugcucaugcuggucaccccuagcauggccaugagaugcgugggcauugggucccgggauuucguugagggacuuagcggcgcuaccuggguggacgucgugcuggagcacgggucuugugugacaacgauggccaaggauaaacccacccucgacaucgaacugcugaagacagaggucaccaacccugcgguucuccgcaaacugugcauugaagccaagaucuccaauacaaccacggauagcagauguccgacacaaggagaggcuacccuuguggaagaacaagacgccaacuuugugugccggcgcaccuucgucgauagaggcuggggcaauggguguggacuguuuggcaaagggucucucauuacaugcgcuaaguucaagugcgugaccaaacuggagggaaagaucguucaguacgaaaaccuuaaauauuccgugaucgucacagugcacacgggcgaccagcaucaaguugggaaugagagcaccgaacacggaacaaccgccacaauuacaccccaggccccuucuacggagauccagcugaccgacuacggcgcucucacacuggauuguagcccccggaccggccuggacuuuaacgaaauggugcuccugacaaugaaggagaaaagcuggcuuguccauaagcagugguuccuggaucucccucugcccuggaccuccggggcgucuacgagccaagagacauggaaucgccaggaccuucuggugaccuuuaaaacagcccacgcuaagaagcaggaagucgugguucucggaucccaagagggcgccaugcacaccgcccugaccggggcuacagaagugcagacgagcggaaccacaaccauuuucgccggccaucugaaaugcagacucaagauggauaaacugacacuuaaggggaugucuuaugucauguguaccggcuccuucaaacuggagaaggaaguggcggagacgcagcacggaacaguucucgugcagaucaaguacgagggcaccgacgcuccgugcaaaauuccuuuuagcacccaagaugaaaagggggucacacagaacggacggcugaucaccgccaaucccaucgugacagacaaagagaagccugugaacauugaagccgagccgcccuucggcgagucuuauaucguuauuggggcuggagaaaaagcccugaaacuuagcugguuuaagaaaggcuccucuaucgggaagauguucgaggcuacggccagaggcgcgcgccggauggccauucucggagauaccgcuugggacuuuggcagcaucgggggagucuucacauccgugggcaaacuggugcaucagaucuuugggaccgccuacggaguccuguucagcggcgugucuuggacaaugaagauugggaucggcguucuccugaccuggcuuggacucaauuccagaagcacgucucucuccaugaccuguauugcugugggccuggucacacuguaccuuggggugaugguucaggccgauagcggaugcgugaucaacuggaaaggccgcgaacucaaguguggguccggaauuuuugucaccaaugaggugcacacauggaccgaacaauauaaguuccaggcggacucuccuaaacggcugagcgccgcuaucggcaaggccugggaggaggggguuugcggcauuagauccgcuacacgccuggaaaacaucauguggaaacagaucucuaacgagcucaaucauauucugcuugaaaacgacaugaagcugaccguggucgugggagauguggccggcauccucgcccaggggaaaaagaugauucggccgcaacccauggaguacaaauauagcuggaaguccuggggaaaggcuaaaaucauuggcgcggacguccagaauacgacauuuaucaucgaugggccuaacacccccgaauguccugacgaucagagagccuggaauauuugggagguugaggacuacggauucggcaucuuuaccacaaacauuuggcugaagcugcgcgauagcuauacccaggugugcgaccaccggcuuaugucugcugccaucaaagauuccaaggccgugcacgcugacaugggcuacuggauugaaagcgagaaaaaugaaacguggaagcucgccagagcgucuuucaucgaggucaagacauguaucuggcccaaaucccauacccuguggagcaacggggugcuggaaucugagaugauuaucccgaagauuuauggaggcccuaucagccaacacaauuaccgccccggguacuucacacagaccgcuggaccuuggcaucucggcaaacuggagcuugauuuugaccugugcgaagggacaaccguuguggucgaugagcacugcggaaaccggggccccucccucagaacgaccacagugaccggcaagauuauccacgaaugguguugccggagcuguacacugccuccccugcgcuucaaaggggaggacggaugcugguauggcauggagaucagaccgguuaaggaaaaggaggaaaaucuugugaaaucuauggucuccgccgggagcggagagguggacuccuuuucucucggccugcuguguauuagcaucaugauugaagagguuaugcgguccagauggucucgcaagaugcucaugaccgggacgcuggccguguucuuucuucugaucaugggacagcucacauggaacgaucugauucggcugugcaucauggucggcgcuaaugccagcgacagaaugggcauggggaccacauaccuugcgcugauggcuaccuucaaaaugcgcccuauguuugccgugggacuccuguucagacggcucaccucccgcgaggugcugcuucugacaauuggccucucucuggucgccagcguugaacugcccaacucccuugaggaacugggggauggacucgcuaugggcaucaugauccugaagcuccugacggacuuucaaagccaucagcuuugggccacccugcucucucugacauucauuagaaccacauuuucccugcacuaugcuuggaaaaccauggccauggugcuuagcaucgugucucuguucccccucugucuguccacgacaagccagaagaccaccuggcucccuguccugcuugggucucugggaugcaagccgcugacaauguuucucauugcggagaauaaaaucuggggccggaaguccuggccccugaacgaaggcauuauggccguggggaucguuagcauccuucuguccagccuccugaaaaacgaugugccucucgcuggaccccugauugccggcgggaugcuuaucgcuuguuacgucauuucuggaagcuccgccgaccugucucuggagaaggccgcugaggugagcugggaagaggaagcggagcauuccggcgccucucacaauauccucguugaagugcaggaugacgggaccaugaaaauuaaggaugaggagcgcgacgauacacugacgauccuucugaaagcuacccuccuggccgucagcggaguguauccucucuccauccccgccacacuguucgucugguacuucuggcaaaagaagaaacagagaucuggcgugcuuugggacaccccuuccccucccgaaguugagcgggcugugcuggaugacggcauuuaucgcaucaugcagagagggcugcucggacggucccaggucggcguggggguuuuucaagaaaacguguuccauacaauguggcacgucacccgcggagccgugcugauguaccagggcaagagacuugagcccagcugggcgucugugaaaaaggaccugauuuccuacgggggaggcuggcggcuccagggcagcuggaauacgggggaggaaguucaggucaucgcuguggagcccggcaagaauccuaagaaugugcaaaccgcccccggcacauuuaagaccucugaaggggaggucggagccauugcucuggauuucaaaccgggcacauccgggagcccuaucgugaacagagaaggaaagauuguuggccucuauggcaaugggguggucaccacauccggaacguacgugucugccaucgcgcaggcuaaagccagccaggagggcccccugccugagaucgaagacgagguuuuucgcaagcggaaccuuaccauuauggaucugcaccccggguccggaaaaacaagacgcuaucugcccgccaucgugcgggaagcuauuaagagacgccuccggacccugauccuugccccuaccagagucguggcuagcgagauggccgaagcgcugaagggcaugccgauucgcuaccaaacaacggccguuaaaucugagcauaccgggaaggagaucguggaccucaugugccacgcuacauucaccaugcggcugcugucccccgucagagugccuaauuauaacaugaucauuauggaugaagcccauuuuacagaccccagcucuaucgcugcccggggcuacauuagcacccgcgugggaaugggcgaggccgcugcgaucuucaugacggccacaccucccggguccgucgaggcuuuuccucagucuaaugccguuauucaggaugaagaaagagacaucccggagcggagcuggaacuccggauaugaguggaucaccgauuuccccggcaaaaccgugugguuugugccuucuauuaagagcgggaaugacaucgccaacugucuccgcaaaaauggaaagagagucauucagcuuucccggaagacauucgauaccgaauaccagaagaccaagaacaacgacugggacuacgugguuaccacggauaucagcgagaugggcgcuaauuucagagccgaccgcgugauugauccccggagaugccugaaaccugucauccugaaggacgggcccgaacgcgugauucucgcgggcccgaugccuguuacaguggcuucugccgcccagcggagaggacgcaucggccggaaccacaauaaagagggggaucaguauaucuacaugggacagccccugaacaaugacgaggaucaugcucacuggaccgaagccaagaugcuucuggacaacauuaauacacccgagggcaucauuccugcgcucuuugaacccgagagagaaaaguccgccgcuaucgauggggaguaucgccugagaggagaggcccggaaaaccuucgucgaacugaugcgcagaggcgaccucccuguguggcuuagcuacaaggucgcuuccgagggguuucaauauucugaucggcgcuggugcuucgacggcgaaagaaacaaucaggugcuggaggaaaacauggauguugagauuuggacgaaagagggagaacggaagaaacugagaccgcgcuggcucgacgcccggaccuacagcgacccccuggcucuuagagaguuuaaggaguucgccgcgggccgccgguccgugucuggggaucugauccucgagaucggaaaacugccucagcaccugacacagagagcccaaaaugcucucgacaaccuugugaugcugcauaauagcgaacagggcgggcgggccuaucgccacgcuauggaggagcugcccgauaccauugaaacacucaugcugcuugcccugaucgccguccucaccggaggcguuacacuguuuuuccuguccggcagagggcucggaaagaccagcauuggccuucugugugugauggcuucuuccgugcugcucuggauggcgagcgucgagccucauuggaucgccgcuucuauuauccuggaauuuuuccuuauggugcugcucauccccgagccggaccggcagcgcacgccucaggauaaccaacuggccuacguugugauugggcugcucuuuaugauccuuacagucgccgcuaaugagaugggacugcuggaaaccaccaagaaagaccucggcauugggcacguggccgucgagaaccaccaucacgcggccaugcuggauguggaccuucaucccgcuuccgccuggacacuguacgcuguugccaccacaaucauuacgccuaugaugagacacaccaucgaaaacacaaccgcgaauauuagccucacagccaucgcuaaccaggccgcuauccugaugggacuggauaagggcuggcccauuucuaaaauggacaucggcgugccucuccuugcccuggggugcuauagccaggucaauccccugacccucacggcugccgugcugaugcuuguugcgcauuacgccauuaucggaccgggccugcaagcuaaggccacccgggaggcucagaaacgcacagccgccgggauuaugaagaacccuaccguggauggaaucgucgcgaucgaccucgaucccgugguguaugacgcuaaguucgaaaaacagcugggccagauuaugcugcucauccuuuguacaucccaaauucugcugaugagaaccacgugggcccucugcgagucuaucacacuggcuaccgggccccuuacaacccugugggagggaagcccuggcaaguuuuggaauaccacaauugccguuuccauggccaacaucuuccggggcagcuaccucgcuggggccggacuggcguucucccugaugaaaucucucggcgggggacgcagaggcacgggggcccagggagaaacccuuggcgagaaguggaaacggcagcugaaucagcugagcaagccggaauuuaacacauauaagagauccggcaucauggaggucgaccgcucugaagcuaaagaggggcucaagcggggagagaccacaaaacacgccgugagcagaggcaccgcuaagcugcgcugguucguggaacggaaucuugucaaacccgaggggaagguuauugaucugggauguggcagagggggaugguccuacuauugcgccggccucaagaaagugacggaagugaagggcuacacaaaagggggaccuggccacgaggaacccaucccuauggcgaccuacggguggaaccuggucaagcugcauucuggaaaagacguguuuuucauucccccugagaagugugauacccuccuuugcgacaucggcgagagcuccccgaaucccacaauugaagaggggcgcacccugcggguucugaaaaugguggaaccuuggcucagaggaaaccaauuuuguaucaagauucugaaucccuauaugccuagcgucguggagacacuugagcagaugcagcgcaagcacggcggcaugcugguucggaacccccucucuagaaauuccacgcaugaaauguacugggugagcugcgggaccggaaacaucgucucugccgugaauaugacaucccgcaugcugcugaaccgguucaccauggcucacagaaaaccgacauaugagcgcgauguggaccucggcgccgggaccagacacgucgcuguugaaccugagguggccaaccuggauaucauuggacagcggaucgaaaauauuaagcaugagcacaaaagcacguggcauuacgacgaggauaaccccuauaagaccugggcuuaccacggcucuuaugaagugaaacccuccgggagcgccuccagcauggucaauggagugguuaaacuucugacaaagccuugggacgugauccccauggucacccaaauugcgaugacagauaccacaccuuuuggccagcagcgcguguucaaagagaagguugacaccagaacgccgaaagccaagcggggcacagcucaaaucauggaagugaccgccaaauggcucuggggguuucugucuagaaacaagaagccccggaucuguacccgcgaggaguucacaagaaaaguccggagcaaugcugccauuggagccguguuuguugacgagaaccaguggaacuccgcgaaggaggcuguggaagaugagcgcuucugggaccuuguccauagagaacgggagcugcacaaacagggcaagugcgccacgugcguguacaacaugauggggaaacgcgaaaagaagcucggagaguuuggcaaagccaaggggucuagagcuaucugguacauguggcugggcgcccgguuccuggaguucgaagcucucggauuuaugaaugaggaucacugguucagccgcgaaaacucccugucuggcgucgagggggagggacuucauaaacugggcuauauucucagagacaucagcaagauuccugggggaaauauguacgccgaugacaccgcgggcugggauacacggaucaccgaagacgaucugcagaacgaggccaaaaucacagacauuauggaacccgagcacgcccuucuggccaaguccaucuuuaaacucaccuaucaaaauaaggugguucgcgugcagagaccugcuaagaacgggacagucauggaugugauuucucggcgcgaccagagaggcagcggacaggugggcaccuacgggcugaauacguucaccaacauggaagcccaacugauccggcagauggaguccgagggaauuuuuagccccucugaacucgagacaccgaaccuggcgggcagaguucuugauuggcuggaaaaacaugggguggagcgccucaagcggauggccaucuccggagacgacugugucgugaaaccuaucgaugacagauucgcuaccgcccugacagcucuuaaugauaugggcaagguucgcaaagacauuccccagugggaaccuagcaagggguggaacgauuggcagcaagugcccuuuugcucucaccacuuccaucagcugaucaugaaggacggccgggagauugucgugccuuguagaaaucaggaugagcucgucggacgcgcccgggugucccagggcgcuggguggagccugagagaaaccgccugccugggaaaauccuaugcgcaaauguggcagcucauguacuuucaccgccgggaccugagacuugccgcuaacgccaucuguucugccguucccguggauugggucccgacgagccgcacaaccugguccauucaugcucaccaucaguggaugacaaccgaggacaugcugagcguguggaaucggguuuggaucgaagagaacccuuggauggaagauaagacgcacgugucuuccuggggcgacguccccuaucucgggaaaagagaggaccaauggugcggaagccugauuggccuuaccgcccgggcgacaugggcuaccaauauccagguggccaucaaccaggugagacgccugcucgggaaugagaacuaccuggauuacaugacaucuaugaagcgguucaaaaaugaaagcgaccccgagggcgcccugugguga

SEQ ID NO: 19137 - RNA, 9879 nt, Artificial Sequence
  derived and/or modified CDS sequence (opt5) from DENV-1__FJ898431__SS-prME
agcgugaccaugcugcugaugcugaugcccaccgcccuugcuuuccaccugacgaccagaggcggggaaccucauaugauugucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccguucuguuucuucugaucaugggacagcucacauggaacgaucugauucggcugugcaucauggugggcgccaaugcuagcgacagaaugggcauggggaccaccuaccuugcccugauggcgacauucaagaugcgcccuauguuugcugucggacuccuguucagacggcucacgucccgcgaggugcugcuucugaccauuggccucucucugguggccagcgucgaacugcccaacucccuugaggaacugggggauggacucgccaugggcaucaugauccugaaacuccugacagacuuucagagccaucaacuuugggcuacccugcucucucugacauucauuaagaccacguuuucccugcacuaugccuggaagacaauggcuaugguucuuagcaucgugucucuguucccccucugucuguccaccaccagccagaaaacaaccuggcucccugugcugcuugggucucugggaugcaagccgcugacaauguuucucauugccgagaauaaaaucuggggcagaaaguccuggccccugaacgaaggcauuauggcggucgggaucgugagcauccuucuguccagccuccugaaaaacgauguuccucucgccggaccccugauugcuggcgggaugcuuaucgccuguuacgugauuucuggaagcuccgcugaccugucucuggagaaggccgccgaggucagcugggaagaggaagcugagcauuccggcgcgucucacaauauccucguggaaguucaggaugacgggacgaugaaaauuaaggaugaggagcgggacgauacccugacaauccuucugaaggccacccuccuggcugugagcggagucuauccucucuccauccccgccacacuguucgugugguacuucuggcagaaaaagaaacaacgcucuggcguccuuugggacaccccuuccccucccgaaguggagagagccguucuggaugacggcauuuaucggaucaugcagcgcgggcugcucggaagaucccaggugggcgucgggguguuucaggaaaacguuuuccauacgauguggcacgugacccggggagcuguccugauguaccaaggcaagcgccuugagcccagcugggccucugugaaaaaggaccugauuuccuacgggggaggcuggagacuccagggcagcuggaauacaggggaggaagugcagguuaucgcggucgagcccggaaagaacccuaaaaaugugcagaccgcucccggcacauuuaagaccucugaaggggaggugggagccauugcccuggauuucaaaccgggcacauccgggagcccuaucgucaaccgggaaggaaagauugugggccucuauggcaaugggguugugacgaccuccggaacauacgucucugcuaucgcccaagcgaaagcuagccaggagggcccccugccugagaucgaagacgagguguuuagaaagcgcaaccuuaccauuauggaucugcaccccggguccggaaagacccggagauaucugcccgccaucguucgcgaagccauuaaacggaagcucagaacacugauccuugcuccuacgcgcguggucgccagcgagauggcugaagcccugaaaggcaugccgauucgguaccagaccacagcggugaagucugagcauaccgggaaagagaucguugaccucaugugccacgccacauucaccaugagacugcugucccccgugcgcgucccuaauuauaacaugaucauuauggaugaagcucauuuuacggaccccagcucuaucgccgcucggggcuacauuagcacaagagugggaaugggcgaggccgccgcuaucuucaugaccgcgaccccucccggguccguggaagccuuuccucaaucuaaugcugucauucaggaugaggaacgggacaucccggagcgcagcuggaacuccggauaugaguggaucacagauuuccccggcaagaccguuugguuugugccuucuauuaagagcgggaaugacaucgccaacugucuccgcaagaauggaaagcgggugauucagcuuucccgcaaaacauucgauaccgaauaccagaagacgaaaaacaacgacugggacuacgucgugacaaccgauaucagcgagaugggcgccaauuucagagcugaccggguuauugaucccagacgcugccugaagccugugauccugaaggacgggcccgaacgggucauucucgccggcccgaugccugugacaguugcgucugcugcccaaagacgcggacggaucggcagaaaccacaauaaagagggggaucaguauaucuacaugggacagccccugaacaaugacgaggaucaugcccacuggaccgaagcuaagaugcuucuggacaacauuaauacgcccgagggcaucauuccugcccucuuugaacccgagcgcgaaaaauccgcggccaucgauggggaguaucggcugagaggagaggcucgcaagaccuucguggaacugaugagacggggcgaccucccugucuggcuuagcuacaaaguggccuccgagggguuucaguauucugaucgcagauggugcuucgacggcgaacggaacaaucaaguccuggaggaaaacauggauguggagauuuggacaaaggagggagaacgcaaaaagcugagaccgcgguggcucgacgcuagaaccuacagcgacccccuggcccuucgcgaguuuaaggaguucgcugccggccggagauccguuucuggggaucugauccucgagaucggaaaacugccucagcaccugacacagcgcgcgcagaaugcccucgacaaccuugugaugcugcauaauagcgaacaaggcgggcgggcuuauagacacgccauggaggagcugcccgauaccauugaaacacucaugcugcuugcucugaucgccgugcucaccggaggcgucacgcuguuuuuccuguccggccgggggcucggaaagacaagcauuggccuucuguguguuauggccucuuccgugcugcucuggauggcuagcguggagccucauuggaucgcggccucuauuauccuggaauuuuuccuuaugguccugcucauccccgagccggaccgccagagaaccccucaggauaaccagcuggcuuacgugguuauugggcugcucuuuaugauccuuaccguggccgccaaugagaugggacugcuggaaacaaccaaaaaggaccucggcauugggcacgucgcuguggagaaccaccaucacgccgcgaugcuggaugucgaccuucaucccgccuccgcuuggacacuguacgccguggcuacgaccaucauuacaccuaugaugcggcacaccaucgaaaacacaaccgccaauauuagccucacggcgaucgccaaccaagcugccauccugaugggacuggauaaaggcuggcccauuucuaagauggacaucggcguuccucuccuugcucuggggugcuauagccaggugaauccccugacccucacagccgcuguccugaugcuuguggcccauuacgcgauuaucggaccgggccugcaggccaaggcuacccgcgaggcccagaagagaacagcugccgggauuaugaagaacccuaccguugauggaaucguggccaucgaccucgaucccgucguguaugacgcgaaauucgaaaagcagcugggccagauuaugcugcucauccuuuguacgucccagauucugcugaugcggacaaccugggcucucugcgagucuaucacacuggccaccgggccccuuaccacacugugggagggaagcccuggcaaauuuuggaauacgaccauugcuguguccauggccaacaucuuccgcggcagcuaccucgccggggcuggacuggccuucucccugaugaagucucucggcgggggaagacggggcacaggggcgcaaggagaaacccuuggcgagaaguggaaacgccagcugaaucagcugagcaaguccgaauuuaacacauauaaaagaucuggcaucauggagguugaccggagcgaagccaaggaggggcucaaaagaggagagaccacgaagcacgcugucucccgcggcacagccaagcugcggugguucguggaaagaaaucuugugaaaccggaggggaaggucauugaucugggauguggccgcgggggauggucuuacuauugcgcuggccucaaaaagguuaccgaagugaaaggcuacaccaaagggggacccggccacgaggaaccuauccccauggccacauacggguggaaccuggugaaacugcauagcggaaaggacgucuuuuucauuccucccgagaagugugauacccuccuuugcgacaucggcgaguccagcccuaauccgacaauugaagaggggcggacgcugagagugcugaaaaugguugaacccuggcuccgcggaaaccaguuuuguaucaagauucugaauccuuauaugcccucuguggucgagacccuugagcaaaugcagcggaaacacggcggcaugcuggugagaaacccucucucccgcaauagcacacaugaaauguacuggguuucuugcgggaccggaaacaucguguccgcggucaauaugacaagccggaugcugcugaacagauucaccauggcccaccgcaagcccacguaugagcgggauguggaccucggcgcugggaccagacacguggccgucgaaccggagguugcuaaccuggauaucauuggacagcgcaucgaaaauauuaaacaugagcacaagucuacauggcauuacgacgaggauaacccuuauaagaccugggccuaccacggcuccuaugaagugaaacccagcggguccgcuagcucuauggugaauggagucgugaaacuucugacaaaacccugggacguuaucccuauggugacccagauugccaugacagauaccacgcccuuuggccaacagagagucuucaaggagaaaguggacacacggaccccuaaggcgaagcgcggcaccgcccagaucauggaaguuacagcuaaauggcucuggggguuucugagcagaaacaagaaaccgcggaucuguacgagagaggaguucacccggaaggugcgcuccaaugccgcuauuggagccgucuuuguggacgagaaccaauggaacucugccaaagaggcgguugaagaugagagauucugggaccuugugcaucgggaacgcgagcugcacaagcagggcaagugcgcuacaugcgucuacaacaugauggggaaaagagaaaagaaacucggagaguuuggcaaggccaaagggagccgggccaucugguacauguggcugggcgcucgcuuccuggaguucgaagcccucggauuuaugaaugaggaucacugguucuccagagaaaacucucugagcggcguggagggggagggacuucauaagcugggcuauauucuccgggacaucuccaaaauucccgggggaaauauguacgcugaugacaccgccggcugggauacacgcaucaccgaagacgaucugcagaacgaggcgaagaucacagacauuauggaaccugagcacgcccuucuggcuaagucuaucuuuaaacucaccuaucagaauaaggucgugagaguucaacggcccgccaaaaacgggacggugauggaugucauuagccgcagagaccagcggggcuccggacaggugggcaccuacgggcugaauacauucaccaacauggaagcucagcugauccgccaaauggagagcgagggaaucuuuucuccuuccgaacucgagacacccaaccuggccggcagagugcuugauuggcuggaaaagcaugggguugagcggcucaaaagaauggcgaucagcggagacgacuguguggucaagccgaucgaugaccgcuucgccaccgcucugacggcccuuaaugauaugggcaaggugcggaaagacauuccucagugggaacccucuaagggguggaacgauuggcagcagguuccuuuuugcucccaccacuuccaucaacugaucaugaaagacggcagagagauugugguccccugucgcaaucaggaugagcucgugggacgggcuagagucagccagggcgccggguggucccugcgcgaaacagcuugccugggaaagucuuaugcccagauguggcaacucauguacuuucaccggagagaccugcgccuugcggccaacgcuaucuguagcgccgugccuguugauugggugcccaccucccggacaaccuggagcauucaugcccaccaucaguggaugacgaccgaggacaugcugucugucuggaauagaguguggaucgaagagaacccguggauggaagauaaaacacacauuuccagcuggggcgacguuccuuaucucgggaagcgcgaggaccaguggugcggaucucugaucggccuuaccgcucgggccacaugggcgaccaauauccaaguggcuauuaaccaggucagacggcugaucgggaaugagaacuaccucgauuacaugacaagcaugaagagauucaaaaaugaauccgaccccgagggcgcccugugguga

SEQ ID NO: 19138 - RNA, 9879 nt, Artificial Sequence
  derived and/or modified CDS sequence (opt5) from DENV-1__GU131678__SS-prME
agcgugaccaugcugcugaugcugaugcccaccgcccuugcuuuccaccugacgaccagaggcggggaaccucauaugaucgucuccaagcaggaacggggaaagucucugcuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcugggacucgaaacaagaaccgagacguggaugagcuccgaaggcgccuggaaacagauucagcggguugagacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggacuuuguugagggacugagcggcgccacauggguggaugucgugcucgaacacgggucuugugugacgaccauggcuaaggacaaacccacacuggauaucgagcugcucaagaccgaagucacaaacccugccguucugcgcaaacuuugcauugaggcgaagaucuccaauaccacgacagacagcagauguccgacccaaggagaagccacccugguggaggagcaggaugcuaacuucgugugccggcgcacauuugucgacagaggcuggggcaauggguguggacucuucggcaaagggucucugcuuaccugcgccaaguuuaagugcaugacaaaacuggaaggaaagauugugcaguacgagaaccucaaauauuccguuaucgugacgguccacaccggcgaucagcaucaaguggggaaugaaagcacagagcacggaaccacagcuaccaucacgccccaggccccuaccacagaaauucagcugaccgacuacggcgcccugacacucgacuguucuccccggaccggccuggauuucaacgagaugguucuucugacgaugaaggagaaauccuggcucgugcauaagcagugguuucuggaccuuccucugcccuggacaagcggggcuuccaccucucaagaaacauggaaucgccaggaucuccuggucaccuucaaaaccgcgcacgccaagaagcaggagguggucgugcugggaagccaagaaggcgcuaugcacacagcccucacgggggccaccgagauccagacauccggaaccacaaccauuuuugcuggccaucugaaaugcagacuuaagauggacaaacugacgcucaaggggaugagcuauguuauguguacaggcucuuucaaacuggaaaaggagguggccgagacccagcacggaaccguccuggugcagaucaaguacgaaggcacagaugcgccgugcaaaauuccuuucuccacccaagacgagaaggggguuacacagaacggacggcuuaucacggcuaaucccaucgugaccgauaaagaaaagccugucaacauugaggccgagccgcccuuuggcgaaagcuauaucgugauuggggccggagagaaagcucucaagcugucuugguucaagaaaggcagcuccaucgggaagauguuuaaagccacagcuagaggcgcccgccggauggcgauucugggagacaccgccugggauuucggcucuaucgggggaguguuuacaagcguuggcaagcucguccaucagaucuucgggaccgcuuacggagugcuguuuuccggcgugagcuggacgaugaaaauugggaucggcguccuucugaccuggcucggacucaauucuagauccacaagccugucuaugaccuguauugccgugggccuuguuacacucuaccugggggugaugguccaggcugacuccggaugcgugaucaacuggaagggccgcgaacugaagugugggagcggaauuuucguuaccaaugaggugcacacauggaccgaacaauauaaauuucaggccgauuccccuaagcggcucucugcggccaucggcaaggcuugggaggagggggucugcggcauuagaagcgccacgcgccuggaaaacaucauguggaagcagaucuccaacgagcuuaaucauauucugcucgaaaacgacaugaaauucacagugguugugggagacgucgcuggcauccuggugcaggggaagaaaaugauucggccgcaacccauggaguacaaguauucuuggaaaagcuggggaaaagccaagaucauuggcgccgaugugcaaaauuccaccuuuaucaucgacgggccuaacacccccgaauguccugaugaccagagagcuuggaauauuugggaggucgaggauuacggauucggcaucuuuacaaccaacauuuggcugaaacuucgcgacagcuauacgcagguuugcgaucaccggcucaugucugcggccaucaaggacuccaaagcugugcacgccgauaugggcuacuggauugaaagcgagaagaaugaaacauggaagcuggccagagcuucuuucaucgaggugaaaaccuguaucuggcccaagucccauacacuguggagcaacgggguccucgaaucugagaugauuaucccgaaaauucacggaggcccuaucagccaacauaauuaucgccccggguacuucacccagacagccggaccuuggcaccugggcaaacuugagcuggacuuugaucucugcgaagggaccacggugguuguggacgagcacugcggaaaccggggccccucccugagaaccacaaccgucacaggcaaaauuauccaugaaugguguugccggagcuguacccugccuccccuucgcuucagaggggaggauggaugcugguacggcauggagauccggccggugaaggaaaaggaggaaaaucucguuaaaucuaugguguccgcggggagcggagaggucgacuccuuucugcugggccuccuguguauuucuaucaugauugaagaggugaugagaagccgcuggucccggaagaugcuuaugacggggacacuggcuguuuucuuucuccugaucaugggacagcugaccuggaacgaccuuauuagacugugcaucauggugggcgccaaugccucugaucgcaugggcauggggacaaccuaucucgcucugauggccaccuucaaaaugagaccuauguuugcggucggacuccuguuccggcgccuuacaagcagagaggugcugcuccugacgauuggccugucccuuguggcuucugucgaacugcccaacagccucgaggaacugggggacggacucgccaugggcaucaugauccugaaacuucugaccgauuuucaauccuaccagcucugggccacacugcugagccuuaccuucauuaaaacaaccuuuucucugcacuaugcuuggaagacgauggccaugguucucuccaucgugagccuguucccccucugucugucuacaaccucccagaagaccacauggcuuccugugcugcuggggagccucggaugcaaaccgcugaccauguuucuuauugcugagaauaagaucuggggccggaaaucuuggccccugaacgaaggcauuauggccgucgggaucguguccauccuccugagcucccuccugaagaacgacguuccucuugcgggaccccugauugccggcgggaugcugaucgcuuguuacgugauuagcggaucuagcgccgaucucucccuggagaaagcugccgaggucucuugggaagaggaagccgagcauagcggcgcuucccacaauauccuuguggaaguucaggacgaugggacaaugaagauuaaagacgaggagcgcgaugacacgcugaccauccuccugaaggcgacacuccuggccgugucuggagucuauccucuuagcauccccgcuacccuguucguguggcauuucuggcaaaagaaaaagcagagauccggcguccugugggauacaccuucucccccggaaguggagcgggccguucucgacgauggcauuuaccgcaucaugcagagagggcugcuuggacggagccaggugggcgucgggguguuucaagaaaacguuuuccacaccauguggcacgugacgcgcggagccguccugauguaucagggcaaaagacucgagccuuccugggcuagcgugaagaaagaccugauuucuuacgggggaggcuggcgguuucagggcuccuggaauaccggggaggaagugcagguuaucgccgucgagcccggaaagaacccuaagaaugugcaaacagcgcccggcaccuucaaaacaccggaaggggaggugggagcuauugcccucgacuuuaagccuggcaccagcgggucucccaucgucaacagagaaggaaaaauugugggccuguacggcaaugggguugugacaacguccggaaccuaugucagcgccaucgcucaggccaaggcgucccaggagggcccucuucccgagaucgaagaugagguguuccgcaaacggaaccugacaauuauggaccugcaucccgggucuggaaagaccagacgcuaccucccugcuaucguucgggaagccauuaagagaaaacugcgcacccuuauccuggccccgacacggguggucgcuagcgagauggccgaagcucucaagggcaugcccauuagauaucaaacgaccgccgugaaauccgagcacacagggaaggagaucguugaucugaugugccaugcgaccuuuacaaugcgccugcucagcccugugcggguccccaauuacaacaugaucauuauggacgaagcccacuucaccgauccuucuuccaucgcugccagaggcuauauuagcacgcgggugggaaugggcgaggcugccgccaucuuuaugacagcuacacccccugggucuauggaagcguucccgcagagcaaugccgugauucaggacgaggaacgcgauauccccgagagauccuggaacucuggauacgaguggaucaccgacuuuccuggcaaaacagucugguucguucccagcauuaaggcugggaaugauaucgccaacugucuucggaagaauggaaaacgcgugauucagcuguccagaaagaccuucgacacagaauaucagaagaccaagaacaacgauugggacuacguggucacgacagacaucucugagaugggcgccaauuuucgggcugauagagugauugacccucgccggugccugaaacccguuauccucaaggaugggccggaaagagugauucuggccggcccuaugcccgucaccguggcgagcgcugcccagcgccggggaagaaucggccgcaaccccaauaaggagggggaccaguacaucuauaugggacagccucuuaacaaugaugaggaccaugcccacuggacagaagcuaaaaugcugcucgauaacauuaauacccccgagggcaucauuccugcccuguucgaaccggagcgggaaaaguccgcggccaucgacggggaguacagacugcgcggagaggcuagaaaaacguuuguugaacucaugcggcgcggcgaucuucccguguggcugagcuauaaggucgccucugagggguuccaauacuccgacagacgguggugcuuugcuggcgaacgcaacaaucaggugcuggaggaaaacauggaugucgagauuuggaccaaagagggagaaagaaagaaacuccugccucgguggcuugacgccagaacauauagcgauccccuggcucuccgcgaguucaaggaauuugccgcgggccggagauccgugucuggggaccugauccuggagaucggaaagcucccucagcaccuuacccagcgcgcccaaaaugcucuggacaaccugguuaugcuccauaauagcgaacagggcgggcgggccuacagacacgcuauggaggagcugcccgauacaauugaaacccuuaugcugcucgcccugaucgccgugcugacaggaggcgugacccucuucuuucuuuccggcaaagggcugggaaagacgucuauuggccugcucugugucauggcuagcuccguucugcuuuggauggggagcguggagccgcauuggaucgcggccucuauuauccuggaguucuuucucauggugcugcugaucccugagcccgaccggcagcgcacaccucaggauaaccaacucgcuuaugucgugauuggacuucuguucaugauccugaccguugccgccaaugagaugggccuccuggaaaccaccaagaaggaccuugggauuggacacguggcugucgagaaccaccaucacgccgcgaugcuggauguggaccuccaucccgccuccgcuuggacccuguacgccgucgcuacaacgaucauuaccccuaugaugagacacacaaucgaaaacaccacagccaauauuagccugaccgcgaucgccaaccaggcugccauccucaugggccuugcuaaaggcuggcccauuucuaagauggauaucggggugccgcugcuggcccucggaugcuacucccagguuaauccucugacgcuuaccgcugccgugcugaugcucgucgcgcauuaugccauuaucggccccgggcugcaagcuaaggccacacgggaggcucagaaacgcaccgccgccggaauuaugaagaaccccacaaucgacggcaucguggcgauugaucuggacccuguuguguacgaugcuaaauuugaaaagcagcucgggcagaucaugcuucugauucuguguaccagccaaauccuccugaugagaacgacaugggcccuuugcgagucuauuacccuggcuacaggaccgcucaccacccugugggagggcagccccggcaaauucuggaauacaacgaucgccgucuccauggccaacaucuuccgggggucuuaucuggcuggagccggccucgcguuuagccuuaugaagucccucgggggaggccgcagagggaccggagcccagggcgaaacacugggcgagaaguggaaacggcagcucaaucagcugagcaaguccgaguucaacaccuacaaacgcucugggauuauggaaguggacagaagcgaagcuaaggagggacuuaaacggggcgagacaaccaagcacgccguguccagagggccugcuaagcugcgcugguuuguugaacggacgcucgucaaucccgagggaaaagugaucgcccugggcugugggagaggagcguggucuuauuacugcgccggccugaagaaaggcacagaagugaagggguauaccaaaggaggcccugggcacgaggaacccauuccuauggcuaccuacggaugggaucucgucaaacuucauagcggcaaagacguuuucuuuaucccgcccgagaagugugacacacugcugugcgauauuggggaguccucuccuaaccccaccaucgaagagggacgcacacuccgggugcugaagaugguggaaccuuggcuuagaggcaaucaauucuguauuaaaauccugaaccccuacaugccgagcgucguggagacgcucgagcagaugcagcgcaagcacggcgggaugcugguucggaauccucuguccagaaacagcacccaugaaauguauugggugucuugcggaacaggcaauaucgucuccgccgugaacaugaccagccgcaugcuccugaaucgguuuacaauggcucacagaaaacccaccuacgagcgcgacguugaucuuggggccggaacgcggcacguggcugucgaccccgaaguggccaaccuggauauuaucggccagagaauugagaacaucaagcaugaacacaaaucuaccuggcauuaugacgaggauaauccuuacaagacaugggcguaucacggguccuacgaggugaagcccagcggaucugccuccagcauggucaacggcguugugaaacuccugaccaagccuugggacgugauuccgauggucacacaaaucgcuaugaccgauacaacccccuucggccagcagcgcguguuuaaagaaaagguugacacgagaacaccuaaagccaagcgggggaccgcucaaaucauggaggugaccgcccgcuggcuuuggggauuccuguccagaaauaagaaaccccggauuuguacaagagaagaguuuacgcggaagguccgcagcaacgccgcgaucggcgcuguguucguugaugaaaaucaguggaacucugccaaagaggccguggaggacgacagauuuugggaucucguccaucgggaacgcgagcugcacaagcaggggaaaugcccuaccugcguguauaauaugaugggaaagagagaaaagaaacugggcgaguucgggaaggcuaaaggcagccggcccauuugguacauguggcucggagcccgcuuccuggaauuugaggcucuuggcuucaugaacgaggaccacugguuuuccagagaaaauucucugagcgggguugagggagaagcccuccauaagcugggcuacauccuucgggauauuuccaaaauccccgggggaaacauguaugcggacgauacagccggcugggacacccgcaucacagaggaugaccugcagaaugaggggaagauuaccgauaucauggaaccugagcacgcucuccuggccaaaucuauuuucaagcugacauaccaaaacaagguggucagagugcagcggcccgcuaaaaauggcaccgucauggacgugaucagccgcagagaucagcggggauccggccagguugggacguauggacucaacaccuuuacaaauauggaagcccaacugauucgccagauggagucugaaggcaucuuccuuccuaacgagcuggagacccccaaccucgcggggagagugcuggacuggcuugaaaaguacggagucgagcggcugaaaagaauggccaucagcggcgaugacuguguggugaagccuauugacgaucgcuuugcuacagcccucaccgcucugaaugacauggggaaaguucggaaggauaucccccagugggaaccguccaagggcuggaacgacuggcagcaagugccuuucugcagccaucacuuucaccagcugauuaugaaagauggaagagagaucgucgugcccugucgcaaucaggacgaacucguuggccgggccagagugucucagggggcuggauggacgcugcgcgagacagccugccuuggcaaguccuaugcgcaaauguggcagcugauguacuucccccggagagcccuccgccuggcugccaacgccauuuguagcgcugucccuguggauugggucccgaccucucggacaaccugguccauccaugcccaccaucaguggaugacgaccgaggacaugcuuagcguguggaauagaguuuggauugaagagaaccccuggauggaagauaaaacacgcaucuccucuugggaggacgugccuuaucuggggaagcgggaagaucaauggugcggaagccucaucggccugacccccagagcgacauggccuaccaauauucaggucgcuaucaaccaggugcggagacugauugggaaugagaacuacuccgacuacaugacaagcaugaaacgcuuuaagaaugagucugaacccgagggcgcccucugguga

SEQ ID NO: 19139 - RNA, 9879 nt, Artificial Sequence
  derived and/or modified CDS sequence (opt5) from DENV-1__GU131679__SS-prME
agcgugaccaugcugcugaugcugaugcccacagcccuugcuuuccaccugacgaccagaggcggggagccucauaugaucgucuccaagcaggaacggggaaaaucucuccuguuuaagacaagcgccggcguuaacaugugcacccuuauugccauggaccugggggaguucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaggcuuggcuuguccauaagcagugguuccuggaucucccucugcccuggacaagcggggcguccaccucucaagagacauggaaucgcaaagaccuucuggugaccuuuaagaccgcccacgcuaagaaacaggaagucgugguucucggaagccaggagggcgccaugcacacagcccugacgggggcuaccgaaauccaaacauccggaaccacaaccauuuucgccggccaucugaagugcagacucaaaauggauaagcugacgcuuaaagggaugagcuaugugauguguacaggcucuuucaagcuggagaaggaagucgcggagacccagcacggaaccgugcucguucagaucaaauacgagggcacagacgcuccgugcaagauuccuuuuuccacccaggaugaaaaaggggugacacaaaacggacggcugaucacggccaaucccaucgucaccgacaaggagaaaccugugaacauugaagccgagccgcccuucggcgagagcuauaucgugauuggggcuggagaaaaggcccugaaacuuucuugguuuaaaaagggcagcuccaucgggaaaauguucgaggcuacagccagaggcgcgcgccggauggccauucucggagauaccgcuugggacuuuggcucuaucgggggaguuuucacaagcgucggcaagcuggugcaucagaucuuugggaccgccuacggagugcuguucuccggcgucagcuggacgaugaaaauugggaucggcgugcuccugaccuggcuuggacucaauucuagauccacaagccucucuaugaccuguauugcuguuggccuggugacacuguaccuuggggucauggugcaggccgauuccggaugcguuaucaacuggaagggccgcgaacucaagugugggagcggaauuuuugugaccaaugagguccacacauggaccgaacaguauaaauuccaagcggacuccccuaagcggcugucugccgcuaucggcaaagccugggaggagggggugugcggcauuagaagcgcuacgcgccuggaaaacaucauguggaagcagaucuccaacgagcucaaucauauucugcuugaaaacgacaugaaauuuacaguuguggucggagauguggccggcauccuggcccaggggaagaaaaugauucggccgcagcccauggaguacaaguauucuuggaaaagcuggggaaaggcuaagaucauuggcgcggacgugcaaaaugccaccuucaucaucgaugggccuaacacccccgaauguccugacgaucagagagcuuggaauauuugggaggucgaggacuacggauuuggcaucuucacaaccaacauuuggcucaaacugcgcgauuccuauacgcagguuugcgaccaccggcugaugagcgccgccaucaaggauucuaaagcugugcacgccgacaugggcuacuggauugaauccgagaagaaugaaacauggaaacuugcgagagcuagcuucaucgaggugaaaaccuguaucuggcccaagucucauacacucugguccaacgggguccuggaaagcgagaugauuaucccgaaaauuuauggaggcccuaucucucagcacaauuaccgccccggguacuuuacccaaacagccggaccuuggcaucugggcaagcucgagcuggauuucgaccuuugcgaagggaccacggugguuguggaugagcacugcggaaaccggggccccagccugagaaccacaaccgucacaggcaaaauuauccacgaaugguguugccgguccuguacccucccuccccugcgcuuuaagggggaggacggaugcugguauggcauggagaucagaccggugaaggaaaaagaggaaaaucugguuaagagcauggugucugccggguccggagaggucgacagcuucucccuuggccuccuguguauuucuaucaugauugaagaggugaugcggagcagauggucccgcaaaaugcugaugacggggacacucgcugucuuuuuccugcuuaucaugggacagcugaccuggaacgaucucauucggcugugcaucauggugggcgccaaugcgucugacagaaugggcauggggacaaccuaccuggcucuuauggccaccuuuaagaugcgcccuauguucgccgucggacugcucuuuagacggcugacaagccgcgaggugcuccugcuuacgauuggccugucccucguggcuucugucgaacugcccaacagccuggaggaacuuggggauggacuggccaugggcaucaugauccucaaacugcucaccgacuuccagucccaucaacugugggcuacacuucugagccucaccuuuauuaagacaaccuucucucugcacuaugccuggaagacgauggcgaugguucuguccaucgugagccuuuuuccccugugucucucuacaaccucccagaaaaccacauggcugccugugcuccuggggagccuuggaugcaagccgcugaccauguuccugauugccgagaauaaaaucuggggcagaaagucuuggccccucaacgaaggcauuauggcugucgggaucguguccauccugcuuagcucccugcucaaaaacgauguuccucuggccggaccccucauugcuggcgggaugcugaucgccuguuacgugauuagcggaucuagcgccgaccuuucccuggagaaggcugcggaggucucuugggaagaggaagccgagcauagcggcgcuucccacaauauccugguggaaguucaggaugacgggacaaugaaaauuaaggaugaggagcgggacgauaugcucacgauccugcuuaaggccacccugcucgccgugucuggagucuauccucugagcauccccgcuacacucuucgugugguacuuuuggcagaaaaagaaacaacgcuccggcguccugugggacaccccuucucccccggaaguggagagagccguucuugaugacggcauuuaucggaucaugcagcgcgggcugcugggaagaagccaggugggcgucgggguguuccaggaaaacguuuuucauacaauguggcacgugacccggggagcgguccucauguaccaaggcaagcgccuggagccuuccugggcuagcgugaaaaaggaccuuauuucuuacgggggaggcuggagacugcagggcuccuggaauacgggggaggaagugcagguuaucgccgucgagcccggaaagaacccuaaaaaugugcagaccgcccccggcacauucaagaccagcgaaggggaggugggagcuauugcccucgauuuuaaaccgggcacaucuggguccccuaucgucaaccgggaaggaaagauugugggccuguauggcaaugggguugugaccacaagcggaacguacgucuccgcgaucgcucaagccaaagccucucaggagggcccccucccugagaucgaagacgagguguucagaaagcgcaaccugaccauuauggaucuucaccccgggagcggaaagacacggagauaucugcccgcuaucguucgcgaagccauuaaacggaagcugagaacccucauccuggcuccuacccgcguggucgccuccgagauggcggaagcccuuaaaggcaugccgauucgguaccagacaacggcugugaaguccgagcauaccgggaaagagaucguugaccugaugugccacgccacauuuaccaugagacuccugucucccgugcgcgucccuaauuauaacaugaucauuauggaugaagcucauuucacagaccccuccagcaucgccgcccggggcuacauuucuaccagagugggaaugggcgaggcugcggccaucuuuaugacggcuacaccucccgggagcguggaagccuucccucaauccaaugccgucauucaggaugaggaacgggacaucccggagcgcucuuggaacagcggauaugaguggaucaccgauuuucccggcaagaccguuugguucgugccuuccauuaagucugggaaugacaucgcuaacugucugcgcaagaauggaaagcgggugauucagcucagccgcaaaacauucgauaccgaauaccagaagaccaagaauaacgacugggacuacgucgugaccacggauaucuccgagaugggcgccaauuuuagagcggaccggguuauugaucccagacgcugccuuaagccugugauccugaaggacgggcccgaacgggucauucuggcuggcccgaugccugugacaguugccagcgccgcucaaagacgcggacggaucggcagaaaccacaauaaagagggggaucaguauaucuacaugggacagccccucaacaaugacgaggaucaugcccacuggaccgaagcgaagaugcugcuugacaacauuaauacacccgagggcaucauuccugcccuguucgaacccgagcgcgaaaaaucugcugccaucgauggggaguaucggcucagaggagaggcucgcaagaccuuuguggaacugaugagacggggcgaccugccugucuggcucuccuacaaaguggccagcgagggguuccaguauuccgaucgcagauggugcuuugacggcgaacggaacaaucaaguccuugaggaaaacauggauguggagauuuggacgaaggagggagaacgcaaaaagcugagaccgcgguggcuggacgcuagaaccuacucugacccccucgcccugcgcgaguucaaggaauuugcggccggccggagaagcguuuccggggaucuuauccuggagaucggaaaacucccucagcaccugacacagcgcgcucagaaugcccuggacaaccucgugaugcuucauaauucugaacaaggcgggcgggcuuauagacacgccauggaggagcugcccgauaccauugaaacacugaugcuccuggcccuuaucgcugugcugaccggaggcgucacacucuucuuucugagcggccgggggcugggaaagaccuccauuggccuccuuuguguuauggcgagcucugugcugcuguggauggccuccguggagccucauuggaucgcugccagcauuauccucgaguucuuucugaugguccuucugauccccgagccggaccgccagagaacgccucaggauaaccagcucgccuacgugguuauugggcugcuguucaugauccucacaguggcugccaaugagaugggacuucuggaaaccaccaaaaaggaccugggcauugggcacgucgcgguggagaaccaccaucacgccgcuaugcucgaugucgaccugcaucccgccucugcuuggacacuuuacgccguggcgaccacaaucauuacgccuaugaugcggcacaccaucgaaaacacaaccgccaauauuucccugacagcuaucgccaaccaagcugccauccucaugggacuggauaaaggcuggcccauuagcaagauggacaucggcguuccucugcucgcucuugggugcuauucucaggugaauccccugacccugacggccgcgguccucaugcugguggcccauuacgcuauuaucggaccgggccuucaggccaaggcuacccgcgaggcccagaagagaacagccgcggggauuaugaagaacccuaccguugauggaaucguggcuaucgaacuggaccccgucguguaugauacaaaauuugagaagcagcucggccagauuaugcugcugauccucuguaccagccagauucuucugaugcggacgacaugggcccugugcgaguccaucacccucgcuacagggccccugaccacccuuugggaaggaucuccuggcaaauucuggaauacaacgauugccgugagcauggccaacaucuuccgcggcuccuaccuggcuggggccggacucgcguuuagccugaugaagucccugggcgggggaagacggggcaccggggcccaaggagagacacucggcgaaaaguggaaacgccagcuuaaucagcugucuaagagcgaguucaacaccuauaaaagauccggcaucauggaaguugaccggucugaggcuaaggaggggcugaaaagaggagaaacaaccaagcacgccgucagccgcggcacggcuaagcuccggugguuuguggagagaaaucuggugaaaccggaagggaaggucauugaccuuggauguggccgcgggggaugguccuacuauugcgccggccugaaaaagguuacagaggugaaaggcuacaccaaagggggacccggccacgaggaaccuauccccauggcgaccuacggguggaaccucgugaaacugcauucuggaaaggaugucuucuuuauuccucccgagaagugugacacacugcucugcgauaucggcgaaagcuccccuaauccgaccauugaggaagggcggacacuuagagugcugaaaaugguugagcccuggcugcgcggaaaccaguucuguaucaagauucucaauccuuauaugcccagcguggucgagacgcuggaacaaaugcagcggaaacacggcggcaugcuugugagaaacccucugucucgcaauuccacccaugagauguacuggguuagcugcgggacaggaaacaucgugucugccgucaauaugaccucccggaugcuccugaacagauuuacaauggcucaccgcaagcccaccuaugaacgggacguggaucugggcgccgggacgagacacguggcugucgagccggaaguugccaaccucgacaucauuggacagcgcaucgagaauauuaaacaugagcacaagagcaccuggcauuacgaugaagacaacccuuauaagacaugggcuuaccacggcucuuaugaggugaaacccuccgggagcgccuccagcauggugaauggagucgugaagcugcuuaccaaacccugggauguuaucccuauggugacacagauugcgaugaccgacacaacccccuucggccaacagagagucuuuaaggaaaaaguggauacgcggacaccuaaggccaagcgcggcaccgcucagaucauggagguuaccgccaaauggcuguggggguuccucucuagaaacaagaaaccgcggaucuguacaagagaagaguuuacgcggaaggugcgcagcaaugcugccauuggagccgucuucguggacgagaaccaauggaacuccgcgaaagaagcuguugaggacgaaagauuuugggaucuggugcaucgggagcgcgaacuucacaagcagggcaagugcgcgaccugcgucuacaacaugauggggaaaagagagaagaaacugggagaguucggcaaggccaaagggucucgggcuaucugguacauguggcucggcgcccgcuuccuggaauuugaggcucugggauucaugaaugaagaccacugguuuagcagagagaacucccucucuggcguggagggggaaggacugcauaaacuuggcuauauucugcgggauaucagcaaaauucccgggggaaauauguacgccgacgauacagcgggcugggacacccgcaucacagaggaugaccuccagaacgaagccaagaucaccgauauuauggagccugaacacgcucugcuugccaaguccaucuucaaacugacauaucagaauaaggucgugagaguucaacggcccgcuaaaaacgggaccgugauggacgucauuucucgcagagaucagcggggcagcggacaggugggcacguacgggcucaauaccuuuacaaacauggaggcccagcugauccgccaaauggaguccgaaggaauuuucagcccuucugagcuggaaacccccaaccucgcgggcagagugcuggacuggcuugagaagcaugggguugaacggcugaaaagaauggccaucuccggagaugacuguguggucaagccgaucgacgaucgcuuugcuacagcccucaccgcucugaaugacaugggcaaggugcggaaagauauuccucagugggagcccagcaagggguggaacgacuggcagcagguuccuuucugcucucaccacuuucaucaacuuaucaugaaagauggcagagagauugugguccccugucgcaaucaggacgaacuggugggacgggccagagucucccagggcgcuggguggagccuccgcgagacggccugccugggaaaguccuaugcgcagauguggcaacugauguacuuccaccggagagaucuccgccuggccgcuaacgccaucuguucugccgugccuguugacugggugcccacaagccggaccacaugguccauucaugcucaccaucaguggaugaccacggaagauaugcuuagcgucuggaauagaguguggaucgaggaaaacccguggauggaggacaaaacccacauuucuuccuggggcgauguuccuuaucuggggaagcgcgaggaccaguggugcggaagccucaucggccugacagcccgggcgaccugggcuacaaauauccaaguggccauuaaccaggucagacggcuuaucgggaaugaaaacuaccuggacuacaugaccucuaugaagagauuuaaaaaugagauugaucccgaaggcgcccucugguga

SEQ ID NO: 19140 - RNA, 9879 nt, Artificial Sequence
  derived and/or modified CDS sequence (opt5) from DENV-1__GU131680__SS-prME
agcgugaccaugcugcucaugcugaugcccacggcccuugcuuuccaccugacgaccagaggaggggagccucauauggugguuuccaagcaggaacggggaaaaucucuccuguuuaagaccagcgccggagugaacaugugcacccuuaucgcgauggaccugggggagcucugugaagauacaaugaccuacaaaugcccgcgcauuacagaggcugaacccgacgauguggacuguuggugcaaugccaccgauacgugggucaccuauggaacauguucccagaccggcgagcacagacgggagaagcgcucuguggcccuggcuccucauguugggcugggacucgaaacaagaaccgagacguggaugagcuccgaaggcgccuggaaacagauccagcggguggagacaugggcucugcgccaccccggcuucaccgucauugcccuuuuucuggcgcaugccaucgggacaucuauuacccagaagggaaucaucuucauucuccugaugcuugugaccccuagcauggcuaugagaugcguuggcaucgggucccgggacuuuguggagggacugagcggcgccacaugggucgauguggugcucgaacacgggucuugugucacgaccauggcuaaggacaaacccacacuggauauugagcugcucaagaccgaaguuacaaacccugccgugcugcgcaaacuuugcaucgaggcgaagauuuccaauaccacgacagacagcagauguccgacccaaggagaagccacccugguggaggagcaggaugcuaacuucgucugccggcgcacauuuguggacagaggcuggggcaauggguguggacucuucggcaaagggucucugcuuaccugcgccaaguuuaagugcguuacaaaacuggaaggaaagaucgugcaguacgagaaccucaaauauuccgucauugugacgguucacaccggcgaucagcaucaaguggggaaugaaagcacagagcacggaaccacagcuaccaucacgccccaggccccuaccacagaaauccagcugaccgacuacggcgcccugacacucgacuguucuccccggaccggccuggauuucaacgagaugguccuucugacgaugaaggagaaauccuggcucgugcauaagcagugguuucuggaccuuccucugcccuggacaagcggggcuuccaccucucaagaaacauggaaucgccaggaucuccuggucaccuucaaaaccgcgcacgccaagaagcaggaggugguugugcugggaagccaagaaggcgcuaugcacacagcccucacgggggccaccgagauucagacauccggaaccacaaccaucuuugcuggccaucugaaaugcagacuuaagauggacaaacugacgcucaaggggaugagcuaugucauguguacaggcucuuucaaacuggaaaaggagguggccgagacccagcacggaaccguucuggugcagauuaaguacgaaggcacagaugcgccgugcaaaaucccuuucuccacccaagacgagaagggggucacacagaacggacggcuuauuacggcuaaucccaucgugaccgauaaagaaaagccugugaacaucgaggccgagccgcccuuuggcgaaagcuauauuguuaucggggccggagagaaagcucucaagcugucuugguucaagaaaggcagcuccauugggaagauguuugaagccacagcuagaggcgcccgccggauggcgauccugggagacaccgccugggauuucggcucuauugggggagucuuuacaagcgugggcaaacucgugcaucagaucuucgggaccgcuuacggaguccuguuuuccggcgugagcuggacgaugaagaucgggauuggcguucuucugaccuggcucggacucaauucuagauccacaagccugucuaugaccuguaucgccgugggccuugucacacucuaccugggggugaugguucaggcugacuccggaugcgugauuaacuggaaaggccgcgagcugaagugugggagcggaaucuucgucaccaaugaagugcacacauggaccgagcaauauaaguuucaggccgauuccccuaaacggcucucugcggccauuggcaaggcuugggaggaagggguuugcggcaucagaagcgccacgcgccuggagaacauuauguggaaacagaucuccaacgaacuuaaucauauccugcucgagaacgacaugaaguucacaguggucgugggagacguggcuggcauucugguccaggggaaaaagaugauccggccgcaacccauggaauacaaauauucuuggaaaagcuggggaaaggccaaaauuaucggcgccgauguucaaaauuccaccuuuauuaucgacgggccuaacacccccgaguguccugaugaccagagagcuuggaauaucugggagguggaagauuacggauucggcauuuuuacaaccaacaucuggcugaaacuucgcgacagcuauacacaggugugcgaucaccggcucaugucugcggccauuaaagacuccaaggcuguccacgccgauaugggcuacuggaucgagagcgagaagaaugagacauggaagcuggccagagcuucuuucauugaagugaagaccuguaucuggcccaaaucccauacacuguggagcaacgggguucucgagucugagaugaucauuccgaagauccacggaggcccuauuagccaacauaauuaucgccccggguacuucacccagacagccggaccuuggcaccugggcaaacuugaacuggacuuugaucucugcgaggggaccacgguggucguggacgaacacugcggaaaccggggccccucccugagaaccacaaccguuacaggcaagaucauucaugagugguguugccggagcuguacccugccuccccuucgcuucagaggggaggauggaugcugguacggcauggaaauccggccggugaaagagaaggaagagaaucucgucaagucuaugguguccgcggggagcggagaaguugacuccuuuucucugggccugcucuguaucagcauuaugaucgaggaggugaugagaucccgcuggucucggaaaaugcugaugacggggacacuugcugucuucuuucugcucauuaugggacagcugaccuggaacgaccugaucagacuuugcauuauggugggcgccaaugccagcgaucgcaugggcauggggacaaccuaucuggcucucauggccaccuucaagaugagaccuauguuugcggugggacugcuguuccggcgccugacauccagagaaguccuucugcucacgaucggccugucucugguugcuagcguggagcuucccaacucccuggaagaacugggggacggacuggccaugggcauuaugauccucaaacugcuuaccgauuuucaaagcuaccagcugugggccacacuccugucucugaccuucaucaagacaaccuuuucccuucacuaugcuuggaaaacgauggccauggugcugagcauugucucucucuucccccugugucucuccacaaccagccagaagaccacauggcugccugugcuucuggggucucugggaugcaagccgcucaccauguuucugaucgcugaaaauaaaauuuggggccggaaguccuggccccuuaacgagggcaucauggccguugggauugugagcauccugcucuccagccugcucaaaaacgacgucccucuggcgggaccccuuaucgccggcgggaugcugauugcuuguuacgugaucucuggaagcuccgccgaucugucucucgagaaggcugccgaaguuagcugggaggaagaggccgaacauuccggcgcuucucacaauauucugguggagguccaggacgaugggacaaugaaaaucaaggacgaggaacgcgaugacacgcuuaccauucugcucaaagcgacacugcucgccgugagcggagucuauccucuguccauccccgcuacccuuuucguguggcauuucuggcaaaagaagaaacagagaucuggcguucugugggauacaccuagcccucccgagguggaacgggccguccuggacgauggcaucuaccgcauuaugcagagagggcuccugggacggucccaggugggcguugggguguuucaagagaacgucuuccacaccauguggcacgugacgcgcggagccgugcuuauguaucagggcaagagacuggagcccagcugggcuucuguuaaaaaggaccucaucuccuacgggggaggcuggcgguuucagggcagcuggaauaccggggaagagguccaggugauugccguggaacccggcaagaacccuaagaauguccaaacagcgcccggcaccuucaagacaccggagggggaagugggagcuaucgcccuggacuuuaaaccuggcaccucugggucccccauuguuaacagagagggaaagaucgugggccucuacggcaauggggucgugacaacgagcggaaccuauguuuccgccauugcucaggccaaagcgucucaggagggcccucugcccgaaaucgaggaugaaguguuccgcaagcggaaccuuacaaucauggaccugcaucccgggagcggaaaaaccagacgcuaccugccugcuauuguccgggaggccaucaagagaaagcuccgcacccugauucuugccccgacacgggugguugcuuccgaaauggccgaggcucugaaaggcaugcccaucagauaucaaacgaccgccgucaagagcgagcacacagggaaagaaauugucgaucucaugugccaugcgaccuuuacaaugcgccugcugucuccugugcgggugcccaauuacaacaugaucaucauggacgaggcccacuucaccgauccuuccagcauugcugccagaggcuauaucucuacgcgggucggaaugggcgaagcugccgccauuuuuaugacagcuacacccccugggagcauggaggcguucccgcaguccaaugccguuauccaggacgaagaaagagauauucccgagagaucuuggaacagcggauacgaauggaucaccgacuuuccuggcaagacagugugguucgugcccuccaucaaagcugggaaugauauugccaacugucuccggaagaauggaaagcgcgucauccagcuuucuagaaaaaccuucgacacagaguaucaaaagaccaaaaacaacgauugggacuacgugguuacgacagacauuagcgaaaugggcgccaauuuucgggcugauagagugaucgacccucgccggugccugaagcccgucauucugaaagaugggccggagagagugauccucgccggcccuaugcccguuaccguggcguccgcugcccagcgccggggaagaauuggccgcaaccauaauaaggagggggaccaguacaucuauaugggacagccccugaacaaugaugaagaccacgcccacuggacagaggcuaagaugcuucuggauaacaucaauaccccugaaggcauuauccccgcccucuucgagccugaacgggagaaaagcgcggccauugacggggaguacagacugcgcggagaagcuagaaagacguuugucgagcugaugcggcgcggcgaucucccgguguggcuuucuuauaaagucgccuccgaaggguuccaauacagcgacagacgguggugcuuugauggcgagcgcaacaaucaggugcuggaagagaacauggacguugagaucuggaccaaggaaggagagcgcaaaaagcugcggcccagauggcucgaugcucgcacauauuccgacccucuggcccuucgggaguucaaagaguuugcugccggcagacgcucugugagcggggaccugauucucgaaaucggaaagcugccccagcaucugacccagcgggcgcaaaaugcccucgauaaccuugugaugcugcacaauuccgagcagggcgggagagcuuaccggcaugccauggaggaacugccugacacaaucgagacccucaugcugcuugcucugauugccguccucacaggaggcguuacccuguucuuucugucuggcaaggggcucggaaaaacgagcaucggccuucugugugugauggccuccagcgugcugcucuggauggcuucugucgaaccccacuggauugcggccuccaucauucuggaguucuuucuuauggugcugcucaucccggagccugaucgccagagaacaccccaggacaaccaacuggcuuauguugugaucgggcuccucuucaugauucuuaccgucgccgccaaugaaaugggacugcuggagaccacaaagaaagaucucggcaucgggcacguggcugucgaaaaccaucaccaugccgcgaugcuggacguggaucuucacccugccagcgcuuggacccuguacgccguugcuacaacgauuaucacccccaugaugcggcauacaauugagaacaccacagccaauaucucucucaccgcgauugccaaccaggcugccauccugaugggacuggacaagggcuggccuaucuccaaaauggauauuggcgugccccuccuugcucuggggugcuacagccaggucaauccgcugacgcucaccgccgcugugcugaugcuuguugcccacuaugcgaucauuggaccuggccugcaagccaaggcuacacgcgaagcccagaagagaaccgcugccgggaucaugaaaaaccccacaauugacggaaucguggccaucgaucucgaccccgucguguacgaugcgaaguuugagaaacagcugggccagauuaugcugcucauccuuuguaccucucaaauucugcugaugcggacgacaugggcucucugcgagagcaucacccuggccacagggccucuuaccacccugugggaaggauccccgggcaaguucuggaauacaacgauugcugugucuauggccaacaucuuccgcggcagcuaucucgccggggcuggacuggccuuuucccugaugaaaagccucggcgggggaagacggggcaccggggcgcagggagagacacuuggcgaaaaguggaagcgccagcugaaucagcuguccaaaucugaguucaacaccuacaagagaagcggcaucauggaaguugaccgguccgaggccaaagaggggcucaagagaggagaaacaaccaaacacgcugucucucgcggcacggccaagcugcggugguuuguggagagaaaucuugugaagcccgaagggaaagucauugaccugggauguggccgcgggggauggagcuauuacugcgcuggccucaagaaaguuacagaggugaagggcuauaccaaagggggaccuggccaugaggaacccaucccuauggccaccuacggguggaaccuggugaagcugcacuccggaaaagaugucuucuuuauucccccugagaagugugacacacuccuuugcgauaucggcgaaucuagcccgaaucccaccauugaggaagggcggacacugagagugcugaagaugguugagccuuggcuccgcggaaaccaauucuguaucaaaauucugaaucccuacaugccuuccguggucgagacgcuugaacagaugcagcggaagcauggcggcaugcuggugagaaacccccucagccgcaauucuacccacgagauguauuggguuuccugcgggacaggaaacaucgugagcgcggucaauaugaccucucggaugcugcugaacagauuuacaauggcccaccgcaaaccgaccuacgaacgggacguggaucucggcgcugggacgagacauguggccgucgagccugaaguugcuaaccuggacaucauuggacagcgcaucgagaauauuaagcacgagcauaaauccaccuggcacuaugaugaagacaaccccuacaagacaugggccuaucauggcagcuacgaggugaagcccucuggguccgcuagcuccauggugaauggagucgugaaacuucugaccaagccuugggauguuauccccauggugacacaaauugccaugaccgacacaaccccuuucggccagcagagagucuuuaaagaaaagguggauacgcggacaccgaaagcgaagcgcggcaccgcccaaaucauggagguuaccgcuagauggcucuggggguuccugagccggaacaagaaacccagaaucuguacacgggaagaguuuacgcgcaaggugagaucuaaugccgcuauuggagccgucuucguggacgagaaccaguggaauagcgccaaagaagcgguugaggacgaucgguuuugggaccuugugcaccgcgaaagagagcugcacaagcagggcaaaugcgcuaccugcgucuauaacaugauggggaagcgggaaaagaaacucggagaguucggcaaggccaaagggucccgcgccaucugguacauguggcugggcgcuagauuccuggaguuugaagcccucggauucaugaaugaggaucauugguuuucucgggaaaacagccuguccggcguggagggggagggacuucacaagcugggcuacauucuccgcgacaucucuaaaauuccugggggaaauauguaugcugaugacacagccggcugggauaccagaaucacagaagacgaucugcagaacgaggcgaagaucaccgacauuauggaacccgagcaugcccuucuggcuaaaagcaucuucaagcucacauaccaaaauaaggucgugcggguucagcgcccugccaaaaacgggaccgugauggaugucauuuccagacgggaccagcgcggcucuggacaggugggcacguaugggcugaauaccuuuacaaacauggaagcucaacugaucagacagauggagagcgagggaauuuuccuccccaacgaacuggagaccccgaaucuugccggccgggugcuggauuggcucgaaaaguacgggguugagagacugaaacgcauggcgaucuccggagacgacuguguggucaagccuaucgaugaccgguuugccacagcucuuaccgcccugaacgauaugggcaaagugagaaaggacauuccccagugggaaccuagcaagggguggaaugauuggcagcaaguucccuucugcucucaccacuuucaucagcucaucaugaaagacggccgcgagauuguggucccuugucggaaccaggaugagcuggugggcagagcucgcgucucccagggcgccggguggagccugcgggaaacggcuugccucggaaagucuuaugcccaaauguggcagcugauguacuuccacagacgcgaccuucggcuggcggccaaugcuaucuguuccgccgugcccguugauugggugccgacaagcagaaccacaugguccauucaugcccaccaucaguggaugaccacggaggacaugcucucugucuggaaccgcguguggaucgaagagaauccuuggauggaagauaaaacccggauuagcuccugggaggacguucccuaucugggcaagagagaggaccaauggugcgggagccuuaucggacugacagcucgggccaccugggcgacaaacauccagguggcuauuaaucaggucagacgccucaucggcaacgaaaauuacucugauuacaugaccuccaugaaacgguuuaagaacgagagcgaacccgagggggcccugugguga

SEQ ID NO: 19141 - RNA, 9879 nt, Artificial Sequence
  derived and/or modified CDS sequence (opt5) from DENV-1__GU131681__SS-prME
agcgugaccaugcugcucaugcugaugcccaccgcccuugcuuuccaccugacgacccggggcggggaaccucauaugauugucaccaagcaggaacggggaaaaucccuccuguuuaagaccucugccggcguuaacaugugcacccuuauugccauggaccugggggaacucugugaagauaccaugacauacaaaugcccccgcaucaccgaggcugaacccgacgauguggacuguuggugcaaugccacggauaccugggugaccuauggaaccuguagccaaacaggcgagcacagacgggacaagcgcuccguugcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguucacagugguugugggagaugucgugggcauucucgcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaagcugcgcgauuccuacacacagguuugcgaccaccggcuuaugagcgcggccauuaaagauucuaaggcugugcaugccgacaugggcuauuggaucgaauccgagaaaaaugaaaccuggaagcucgccagagcuagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgccggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuucaaaggggaggacggaugcugguacggcauggagauuagaccggugaaggaaaaggaggaaaaucuuguuaaaagcauggugucugcgggguccggagaggucgacagcuuuucccucggccugcuguguaucucuauuaugaucgaagaggugaugcggagcagauggucccgcaagguucucaugacagggacccuggcuguguuccuucugcucauuaugggacagcugacauggaacgaucugauccggcuuugcauuauggucggcgccaaugccucugacagaaugggcauggggaccaccuaucuggcucucauggccacauuuaaaaugcgcccuauguucgcggugggacugcucuuuagacggcugacgagccgcgaggugcuucugcucaccaucggccugucccuggucgcuucuguugaacuucccaacagccuggaggaacucggggauggacuggccaugggcaucaugauucucaagcugcuuacagacuuccaaucccaccagcugugggccacccuccugagccugacauuuaucaaaaccacgcuuucucugcauuacgcuuggaagacaauggccauggugcucuccauugugagccuguucccccucugucugucuaccaccucccagaagacaaccuggcuuccuguccugcuggggagccucggaugcaaaccgcugacaauguuucuuaucgcugagaauaagauuuggggcagaaaaucuuggccccugaacgaaggcaucauggccguggggguuguguccauccuccugagcucccuccugaagaacgaugucccucuugcgggaccccugauugccggcgggaugcugaucgcuuguuaugugauuagcggaucuagcgccgaccucucccuggagaaagcugccgagguuucuugggaagaggaagccgagcacagcggcgcuucccauaauauccuuguggaaguccaggaugacgggacgaugaagauuaaagaugaggagcgggacgauacccugacaauccuccugaaggcgacccuccuggccgugucuggagucuacccucuuagcauccccgcuacacuguucgugugguauuuuuggcaaaagaaaaagcagcgcuccggcguucugugggacaccccuucucccccggaaguggagagagccguccucgaugacggcauuuaccggaucaugcagcgcgggcugcuuggaagaagccaggugggcguugggguguuccaagaaaacgucuuccacacgauguggcacgugacccggggagccgugcugauguaucagggcaaacgccucgagccuuccugggcuagcguuaagaaagaccugauuucuuacgggggaggcuggagacuccagggcuccuggaauacaggggaggaaguccaggugaucgccguggagcccggaaagaacccuaagaauguccaaaccgcgcccggcacauuuaaaaccccggaaggggaggugggagcuauugcccuggauuucaagccuggcacaagcgggucucccaucguuaaccgggaaggaaaaauugugggccuuuacggcaauggggucgugacgaccuccggaacauauguuagcgccaucgcucaggccaaggcgucccaggagggcccucugcccgagaucgaagacgagguguuuagaaaacgcaaccugaccauuauggaucuccaucccgggucuggaaagacccggagauaccugccugcuaucguccgcgaagccauuaagcggaaacuuagaacacugauccucgccccgacgcgcgugguugcuagcgagauggccgaagcucugaagggcaugcccauucgguaucaaaccacagccgugaaauccgagcacaccgggaaggagaucgucgaccugaugugccaugcgacauucaccaugagacuccuuagcccugugcgcgugcccaauuacaacaugaucauuauggaugaagcccacuuuacggacccuucuuccaucgcugcccggggcuauauuagcacaagagucggaaugggcgaggcugccgccaucuucaugaccgcuacacccccugggucuguugaagcguuuccgcagagcaaugccgugauucaggaugaggaacgggacauccccgagcgcuccuggaacucuggauacgaguggaucacagauuucccuggcaaaaccgugugguuuguccccagcauuaaguccgggaaugacaucgcuaacugucugagaaagaauggaaaacgggugauucagcugucucgcaagacauucgauaccgaauaucagaagacgaagaacaacgacugggacuacguugugacaaccgauaucagcgagaugggcgccaauuuuagagccgaccgggucauugauccuagacgcugccucaaacccgugauccugaaggacgggccggaacggguuauucuugcuggcccuaugcccgugacagucgccuccgcggcucagagacgcggacggaucggcagaaaccauaauaaggagggggaucaguacaucuauaugggacagccccugaacaaugacgaggaucacgcccacuggaccgaagccaaaaugcuccuggacaacauuaauacgccugagggcaucauucccgcucuguucgaaccugagcgcgaaaagagcgccgcgaucgauggggaguaccggcucagaggagaggcccgcaaaaccuucguggaacuuaugagacggggcgaccugccggucuggcugucuuauaagguggcuuccgagggguuucaauacagcgaucgcagauggugcuucgacggcgaacggaacaaucagguucucgaggaaaacauggauguggagauuuggacaaaagagggagaacgcaagaaacugagaccccgguggcuugacgccagaaccuauuccgacccucuggcucuccgcgaguuuaaggaguucgccgcuggccggagaucugugagcggggaucugauccuggagaucggaaagcucccccagcaucuuacacagcgcgcccaaaaugcgcuggacaaccuggucaugcuccacaauuccgaacagggcgggcgggccuacagacaugcuauggaggagcugccugauaccauugaaacacuuaugcugcucgcccugaucgcuguucugaccggaggcgugacgcucuuuuuccuuucuggccgggggcugggaaaaacaagcauuggccugcucugugugauggccuccagcguccugcuuuggauggccucuguggagccccacuggaucgcugcguccauuauccuggaauuuuuccucaugguucugcugaucccggagccugaccgccagagaacaccccaggauaaccaacucgccuauguggucauugggcuucuguuuaugauccugaccguggcugccaaugagaugggacuccuggaaacaaccaagaaagaccuuggcauugggcacgucgccguggagaaccaucaccaugcuacaaugcuggauguugaccuccacccugccagcgcguggacgcuguacgccguggcuaccacaaucauuacccccaugaugcggcauacaaucgaaaacaccacggccaauauuucucugaccgcuaucgccaaccaggcggccauccucaugggacuugauaagggcuggccuauuuccaaaauggacaucggcgucccccugcuggcucucgggugcuacagccaggugaauccgcugacacuuaccgccgcuguucugaugcucguggcccacuaugcuauuaucggaccuggccugcaagccaaggcgacacgcgaggcccagaagagaaccgcugccgggauuaugaaaaaccccacggucgauggaaucguggcuaucgaccuggaucccgugguuuacgacgccaaguucgaaaaacagcucggccagauuaugcuucugauccuguguacaucucaaauucuccugaugcggaccacaugggcccuuugcgagagcaucacccuggcgaccgggccucucacaacgcugugggagggauccccgggcaaguuuuggaauaccacaauugcugucucuauggccaacaucuuccgcggcagcuaucuggcuggggccggacucgccuuuucccuuaugaaaagccugggcgggggaagacggggcaccggggcucagggagaaacacugggcgagaaguggaagcgccagcucaaucagcuguccaaaucugaguucaacaucuacaagagaagcggcauuauggagguggaccgguccgaagccaaagaggggcuuaagagaggagagaccacgcgccacgcggugucucggggcacagccaaacugagaugguucgucgaacgcaaucucguuaagcccgaggggaaggugaucgaucugggauguggcagagggggauggagcuauuacugcgcuggccugaaaaaggugaccgaagucaaaggcuauaccaaagggggaccuggccaugaggaacccauuccuauggccacauacggguggaaccucgugaaacuucacuccggaaaggacgucuuuuucacacccccugagaaaugugauacacugcugugcgacaucggcgagucuagcccgaaucccacgauugaagaggggagaacccuccgcgugcugaagauggucgaaccuuggcuucggggaaaccaauuuuguaucaagauucugaaucccuacaugccuuccgugguugagacacucgagcagaugcagagaaaacauggcggcaugcuggugcgcaacccccugagcagaaauucuacccacgaaauguauugggucuccugcgggacaggaaacaucgugagcgcugugaauaugaccucuagaaugcuccugaaccgcuucacgauggcccaccggaagccgaccuacgagagagaugucgaccuuggcgcggggacacgccauguugccguggaaccugagguggcuaaccuggauaucauuggacagagaaucgaaaauauuaaacacgagcauaaguccaccuggcacuaugacgaggauaaccccuacaaaacaugggccuaucauggcagcuacgaagucaagcccucuggguccgcuagcuccauggugaauggaguugugaagcuccugaccaaaccuugggacgucauccccauggugacacaaauugccaugaccgauacgacaccuuuuggccagcagcggguuuucaaggagaaaguggacacccgcaccccgaaggcuaaaagaggcacagcccaaaucauggaagucacggcgcgguggcuuuggggguuucugagcagaaacaagaagccccggaucuguacccgcgaggaguucacaagaaaagugcggucuaaugccgcuauuggagccguuuuuguggacgagaaccaguggaauagcgcuaaggaggccgucgaagaugagcgcuucugggaccucgugcagaaagaaagagagcugcacaagcagggcaaaugcgcgaccugcgucuauaacaugauggggaagcgggaaaagaaacugggagaguuuggcaaggcgaaagggucccgcgcuaucugguacauguggcucggcgccagauuccuggaguuugaagcccuuggauucaugaaugaggaucacugguucucucgggaaaacagccuguccggcguggagggggagggacuccauaagcugggcuacauucuucgcgacaucucuaaaauuccugggggaaauauguaugcugaugacacagccggcugggauaccagaaucacagaagacgaucugcaaaacgaggcuaagaucaccgacauuauggaacccgagcacgcccuccuggcgacgagcaucuuuaaacugaccuaccagaauaagguugugcggguccagcgcccugccaagaacgggacagugauggaugugauuuccagacgggaccagcgcggcucuggacaaguuggcaccuaugggcucaauacauucaccaacaugggagcucagcugaucagacagauggaaagcgagggcaucuuuucccccagcgagcuugaaaucccgaaccuggccgagcgggugcucgauuggcuggaaaaauacggggucgagagacuuaagcgcauggcuaucucuggagacgacugugugguuaaaccuauugaugaccgguucgccacggcgcugacagcccucaaugauaugggcaaggugagaaaagacgucccccagugggaaccuuccaagggguggaacgauuggcaacaggugcccuuuugcagccaucacuuccaccagcugaucaugaaggacggccgcgagauugucgugccuugucggaaucaggaugagcugguuggacgggcucgcgugucucaaggcgccggguggucccuccgggaaaccgcuugccugggaaaaagcuaugcccagauguggcagcuuauguacuuucauagacgcgaccugcggcucgcugccaacgcgaucuguuccgccguccccguggauuggguuccgacaucuagaaccacguggagcauucacgcucaucaccaauggaugaccacagaggacaugcuguccguguggaaucgcgucuggaucgaagagaacccuuggauggaagauaagacccaugugagcucuuggggcgacgugcccuaucuugggaaacgggaggaccaguggugcggaucccugauuggccucacagccagagccaccugggcuagcaauauccagguugccaucaaccagguccggagacugauugggaaugagaacuaccuggauuacaugacaucuaugaagcgcuucaaaaaugaaggcgaccccgagggagcgcucugguga

SEQ ID NO: 19142 - RNA, 9879 nt, Artificial Sequence
  derived and/or modified CDS sequence (opt5) from DENV-1__GU131682__SS-prME
agcgugaccaugcugcucaugcugaugcccacagcccuugcuuuccaccugacgaccagaggcggggaaccucauaugaucgucuccaagcaggaacgggggaaaucucuccuguuuaagacaagcgccggcguuaacaugugcacccuuauugccauggaccugggggaacucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugucauugggaccucuaucacccagaagggaaucauuuucauccuccugaugcuugugacaccuagcauggcgaugagaugcguuggcauugggucccgggauuuuguggagggacugagcggcgccacgugggucgacguggugcucgagcacgggucuugugucaccacaauggcuaaggauaaacccacccuggacaucgaacugcucaagacagagguuaccaacccugccgugcugcgcaaacuuugcauugaagcuaagaucuccaauacgacaaccgauagcagauguccgacccaaggagaggccacacugguggaagaacaagacgcgaacuucgucugccggcgcaccuuuguggauagaggcuggggcaauggguguggacucuucggcaaagggucucugauuacaugcgccaaguuuaagugcguuacgaaacuugagggaaagaucgugcaguacgaaaaccugaaauauuccgucaucgugaccguucacacaggcgaccagcaucaaguggggaaugagagcaccgaacacggaacaaccgcuacgauuacaccccaagccccuaccaccgagauccagcucacagacuacggcgcucugacccuggauuguucuccccggacgggccucgacuucaacgaaaugguccugcuuacaaugaaggagaaauccuggcuggugcauaagcagugguuucucgaucugccucuucccuggaccagcggggccuccacaucucaagagaccuggaaucgccaggaccugcucgucaccuucaaaacagcccacgcuaagaagcaggaagugguugugcugggaagccaagagggcgcgaugcacacggcccugaccggggcuacagaaauucagaccuccggaacaaccacgaucuuugccggccaucucaaaugcagacugaagauggauaaacuuacacugaaggggaugagcuaugucauguguaccggcucuuucaaacucgagaaggaaguggccgagacccagcacggaacaguucuggugcagauuaaguacgagggcaccgacgcuccgugcaaaaucccuuucuccacacaagaugaaaagggggucacgcagaacggacggcugaucaccgccaaucccauugugacagacaaagagaagccugugaacaucgaagcggagccgcccuuuggcgagagcuauauuaucauuggggcuggagaaaaagcccuuaagcucucuugguucaagaaaggcagcuccaucgggaagauguuugaggccaccgcuagaggcgcccgccggauggcuauccugggagauacagccugggacuucggcucuauugggggaguuuuuaccagcgucggcaaacuggugcaucagaucuucgggacggcguacggagugcucuuuuccggcgucagcuggaccaugaagauugggaucggcgugcugcuuacauggcugggacucaauucuagauccaccagccugucuaugacauguauugccguuggccuggugacccuuuaccucggggucauggugcaggcugauuccggaugcguuaucaacuggaaaggccgcgaacugaagugugggagcggaauuuucgugacaaaugagguccacaccuggacggaacaauauaaguuucaggccgacuccccuaaacggcugucugcugccaucggcaaggcgugggaggagggggugugcggcaucagaagcgccacacgccucgaaaacauuauguggaaacagaucuccaacgagcugaaucauauucuucuggaaaacgacaugaaguucaccguuguggucggagauguggcuggcauccucgcccaggggaaaaagaugauucggccgcaacccauggagcacaaauacucuuggaaaagcuggggaaaggcuaagaucaucggcgccgacgugcagaauaccacauuuauuaucgaugggccuaacacccccgaauguccugacgaucagagagccuggaauauuugggaggucgaggacuauggauucggcaucuuuacgacaaacauuuggcugaagcugcgcgauuccuacacccagguuugcgaccaccggcuuaugagcgcugcgaucaaagauucuaaggccgugcaugcugacaugggcuauuggaucgaauccgagaaaaaugaaacauggaagcucgccagagccagcuucauugaggugaagaccuguaucuggcccaaaucucacacacugugguccaacgggguccuggaaagcgagaugauuaucccgaagauuuacggaggcccuaucucucaacauaauuaucgccccggguacuucacccagacggcuggaccuuggcaccucggcaaacuggagcuugauuuugaccugugcgaagggaccacagugguuguggaugagcacugcggaaaccggggccccagccucagaaccacaaccgucacgggcaagaucauucaugaaugguguugccgguccuguacacugccuccccugcgcuucagaggggaggacggaugcugguacggcauggagauccggccggugaaagaaaaggaggaaaaucuuguuaagagcauggugucugccggguccggagaggucgacagcuuuucccucggccugcuguguauuucuaucaugauugaagaggugaugagaagccgcuggucccggaaaaugcucaugaccgggacacuggcgguuuucuuucuucugaucaugggacagcucaccuggaacgaucugauuagacugugcaucauggugggcgcuaaugccucugaccgcaugggcauggggaccacauaucuugcccugauggcuacguucaagaugagaccuauguuugccgucggacuccuguuccggcgccucaccagcagagaggugcugcuucugacaaucggccucucccugguggcgucugucgaacugcccaacagccuugaggaacugggggauggacucgcuaugggcauuaugauccugaaacuccugaccgacuuucaaucccaccagcuuugggccacacugcucagccugaccuucauuaagacgacauuuucucugcauuacgccuggaaaaccauggcuaugguucuuuccaucgugagccuguucccccucugucugucuaccacaucccagaagaccacauggcucccugugcugcuugggagccugggaugcaagccgcugacgauguuucucauugccgagaauaaaaucuggggccggcgcucuuggccccugaacgaaggcaucauggcugucgggauuguguccauccuucugagcucccuccugaagaacgauguuccucucgccggaccccugauugcgggcgggaugcuuaucgccuguuaugugauuagcggaucuagcgcugaccugucccuggagaaagccgcugaggucucuugggaagaggaagccgagcacagcggcgccucccauaauauccucguggaaguucaggaugacgggaccaugaagaucaaagaugaggagagagacgauacacugaccauucuucugaaggcuacacuccuggcggugucuggagucuacccucucagcauccccgccacccuguucgugugguauuucuggcagaagaagaagcagcgguccggcguccuuugggacacgccuucucccccggaaguggagcgcgcuguucuggaugacggcauuuacagaaucaugcagcgggggcugcucggacgcagccaggugggcgucgggguguuucaagaaaacguuuuccacaccauguggcacgugacaagaggagccguccugauguaucagggcaaacggcuugagccuuccugggccagcgugaagaaagaccugauuucuuacgggggaggcuggagacuccagggcuccuggaauaccggggaggaagugcagguuaucgcugucgagcccggaaagaacccuaaaaaugugcaaacagcccccggcaccuuuaagacaccggaaggggaggugggagcgauugcucuggauuucaagccuggcacgagcgggucucccaucgucaaccgcgaaggaaaaaucgugggccucuacggcaaugggguugugaccacauccggaaccuaugucagcgccauugcccaggcuaaggccucccaggagggcccucugcccgagaucgaagacgagguguuucggaaaagaaaccuuaccauuauggaucugcaucccgggucuggaaagacacgccgguaccugccugcgaucguuagagaagcuauuaaacgcaagcuccggacgcugauccuugccccgaccagaguggucgccagcgagauggcugaagcccugaagggcaugcccauccgcuaucaaacaaccgcugugaaauccgagcacacagggaaggagauuguugaccucaugugccaugccaccuucacgaugcggcugcugagcccugugagaguccccaauuacaacaugaucauuauggaugaagcgcacuuuacagacccuucuuccaucgccgcucggggcuauauuagcacccgcgugggaaugggcgaggccgcugccaucuucaugaccgccacacccccugggucuguggaggcuuuuccgcagagcaaugcggucauccaggaugaggaaagagacauucccgagcgguccuggaacucuggauacgaguggaucaccgauuucccuggcaaaacaguuugguuugugcccagcauuaaguccgggaaugacaucgccaacugucuccgcaaaaauggaaagagagugauucagcuuucucggaagaccuucgauacggaauaucagaaaaccaagaacaacgacugggacuacgucgugaccacagauaucagcgagaugggcgcuaauuucagagccgaccgcguuauugauccucggagaugccugaaacccgugauccugaaggacgggccggaacgcgucauccucgccggcccuaugcccgugaccguugcuuccgccgcgcagcggagaggacgcauuggccggaaccauaauaaagagggggaucaguacaucuauaugggacagccccugaacaaugacgaggaucacgcucacuggacggaagccaagaugcuucuggacaacauuaauaccccugagggcaucauucccgcccucuuugaaccugagagagaaaagagcgcugccaucgauggggaguaccgccugagaggagaggcgcggaaaacauucguggaacugaugcgcagaggcgaccucccggucuggcuuucuuauaagguggccuccgagggguuucaauacagcgaucggcgcuggugcuucgacggcgaaagaaacaaucagguccuggaggaaaacauggauguggagaucuggaccaaagagggagaacggaagaaacugagaccccgcuggcucgacgcucggacauauuccgacccucuggcccuuagagaguuuaaggaguucgcugccggccgccggucuguuagcggggaucugauucucgagaucggaaaacugccccagcaucugacccagagagcucaaaaugcccucgacaaccuugugaugcugcacaauuccgaacagggcgggcgggcguaccgccaugccauggaggagcugccugauacaauugaaacccucaugcugcuugcucugaucgccgugcucacgggaggcgucacacuguuuuuccugucuggcagagggcucggaaagaccagcauuggccuucuguguguuauggcuuccagcgugcugcucuggauggccucuguggagccccacuggaucgccgcuuccaucauucuggaauuuuuccuuaugguccugcucaucccggagccugaccggcagcgcacaccccaggauaaccaacuggcguaugugguuauugggcugcucuuuaugauccuuacaguggccgcuaaugagaugggacugcuggaaaccacaaagaaagaccucggcauugggcacgucgccguggagaaccaucaccaugccgcuaugcuggaugucgaccuucacccugccagcgcguggacgcuguacgccguggcuaccacaaucauuacccccaugaugagacauacaaucgaaaacaccacggccaauaucucucucaccgcuauugccaaccaggcggccauccugaugggacuggauaagggcuggccuauuuccaaaauggacaucggcguuccccuccuugcucuggggugcuacagccaggugaauccgcugacacucaccgccgcuguccugaugcuuguggcccacuaugcuauuaucggaccuggccugcaagccaaggcgacacgggaggcccagaaacgcaccgcugccgggaucaugaagaaccccacgguugauggaauuguggcuaucgaccucgaucccgucguguacgacgccaaguucgaaaaacagcugggccagauuaugcugcucauccuuuguacaucucaaauucugcugaugagaaccacaugggcccucugcgagagcaucacccuggcgaccgggccucuuacaacgcugugggagggauccccgggcaaguuuuggaauaccacaaucgcugugucuauggccaacauuuuccggggcagcuaucucgcuggggccggacuggccuucucccugaugaaaagccucggcgggggacgcagaggcaccggggcucagggagaaacacuuggcgagaaguggaaacggcagcugaaucagcuguccaagucugaauuuaacaccuacaagagaagcggcaucauggagguugaccgcuccgaagccaaagaggggcucaagcggggagagacgacaaaacacgcggucucuagaggcaccgccaagcugcgcugguucguggaacggaaucuugugaaacccgaggggaaggucauugaucugggauguggcagagggggauggagcuauuacugcgcuggccucaagaaaguuaccgaagugaagggcuauacaaaagggggaccuggccaugaggaacccaucccuauggccaccuacggguggaaccuggugaagcugcacuccggaaaagacgucuuuuucauucccccugagaagugugauacacuccuuugcgacaucggcgagucuagcccgaaucccacgauugaagaggggcgcacccugcgggugcugaaaaugguugaaccuuggcucagaggaaaccaauuuuguaucaagauccugaaucccuacaugccuuccguggucgagacacuugagcagaugcagcgcaagcauggcggcaugcuggugcggaacccccucagcagaaauucuacccacgaaauguauuggguuuccugcgggacaggaaacauugugagcgcugucaauaugaccucucgcaugcugcugaaccgguucacgauggcccacagaaaaccgaccuacgagcgcgauguggaccucggcgcggggacaagacauguggccgucgaaccugagguugcuaaccuggauaucauuggacagcggaucgaaaauauuaagcacgagcauaaauccaccuggcacuaugacgaggauaaccccuacaagacaugggccuaucauggcagcuacgaagugaaacccucuggguccgcuagcuccauggugaauggagucgugaaacuucugaccaagccuugggacguuauccccauggugacacaaaucgccaugaccgauacgacaccuuuuggccagcagcgcgucuucaaagagaagguggacaccagaaccccgaaagcuaagcggggcacagcccaaauuauggaaguuacggcgaaauggcucuggggguuucugagcagaaacaagaagccccggaucuguacccgcgaggaguucacaagaaaagugcggucuaaugccgcuauuggagccgucuuuguggacgagaaccaguggaauagcgcuaaggaggccguugaagaugagcgcuucugggaccuugugcacagagaacgggagcugcacaaacagggcaagugcgcgaccugcgucuauaacaugauggggaaacgcgaaaagaagcucggagaguuuggcaaagcgaagggguccagagcuaucugguacauguggcugggcgcccgguuccuggaguucgaagcccucggauuuaugaaugaggaucauugguucucucgcgaaaacagccuguccggcguggagggggagggacuucacaaacugggcuacauucucagagacaucucuaagaucccugggggaaauauguaugcugaugacacagccggcugggauacccggauuacagaagacgaucugcagaacgaggcucgcaucaccgacauuauggaacccgagcaugcccuucuggcgaaaagcaucuuuaagcucacguaccaaaauaaagucgugagaguucagcggccugccaagaacgggaccgugauggaugucauuucccgcagagaccagcggggcucuggacaggugggcacauaugggcugaauaccuucacaaacauggaagcucaacugaucagacagauggagagcgagggaaucuuuucccccagcgaacucgagaccccgaaccuggccgaacgcgugcuugauuggcuggagaaguacggcguugaacggcucaaaagaauggcuauuucuggggacgacuguguggucaagccuaucgaugaccgcuucgccacggcgcugacagcccuuaaugauaugggaaaagugcggaaggacauuccccagugggagccuuccaaaggcuggaacgauuggcagcaaguucccuuuugcagccaccacuuccaucagcugaucaugaaggacgggagagagauuguggucccuugucgcaaucaggaugaacucgugggccgggcuagagucucucagggagccggcuggucccugcgcgagaccgcuugccugggaaagagcuaugcccaaauguggcagcucauguacuuucaccggagagaccugcgccuugcugccaacgcgaucuguuccgccgugcccguugauuggauuccgacaucucggaccacguggagcauccaugcucaccaucaguggaugaccacagaagacaugcuguccguguggaauagagucuggaucgaggaaaacccuuggauggaggauaaaacccacauuagcucuuggggagacgugcccuaucucggcaagcgggaggaccaauggugcgggucccugaucggacuuacagccagagccaccugggcuacaaauauucagguugccaucaaccaggugcgccggcugauuggcaaugaaaacuaccucgauuacaugaccagcaugaaaagauucaagaaugagucugaccccgaaggggcgcugugguga

SEQ ID NO: 19143 - RNA, 9879 nt, Artificial Sequence
  derived and/or modified CDS sequence (opt5) from DENV-1__GU131683__SS-prME
agcgugaccaugcugcucaugcugaugcccacagcccuugcuuuccaccugacgaccagaggcggggagccucauaugaucgucuccaagcaggaacggggaaaaucucuccuguuuaagacaccggccggcguuaacaugugcacccuuauugcgauggaccugggggagcucugugaagauacaaugaccuacaaaugcccccgcaucacagagaccgaaccugacgauguggacuguuggugcaaugcuacggauaccugggugacauauggaaccuguagccaaacaggcgagcacagacgggacaagcgcuccgucgcccuggccccccauguggggcugggacucgagaccagaacggaaacauggaugucuagcgagggcgcuuggaaacagauucagcggguugaaaccugggcccugcgccacccuggcuucacagugaucgcucuuuuucuggcccaugcgauugggaccuccaucacccagaagggaaucauuuucauccuccugaugcuugucacacccucuauggccaugagaugcgugggcauugggagccgggauuuuguugagggacuguccggcgcuacguggguggacgucgugcucgagcacgggagcugugugaccacaauggccaaggauaaaccuacccuggacaucgaacugcucaagacagaggucaccaacccggcuguucugcgcaaacuuugcauugaagccaagaucucuaauacgacaaccgauuccagaugucccacccaaggagaggcgacacugguggaagagcaggacgccaacuucgugugccggcgcaccuuugucgauagaggcuggggcaauggguguggacucuucggcaaagggagccugauuacaugcgcuaaguuuaagugcgugacgaaacuugagggaaagaucguucaguacgaaaaccugaaauauucugugaucgucaccgugcacacaggcgaccagcaucaaguugggaaugaguccaccgaacacggaacaaccgccacgauuaccccucaggcucccacaaccgagauccagcucacagacuacggcgcccugacccuggauuguagcccucggacgggccucgacuucaacgaaauggugcugcuuacaaugaaggagaaaucuuggcuggcccauaagcagugguuucucgaucugccccuuccguggaccuccggggcuagcacaucccaagagaccuggaaucgccaggaccugcucgucaccuucaaaacagcgcacgccaagaagcaggaaguggucgugcugggaucucaagagggcgcuaugcacacggcccugaccggggccacagaaauucagaccagcggaacaaccacgaucuuugcuggccaucucaaaugcagacugaagauggauaaacuuacacugaaggggauguccuauguuauguguaccggcagcuucaaacucgagaaggaacuggccgagacccagcacggaacagugcugguccagauuaaguacgagggcaccgacgcgccuugcaaaauccccuucucuacacaagaugaaaagggggugacgcagaacggacggcuuaucaccgcuaauccuauuguuacagacaaagagaagcccgugaacaucgaagccgagcccccuuuuggcgaguccuauauugucaucggggccggagaaaaagcucucaagcugagcugguucaagaaaggcucuagcauugggaagauguuugaggccaccgcuagaggcgcccgccggauggcgauccugggagauacagccugggacuucggcuccaucgggggaguguuuaccucugcuggcaaacucgugcaucagauuuucgggacggccuacggaguucuguuuagcggcgucuccuggaccaugaagaucgggauuggcgugcuucugacauggcucggacugaauagcagaucuaccucccugagcaugacauguaucgcugugggccuugucacccucuaccugggggugaugguucaggccgauucuggaugcgugauuaacuggaaaggccgcgaacugaaguguggguccggaaucuucgucacaaaugaggugcacaccuggacggaacaauauaaguuucaggcggacagcccgaaacggcucuccgccgcuauuggcaaggccugggaggaggggguuugcggcaucagaucugcuacacgccuggaaaacaucauguggaaacagauuagcaacgagcuuaaucauauccugcucgaaaacgacaugaaguucaccguggucgugggagauguugccggcauucuggcccaggggaaaaagaugauccggccccaaccuauggaguacaaauauuccuggaagucuuggggaaaggcuaaaauuaucggcgcggacgugcagaauaccacauuuaucauugaugggcccaacaccccugaaugucccgacgaucagagagccuggaauaucugggaggucgaggacuacggauucggcauuuuuacgacaaacaucuggcugaagcuucgcgauagcuauacccaggugugcgaccaccggcucauguccgcugccauuaaagauagcaaggccgugcacgcugacaugggcuacuggaucgaaucugagaaaaaugaaacauggaagcuggccagagcguucuucaucgaggucaagaccuguauuuggccgaaaucccauacacuguggagcaacgggguucucgaaucugagaugaucauuccuaagaucuauggaggccccauuucccaacacaauuaccgcccuggguacuuuacccagacggcuggacccuggcaucugggcaaacuugagcuggauuucgaccucugcgaagggaccacagugguggucgaugagcacugcggaaaccggggcccuagccugagaaccacaaccgugacgggcaagaucauccacgaaugguguugccggucuuguacacugcccccgcuucgcuuuagaggggaggacggaugcugguauggcauggagauucggccuguuaaagaaaaggaggaaaaucucgugaagagcauggucuccgccgggagcggagagguggacucuuucucccugggccugcucuguaucagcauuaugaucgaagagguuaugagaucccgcuggucucggaaaaugcugaugaccgggacacuugccguguuuuuccugcucauuaugggacagcugaccuggaacgaucugaucagacuuugcauuauggucggcgcuaaugccagcgaccgcaugggcauggggaccacauaccuggcgcucauggcuacguuuaagaugagacccauguucgccgugggacugcucuuucggcgccugaccuccagagagguucuucugcucacaaucggccugucucugguggccagcgucgaacuucccaacucccuggaggaacucggggauggacuggcuaugggcaucaugauucucaaacugcuuaccgacuuccaaucucaucagcugugggccacacuccugagccugaccuuuaucaagacgacauucucccuucacuaugcuuggaaaaccauggccauggugcugagcauugugucucucuuuccucugugucucuccaccacaagccagaagaccacauggcugccgguccuucuggggucucugggaugcaagccccucacgauguuccugaucgcggagaauaaaauuuggggccggcgcuccuggccucuuaacgaaggcaucauggccguugggaucgugagcauucugcucucuucccugcucaagaacgaugugccccuggcuggaccucuuaucgccggcgggaugcugauugcuuguuacgucaucagcggauccagcgccgaccugucucucgagaaagccgcugaggugagcugggaagaggaagcggagcauuccggcgccucucacaauauucugguugaagugcaggaugacgggaccaugaagaucaaagaugaggagagagacgauacacuuaccauccugcucaaggcuacacugcucgccgucagcggaguguauccccuguccauuccugccacccuuuucguuugguacuuuuggcaaaaaaagaagcagcggucuggcgugcugugggacacgcccagcccgccugaagucgagcgcgcugugcuggaugacggcaucuauagaauuaugcagcgggggcuccugggacgcucccaggucggcguggggguuuuccaagaaaacguguuucauaccauguggcacgucacaagaggagccgugcuuauguaccagggcaaacggcuggagcccucuugggcgagcguuaagaaagaccucaucuccuacgggggaggcuggagacugcagggcagcuggaauaccggggaggaagugcaggucauugcuguggagccuggaaagaaccccaaaaaugugcaaacagccccgggcaccuucaagacaccugaaggggagguuggagccaucgcucucgauuuuaagcccggcacgucuggguccccuauugucaaccgcgaaggaaaaaucgugggccuguauggcaaugggguggucaccacaagcggaaccuacgugucugccaucgcgcaggcuaaggccucccaggagggcccccuucccgagauugaagacgagguuuuccggaaaagaaaccugaccaucauggaucugcacccugggagcggaaagacacgccgguaucucccggccauugugagagaagcuaucaaacgcaagcugcggacgcuuauucuggcccccaccagagucguggcuuccgagauggccgaagcgcucaagggcaugccuauccgcuaccaaacaaccgccguuaaaucugagcauacagggaaggagaucguggaccugaugugccacgcuaccuuuacgaugcggcugcucagccccgucagagugccuaauuauaacaugauuaucauggaugaagcccauuucacagaccccuccagcauugcugcccggggcuacaucucuacccgcguuggaaugggcgaggccgcugcgauuuuuaugaccgccacaccuccgggguccguggaagcuuucccccagagcaaugccgucauccaggaugaggaaagagacaucccugagcggucuuggaacagcggauaugaguggauuaccgauuuucccggcaaaacagugugguucgugccuuccaucaagucugggaaugacauugccaacugucuucgcaaaaauggaaagagagucauccagcugagccggaagaccuucgauacggaauaccaaaaaacaaagaacaacgacugggacuacguugugaccacagauauuuccgagaugggcgcuaauuuuagagccgaccgcgugaucgauccccggagaugccugaaaccggucauucucaaggacgggccugaacgcgugauccuggcgggccccaugcccguuaccguggcuucugccgcccagcggagaggacgcaucggccggaaccacaauaaagagggggaucaguauauuuacaugggacagccucuuaacaaugacgaggaucaugcucacuggacggaagccaagaugcugcucgacaacaucaauacccccgagggcauuaucccugcgcuguucgaaccggagagagaaaagagcgccgcuauugauggggaguaucgccugagaggagaggcccggaaaacauuugucgaacucaugcgcagaggcgaccuucccguguggcuguccuacaagguugcuagcgagggguuccaauauucugaucggcgcuggugcuuugacggcgaaagaaacaaucaggugcuggaggaaaacauggaugucgagaucuggaccaaagagggagaacggaagaaacucagaccucgcuggcuggacgcccggacauacuccgacccccuugcucugagagaguucaaggaauuugccgcgggccgccggagcguguccggggaucucauccuggagauuggaaaacugccucagcaccucacccagagagcccaaaaugcucuugacaaccuggucaugcugcauaauucugaacagggcgggcgggccuaucgccacgcuauggaggagcuccccgauacaaucgaaacccugaugcuucuggcccucauugccgugcugacgggaggcguuacacuguucuuucucagcggcagagggcuuggaaagaccuccaucggccugcugugugugauggcuucuagcgugcuccuguggauggcguccgucgagccgcauuggauugccgcuagcaucauccuugaauucuuucugaugguucuccugauuccugagcccgaccggcagcgcaccccucaggauaaccaacuggccuacguggugaucgggcuccuuuucaugauucugacagucgccgcuaaugagaugggacugcucgaaaccacaaagaaagaccugggcaucgggcacguggccguugagaaccaccaucacgcggccaugcuugauguggaccugcaucccgcuucugccuggacgcucuacgcugucgccaccacaauuaucaccccuaugaugagacacacaauugaaaacaccacggcgaauaucucccugaccgccaucgcuaaccaggccgcuauucugaugggacucgauaagggcuggcccaucagcaaaauggacauuggcgugccgcuucuggcccuggggugcuauucucaggucaauccucucacacugaccgcugccgugcuuaugcugguugcgcauuacgccaucauuggacccggccuccaagcuaaggccacacgggaggcucagaaacgcaccgccgccgggaucaugaagaaccccacgguggauggaaucgucgcgauugaccuggauccugugguuuaugacgcuaaguuugaaaaacagcugggccagaucaugcuccuuauucuguguacaucccaaauccugcucaugagaaccacaugggcccugugcgagagcauuacccuugcuaccgggccgcugacaacgcucugggagggaucucccggcaaguucuggaauaccacaaucgccgugagcauggccaacaucuuccggggcuccuaccuggcuggggccggacuggcguuuucucucaugaaaagccuuggcgggggacgcagaggcaccggggcccagggagaaacacugggcgagaaguggaaacggcagcugaaucagcucuccaagagcgaauucaacaccuauaagagauccggcauuauggaggucgaccgcucugaagcuaaagaggggcugaagcggggagagacgacaaaacacgccgugagcagaggcaccgcuaagcuucgcugguuuguggaacggaaucugguuaaaccugaggggaaggucaucgaucucggauguggcagagggggaugguccuacuauugcgccggccugaagaaagugaccgaagugaagggcuacacaaaagggggacccggccacgaggaaccuauucccauggcgaccuacggguggaaccuggucaagcuccauucuggaaaagacguuuucuuuaucccuccggagaagugugauacacuucugugcgacauuggcgagagcucccccaauccuacgaucgaagaggggcgcacccugcgggugcucaaaaugguggaacccuggcugagaggaaaccaauucuguauuaagauccuuaauccuuauaugcccucugucguggagacacuggagcagaugcagcgcaagcacggcggcaugcucguucggaacccgcugagcagaaauuccacccaugaaauguacugggugagcugcgggacaggaaacaucgucucugccgugaauaugaccucccgcaugcugcucaaccgguuuacgauggcucacagaaaaccuaccuaugagcgcgauguugaccugggcgccgggacaagacacguggcugucgaacccgagguggccaaccuugauauuaucggacagcggauugaaaauaucaagcaugagcacaaaagcaccuggcauuacgacgaggauaaccccuauaagacaugggcuuaccacggcucuuaugaagugaaaccuuccgggagcgccucuuccauggucaauggaguugugaagcugcucaccaagcccugggacgugauuccuauggucacacaaaucgcgaugaccgauacgacaccguucggccagcagcgcguguuuaaagagaagguugacaccagaacccccaaagccaagcggggcacagcucaaaucauggaagugacggccaaauggcuguggggguuccuuagcagaaacaagaagccucggauuuguacccgcgaggaauuuacaagaaaaguccgguccaaugcugccaucggagccguguucguugacgagaaccaguggaauagcgcgaaggaggcuguggaagaugagcgcuuuugggaccugguccauagagaacgggagcuccacaaacagggcaagugcgccaccugcguguacaacaugauggggaaacgcgaaaagaagcugggagaguucggcaaagccaaggggucuagagcuauuugguacauguggcugggcgcccgguuccucgaguuugaagcucugggauucaugaaugaggaucacugguuuagccgcgaaaacucccuuucuggcguugagggggagggacugcauaaacucggcuauauccugagagacauuagcaagauccccgggggaaauauguacgccgaugacacagcgggcugggauacccggaucacagaagacgaucuucagaacgaggcccgcauuaccgacaucauggaaccugagcacgcucugcucgccaaauccauuuucaagcugacguaucaaaauaaaguggucagagugcagcggcccgcuaagaacgggaccgucauggaugugaucucucgcagagaccagcggggcagcggacagguuggcacauacgggcugaauaccuuuacaaacauggaagcccaacucauuagacagauggaguccgagggaaucuucucuccgagcgaacuggagaccccuaaccuugcggaacgcgugcuggauuggcucgagaaguauggcgucgaacggcugaaaagaauggccaucuccggggacgacuguguggugaagcccauugaugaccgcuuugcuacggcccuuacagcucugaaugauaugggaaaaguucggaaggacaucccucagugggagcccagcaaaggcuggaacgauuggcagcaagugccuuucugcucucaucacuuucaccagcucauuaugaaggacgggagagagaucgucgugcccugucgcaaucaggaugaacugguuggccgggccagagugucccagggagcuggcuggagccugcgcgagaccgccugccucgggaagucuuacgcgcaaauguggcagcugauguauuuccaucggagagaccuucgccuggccgcuaacgccauuuguuccgccgucccgguggauuggaucccuacaagccggaccacgugguccauucacgcucaucaccaguggaugaccacagaagacaugcucucugucuggaauagaguguggaucgaggaaaaccccuggauggaggauaaaacccauaucagcuccuggggagacguucccuaccugggcaagcgggaggaccaauggugcgggagccuuauuggacugacagccagagcgaccugggcuacaaauauccagguggccauuaaccagguccgccggcucaucggcaaugaaaacuaccuggauuauaugaccucuaugaaaagauuuaagaaugaguccgacccugaaggggcccugugguga

SEQ ID NO: 19144 - RNA, 9879 nt, Artificial Sequence
  derived and/or modified CDS sequence (opt5) from DENV-1__GU131684__SS-prME
agcgugaccaugcugcugaugcugaugcccacagcccuugcuuuccaccugacgacccggggcggggagccucauaugaucgucuccaagcaggaacggggaaaaucucuccuguuuaagacaagcgccggcguuaauaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaagcugacgguuguggucggagauguggcuggcauucucgcccaggggaaaaagaugauccggccgcaacccauggaguacaaauauagcuggaaguccuggggaaaggccaaaauuaucggcgcugacgugcagaauacaaccuuuaucauugaugggccuaacacccccgaauguccugacgaucagagagcguggaauaucugggaggucgaggacuacggauucggcauuuuuacaaccaacaucuggcugaagcugcgcgauagcuauacgcagguuugcgaccaccggcuuaugucugccgcuauuaaagauuccaaggccgugcacgccgacaugggcuacuggaucgaaagcgagaaaaaugaaacauggaagcucgcuagagccucuuucaucgaggugaagaccuguauuuggcccaaaucccauacacuguggagcaacgggguccuggaaucugagaugaucauuccgaagaucuauggaggcccuauuagccaacacaauuaccgccccggguacuucacccagacagcgggaccuuggcaucucggcaaacuggagcuugauuuugaccugugcgaagggaccacggugguuguggaugagcacugcggaaaccggggccccucccucagaaccacaaccgucacaggcaagaucauccacgaaugguguugccggagcuguacccugccuccccugcgcuucaaaggggaggacggaugcugguauggcauggagauuagaccggugaaggaaaaggaggaaaaucuuguuaaaucuaagguguccgcugggagcggagaggucgacuccuuuucucucggccugcuguguaucagcauuaugaucgaagaggugaugcgguccagauggucucgcaaaaugcucaugacggggacacuggccguuuucuuucuucugauuaugggacagcucaccuggaacgaucugauccggcugugcauuauggugggcgccaaugcuagcgacagaaugggcauggggacaaccuaccuugcccugauggcgaccuucaagaugcgcccuauguuugcugucggacuccuguucagacggcucacaucccgcgaggugcugcuucugacgaucggccucucucugguggccagcgucgaacugcccaacucccuugaggaacugggggauggacucgccaugggcaucaugauucugaaacuccugaccgacuuucaaagccaucagcuuugggcuacacugcucucucugaccuucaucagaacaaccuuuucccugcacuaugccuggaagacgauggcuaugguucuuagcauugugucucuguucccccucugucuguccacaaccagccagaagaccacauggcucccugugcugcuugggucucugggaugcaaaccgcugaccauguuucucaucgccgagaauaagauuuggggccggaaauccuggccccugaacgaaggcaucauggcggucgggaucgugagcauucuucuguccagccuccugaagaacgauguuccucucgccggaccccugaucgcuggcgggaugcuuauugccuguuacgugaucucuggaagcuccgcugaccugucucuggagaaagccgccgucgugagcugggaggaagaggcugaacauuccggcgcgucucacaauauucucguugaggugcaggaugacgggacaaugaagaucaaagaugaggaacgcgacgauacgcugaccauccuucugaaggccacacuccuggcugucagcggaguguauccucucuccauucccgccacccuguucgucugguacuucuggcaaaagaaaaagcagagaucuggcgugcuuugggacacaccuuccccucccgagguugaacgggccgugcuggaugacggcaucuaucgcauuaugcagagagggcugcucggacggucccaggucggcguggggguuuuucaagagaacguguuccauaccauguggcacgucacgcgcggagcugugcugauguaccagggcaaaagacuugaacccagcugggccucugugaagaaagaccugaucuccuacgggggaggcuggcggcuccagggcagcuggaauaccggggaggagguucaggucauugcgguggaacccggaaagaacccuaagaaugugcaaacagcucccggcaccuuuaaaacaucugagggggaagucggagccaucgcccuggauuucaagccgggcaccuccgggagcccuauugugaacagagagggaaaaaucguuggccucuauggcaaugggguggucacaacguccggaaccuacgugucugcuaucgcccaggcgaaggcuagccaggaaggcccccugccugagauugaggacgaaguuuuucgcaaacggaaccuuacaaucauggaucugcaccccggguccggaaagaccagacgcuaucugcccgccauugugcgggaggccaucaagagaaaacuccgcacccugauucuugcuccuacacgggucguggccagcgaaauggcugaggcccugaagggcaugccgaucagauaccaaacgaccgcgguuaaaucugaacauacagggaaggagaucguggaccucaugugccacgccaccuucacaaugcgccugcugucccccguccgggugccuaauuauaacaugauuaucauggaugaggcucauuuuaccgaccccagcucuauugccgcuagaggcuacaucagcacgcgggugggaaugggcgaagccgccgcuauuuucaugacagcgaccccucccggguccgucgaggccuuuccucagucuaaugcuguuauccaggaugaggaacgcgacaucccggaaagaagcuggaacuccggauaugaguggauuaccgauuuccccggcaaaacagugugguuugugccuucuaucaagagcgggaaugacauugccaacugucuccggaagaauggaaaacgcgucauccagcuuuccagaaagaccuucgauacagaguaccagaagaccaagaacaacgacugggacuacgugguuacgacagauauuagcgaaaugggcgccaauuuccgggcugacagagugaucgauccccgccggugccugaaaccugucauucugaaggacgggcccgagagagugauccucgccggcccgaugccuguuaccguggcgucugcugcccagcgccggggaagaaucggccgcaaccacaauaaggaaggggaucaguauauuuacaugggacagccccugaacaaugacgaggaucaugcccacuggacagaggcuaaaaugcuucuggacaacaucaauacccccgaaggcauuaucccugcccucuuugagcccgaacgggagaaguccgcggccauugauggggaauauagacugcgcggagaggcuagaaaaacguucgucgagcugaugcggcgcggcgaccucccuguguggcuuagcuacaaggucgccuccgaaggguuucaauauucugauagacgguggugcuucgacggcgagcgcaacaaucaggugcuggaagagaacauggauguugaaaucuggaccaaagagggagagagaaagaaacugcggccgagauggcucgacgcucgcacauacagcgacccccuggcccuucgggaauuuaaggaguucgcugccggcagacgcuccgugucuggggaucugauccucgaaauuggaaagcugccucagcaccugacccagcgggcgcaaaaugcccucgacaaccuugugaugcugcauaauagcgagcagggcgggagagcuuaucggcacgccauggaggaacugcccgauacaaucgagacccucaugcugcuugcucugauugccguccucacaggaggcguuacccuguuuuuccuguccggccgcgggcucggaaaaacgagcaucggccuucugugugugauggccucuuccgugcugcucuggauggcuagcgucgaaccucauuggauugcggccucuaucauccuggaguuuuuccuuauggugcugcucauucccgaaccggacagacagcggacaccucaggauaaccaacuggcuuacguugugaucgggcugcucuuuaugauucuuaccgucgccgccaaugagaugggacugcuggagaccacaaagaaagaccucggcaucgggcacguggcugucgaaaaccaccaucacgccgcgaugcuggauguggaccuucaucccgccuccgcuuggacccuguacgccguugcuacaacgauuaucaccccuaugaugcgccacacaauugagaacaccacagccaauaucagccucaccgcgaucgccaaccaggcugccauucugaugggacuggauaagggcuggcccaucucuaaaauggacauuggcgugccucuccuugcucuggggugcuauagccaggucaauccccugacgcucaccgccgcugugcugaugcuuguugcccauuacgcgaucauuggaccgggccugcaagccaaggcuacaagagaagcccagaagcggaccgcugccgggaucaugaaaaacccuacaguggauggaaucgucgccauugaccucgaucccgugguguaugacgcgaaguucgagaaacagcugggccagaucaugcugcucauucuuuguaccucccaaauccugcugaugcgcacgacaugggcucucugcgaaucuauuacccuggccacagggccccuuaccacccugugggagggaagcccuggcaaguuuuggaauacaacgaucgcuguuuccauggccaacaucuucagaggcagcuaccucgccggggcuggacuggccuucucccugaugaaaucucucggcgggggacggcgcggcaccggggcgcagggagagacacuuggcgaaaaguggaagagacagcugaaucagcugagcaaauccgaguuuaacaccuauaagcggucuggcauuauggaagucgacagaagcgaggccaaagaagggcucaagcgcggagagacaaccaaacacgcugugucccggggcacggccaagcugagaugguucguggagcgcaaucuugucaagccggaagggaaaguuaucgaucugggauguggcagagggggauggucuuacuauugcgcuggccucaagaaagugacagaggugaagggcuacaccaaagggggacccggccacgaggagccuauucccauggccaccuacggguggaaccuggucaagcugcauagcggaaaagacguguuuuucaucccucccgaaaagugugauacacuccuuugcgacauuggcgaguccagcccuaauccgaccaucgaggaagggagaacacugcgcguucugaagaugguggagcccuggcuccggggaaaccaauuuuguauuaaaauccugaauccuuauaugcccucugucguggaaacgcuugagcagaugcagagaaagcacggcggcaugcugguucgcaacccucucucccggaauagcacccaugagauguacugggugucuugcgggacaggaaacaucgucuccgcggugaauaugaccagcagaaugcugcugaaccgcuucacaauggcccaccggaaacccaccuaugaaagagauguggaccucggcgcugggacgcgccacgucgccguugagccggaaguggcuaaccuggauauuaucggacagagaauugagaauaucaagcaugaacacaaaucuaccuggcauuacgacgaggauaacccuuauaagacaugggccuaccacggcuccuaugaggugaagcccagcggguccgcuagcucuauggucaauggagugguuaaacuucugaccaagcccugggacgugauuccuauggucacacaaaucgccaugaccgauacaacccccuuuggccagcagcggguguucaaagaaaagguugacacgcgcacaccuaaagcgaagagaggcaccgcccaaaucauggaggugaccgcuaaguggcucuggggguuucugagccggaacaaaaagccgagaauuuguacacgggaagaguucacgcgcaaagucagauccaaugccgcuaucggagccguguuuguugacgaaaaccaguggaacucugccaaggaggcgguggaggaugaacgguucugggaccuuguccaucgcgagagagaacugcacaaacagggcaagugcgcuaccugcguguacaacaugauggggaagcgggagaaaaagcucggagaauuuggcaaagccaaggggagccgcgccauuugguacauguggcugggcgcuagauuccuggaguucgaggcccucggauuuaugaaugaagaucacugguucucccgggagaacucucugagcggcgucgaaggggagggacuucauaaacugggcuauauccuccgcgacauuuccaagauccccgggggaaauauguacgcugaugacacagccggcugggauaccagaaucacagaggacgaucugcagaacgaagcgaaaauuaccgacaucauggagccugaacacgcccuucuggcuaagucuauuuuuaagcucacauaucaaaauaaagugguucgggugcagcgccccgccaagaacgggaccgucauggaugugaucagcagacgggaccagcgcggcuccggacaggugggcacguacgggcugaauaccuucacaaacauggaggcucaacugauuagacagauggaaagcgagggaaucuuuucuccuuccgagcucgaaacccccaaccuggccggccggguucuugauuggcuggagaaacaugggguggaaagacucaagcgcauggcgaucagcggagacgacugugucgugaaaccgauugaugaccgguucgccacagcucugaccgcccuuaaugauaugggcaagguuagaaaggacaucccucagugggagcccucuaaaggguggaacgauuggcagcaagugccuuuuugcucccaccacuuccaucagcugauuaugaaggacggccgcgaaaucgucgugcccugucggaaucaggaugagcucgucggcagagcucgcgugagccagggagccggguggucccugcgggagacggcuugccugggaaaaucuuaugcccaaauguggcagcucauguacuuucacagacgcgaccugcggcuugcggccaacgcuauuuguagcgccguuccuguggauuggguccccacauccagaaccacauggagcauccaugcccaccaucaguggaugaccacggaagacaugcugucuguguggaaucgcguuuggauugaggaaaacccguggauggaggauaagacccacaucuccagcuggggcgacgugccuuaucucgggaaacgggaagaccaauggugcggaucucugaucggccuuacagcuagagccaccugggcgacaaauauucaggucgcuaucaaccaggugcggagacugcucgggaaugagaacuaccuggauuacaugaccagcaugaagcgcuucaagaaugaguccgaccccgaaggcgcccugugguga

SEQ ID NO: 19145 - RNA, 9879 nt, Artificial Sequence
  derived and/or modified CDS sequence (opt5) from DENV-1__GU131685__SS-prME
agcgugaccaugcugcucaugcugaugcccacagcccuugcuuuccaccugacgaccagaggaggggagccucauaugaucguguccaagcaggaacggggaaaaucucuccuguuuaagacaagcgccggaguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaggaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggagaaacuuacacugaaggggaugagcuaugugauguguaccggcucuuucaaacucgaaaaggaggucgcugagacccagcacggaacagugcugguucagauuaaguacgaaggcaccgaugccccgugcaaaaucccuuucuccacacaagacgagaagggggugacgcagaacggacggcugaucaccgcgaaucccauugucacagauaaagaaaagccugugaacaucgaggcugagccgcccuuuggcgaaagcuauauugugaucggggccggagagaaagcccuuaagcucucuugguucaagaaaggcagcuccauugggaagauguuugaagcuaccgccagaggcgcucgccggauggccauccugggagacacagcgugggauuucggcucuaucgggggaguuuuuaccagcgucggcaaacugauucaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgacuccggaugcgugaucaacuggaaaggccgcgagcugaagugugggagcggaauuuucguuacaaaugaagugcacaccuggacggagcaauauaaguuucaggcugauuccccuaaacggcugucugccgcgaucggcaaggccugggaggaaggggucugcggcaucagaagcgcuacacgccucgagaacauuauguggaaacagaucuccaacgaacugaaucauauucuucuggagaacggaaugaaguucaccgugguugugggcgacgucgccgggauccucgcucagggcaagaagaugauucggccgcaacccauggaauacaaauauucuuggaaaagcuggggcaaggccaagaucaucggggccgacgugcagaauaccacauuuauuaucgauggaccuaacacccccgaguguccugacgaucagagagcuuggaauauuugggagguggaagacuacggcuucggcaucuuuacgacaaacauuuggcugaagcugcgcgauuccuauacccaggucugcgaccaccggcuuaugagcgcggccaucaaagauucuaaggcuguucacgccgacaugggguacuggaucgaguccgagaaaaaugagacauggaagcucgccagagcuagcuucauugaagugaagaccuguaucuggcccaaaucucauacacugugguccaacggagugcuggagagcgagaugauuaucccgaagauuuauggcgggccuaucucucaacacaauuaccgccccggauacuucacccagacggccggcccuuggcaucucgggaaacuggaacuugauuuugaccugugcgagggaaccacagucgugguugaugaacacugcggcaaccggggccccagccucagaaccacaaccgugacggggaagaucauucacgagugguguugccgguccuguacacugccuccccugcgcuucagaggagaggacggcugcugguaugggauggaaauccggccggucaaagagaaggaagagaaucuugucaagagcaugguuucugcgggauccggcgaaguggauagcuuuucccucgggcugcuguguauuucuaucaugauugaggaggucaugagaagccgcuggucccggaaaaugcucaugaccggaacacuggcuguguucuuucuucugaucaugggccagcucaccuggaacgaccugauuagacugugcaucaugguuggcgccaaugccucugaccgcauggggaugggaaccacauaccuugcucugauggccacguucaagaugagaccuauguuugcggugggccuccuguuccggcgccucaccagcagagaaguccugcuucugacaaucgggcucucccugguggcuucuguggagcugcccaacagccuugaagaacugggagauggccucgccauggggauuaugauccugaaacuccugaccgacuuucaaucccaucagcuuugggccacacugcucagccugaccuucauuaagacgacauuuucucugcacuaugcuuggaaaaccauggccaugguccuuuccaucguuagccuguucccccucugucugucuaccacaucccagaagaccacauggcucccugugcugcuuggaagccugggcugcaagccgcugacgauguuucucauugcugaaaauaaaaucuggggccggcgcucuuggccccugaacgaggggaucauggccgugggaauugucuccauccuucugagcucccuccugaagaacgaugugccucucgcgggcccccugauugccgggggaaugcuuaucgcuuguuacguuauuagcggcucuagcgccgaccugucccuggagaaagcugccgaagugucuugggaggaagaggccgaacauagcggggcuucccacaauauccucgucgaggugcaggaugacggaaccaugaagaucaaagaugaggaaagagacgauacacugaccauucuucugaaggcgacacuccuggccguuucuggcguguauccucucagcauccccgcuacccuguucgucugguacuucuggcagaaaaagaagcagcgguccggcgugcuuugggacacgccuucucccccggaggucgaacgcgccgugcuggaugacgggauuuauagaaucaugcagcggggacugcucggccgcagccagguuggggugggagucuuucaagagaacguguuccauaccauguggcacguuacaagaggcgccgugcugauguaccaggggaaacggcuugagccuuccugggcuagcgucaagaaagaucugauuucuuacggaggcggcuggagacuccagggguccuggaauaccggagaagagguccaggugaucgccguugaacccggcaagaacccuaaaaauguccaaacagcgcccgggaccuuuaagacaccggagggagaagugggcgcuauugcccuggacuucaagccugggacgagcggaucucccaucgugaaccgcgagggcaaaaucgucggccucuaugggaauggagugguuaccacauccggcaccuacgugagcgccauugcucaggccaaggcgucccaggaggggccucugcccgaaaucgaggacgaagucuuucggaaaagaaaccuuaccauuauggaucugcaccccggaucuggcaagacacgccgguaucugccugcuaucgugagagaggccauuaaacgcaagcuccggacgcugauccuugccccgaccagaguuguggcuagcgaaauggccgaggcucugaaggggaugcccauccgcuaccaaacaaccgccgucaaauccgagcauacaggcaaggaaauuguggaccucaugugccacgcgaccuucacgaugcggcugcugagcccuguuagagugcccaauuauaacaugaucauuauggaugaggcccauuuuacagacccuucuuccaucgcugcccggggauacauuagcacccgcgucggcaugggggaagcugccgccaucuucaugaccgcuacacccccuggaucuguggaggcguuuccgcagagcaaugccgugauccaggaugaagagagagacauucccgagcgguccuggaacucuggcuaugaauggaucaccgauuucccugggaaaacagucugguuuguucccagcauuaaguccggaaaugacaucgcuaacugucuccgcaaaaauggcaagagagugauucagcuuucucggaagaccuucgauacggaguaccagaaaaccaagaacaacgacugggauuacguggucaccacagacaucagcgaaaugggggccaauuucagagccgaccgcgugauugauccucggagaugccugaaacccguuauccugaaggacggcccggagcgcgugauccucgcuggaccuaugcccgucaccguggccuccgcggcucagcggagaggccgcauugggcggaaccacaauaaagagggagaucaguauaucuacaugggccagccccugaacaaugacgaagaucaugcccacuggacggaggccaagaugcuucuggacaacauuaauaccccugaagggaucauucccgcucucuuugagccugaaagagaaaagagcgccgcgaucgauggagaguaucgccugagaggcgaagcccggaaaacauucguugagcugaugcgcagaggggaccucccgguguggcuuucuuacaaggucgcuuccgaaggcuuucaauauagcgaucggcgcuggugcuucgacggagagagaaacaaucaggugcuggaagagaacauggaugucgagaucuggaccaaagaaggcgagcggaagaaacugagaccccgcuggcucgacgcccggacauacuccgauccucuggcucuuagagaauuuaaggaguucgccgcugggcgccggucugugagcggagaccugauucucgaaaucggcaaacugccccagcaccugacccagagagcccaaaaugcgcucgacaaccuuguuaugcugcauaauuccgagcaagggggacgggccuaucgccacgcuauggaggaacugccugauacaauugagacccucaugcugcuugcccugaucgcugugcucacgggcggcgugacacuguuuuuccugucugggagaggacucggcaagaccagcauugggcuucugugugucauggccuccagcguucugcucuggauggccucuguggaaccccauuggaucgcugcguccaucauucuggaguuuuuccuuauggugcugcucaucccggagccugaccggcagcgcacaccccaggauaaccaacuggccuacgucgugauuggacugcucuuuaugauccuuacaguugcugccaaugaaaugggccugcuggagaccacaaagaaagaccucgggauuggacacguggccgucgaaaaccaccaucacgcugccaugcuggauguggaccuucauccugcgagcgccuggacgcuguacgcugucgccaccacaaucauuacccccaugaugagacacacaaucgagaacaccacggcuaauaucucucucaccgccauugcgaaccaggccgcuauccugaugggccuggauaagggcuggccuauuuccaaaauggacaucggggugccccuccuugcccugggaugcuauagccagguuaauccgcugacacucaccgcugccgugcugaugcuugucgcucauuacgccauuaucggcccugggcugcaagcgaaggccacacgggaagcucagaaacgcaccgccgcuggaaucaugaagaaccccacgguggauggcauuguugccaucgaccucgaucccguggucuaugacgccaaguucgagaaacagcuggggcagauuaugcugcucauccuuuguacaucucaaauucugcugaugagaaccacaugggcgcucugcgagagcaucacccuggcuaccggaccucuuacaacgcugugggaaggcuccccgggcaaguuuuggaauaccacaaucgccgugucuauggcuaacauuuuccgggggagcuaccucgccggagccggccuggcuuucucccugaugaaaagccucgggggaggccgcagagggaccggagcccagggcgagacacuuggcgaaaaguggaaacggcagcugaaucagcuguccaagucugaguuuaacaccuauaagagaagcgggaucauggaaguggaucgcuccgaggcgaaagagggacucaagcggggcgaaacgacaaaacacgccguuucuagagggaccgcuaagcugcgcugguucgucgagcggaaucuugugaaacccgaaggaaaggugauugaccugggcugugggagaggaggcuggagcuacuauugcgccggccucaagaaagucaccgagguuaagggguacacaaaaggaggcccugggcacgaggaacccaucccuauggcuaccuacggauggaaccuggugaagcugcauuccggcaaagacguguuuuucauucccccugagaagugugauacacuccuuugcgacaucggggaaucuagcccgaaucccacgauugaggaaggacgcacccugcggguccugaaaaugguggagccuuggcucagaggcaaccaauuuuguaucaagauccugaaucccuauaugccuuccguuguggagacacuugaacagaugcagcgcaagcacggcgggaugcugguccggaacccccucagcagaaauucuacccaugagauguacuggguguccugcggaacaggcaacauuguuagcgccgugaauaugaccucucgcaugcugcugaaccgguucacgauggcgcacagaaaaccgaccuaugaacgcgaugucgaccucggggccggaacaagacacguggcuguggagccugaagucgccaaccuggauaucauuggccagcggaucgagaauauuaagcaugagcacaaauccaccuggcauuacgacgaagauaaccccuauaagacaugggcuuaccacgggagcuaugagguuaaacccucuggauccgccagcuccauggugaauggcguggucaaacuucugaccaagccuugggacgugauccccaugguuacacaaaucgcuaugaccgauacgacaccuuuuggccagcagcgcguguucaaagaaaaggucgacaccagaaccccgaaagccaagcgggggacagcgcaaauuauggaggugacggccaaauggcucuggggauuucugagcagaaacaagaagccccggaucuguacccgcgaagaguucacaagaaaaguucggucuaaugcugccauuggcgcuguguuugucgaugagaaccaguggaauagcgccaaggaagccguggaggacgaacgcuucugggaccuuguucauagagagcgggaacugcacaaacaggggaagugcgcgaccugcguguacaacaugaugggaaaacgcgagaagaagcucggcgaguuugggaaagcuaagggcuccagagccaucugguacauguggcugggagcccgguuccuggaguucgaggcucucggcuuuaugaaugaagaucacugguucucucgcgagaacagccuguccggggucgagggagaaggccuucauaaacugggguauauucucagagacaucucuaagaucccuggaggcaauauguacgccgaugacacagcugggugggauacccggauuacagaggacgaucugcagaacgaagcccgcaucaccgacauuauggagcccgaacacgcgcuucuggccagaagcaucuuuaaacucacguaucaaaauaaggugguccgggugcagcgcccugcuaaaaacggcaccguuauggaugugauuuccagacgggaccagagaggaucuggccaggucgggacauacggacugaauaccuucacaaacauggaggcccaacugauccgccagauggagagcgaaggcaucuuuucccccagcgagcucgaaaccccgaaccuggcugagcgggugcuugauuggcuggaaaaguaugggguggagagacucaagcgcauggccauuucuggagacgauuguguugugaaaccuaucgacgaccgguucgcgacggcccugacagcucuuaaugauaugggcaaggucagaaaagacauuccccagugggagccuuccaagggguggaacgauuggcagcaagugcccuuuugcagccaucacuuccaccagcugaucaugaaagacggccgcgaaauuguugugccuugucggaaucaggaugagcucgucggcagagcccgcgugucucagggcgcuggguggucccugcgggaaaccgccugccugggaaagagcuacgcucaaauguggcagcucauguauuuucauagacgcgaccugcggcuugccgcgaacgccaucuguuccgcuguccccguggauuggauuccgacaucuagaaccacguggagcauccacgcccaucaccaguggaugaccacagaggacaugcuguccguuuggaaucggguguggaucgaagagaacccuuggauggaggauaagacccauauuagcucuuggggcgacguccccuaccucgggaaaagagaagaucaauggugcggaucccugaucggccuuacagcccgcgcuaccugggccacaaauauucagguggcgaucaaccagguucggagacugauugggaaugagaacuaccucgacuauaugaccagcaugaagcgcuucaaaaaugaaucugaccccgagggcgcucugugguga

SEQ ID NO: 19146 - RNA, 9879 nt, Artificial Sequence
  derived and/or modified CDS sequence (opt5) from DENV-1__GQ868614__SS-prME
agcgugaccaugcugcucaugcugaugcccacagcccuugcuuuccaccugacgaccagaggcggggagccucauaugaucgucacaaagcaggaacggggaaaaucccuccuguuuaagaccucugccggcguuaacaugugcacacuuauugcgauggaccugggggagcucugugaagauaccaugacauacaaaugcccgcgcaucaccgaggcugaacccgacgauguggacuguuggugcaaugccacggauaccugggugacauauggaaccuguagccaaacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagagcaggacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuaccccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcccguucaaacucgagaaggaaguggccgagacccagcacggaaccguccuggugcagauuaaguacgagggcacagacgcgccuugcaaaauccccuucucuacccaagaugaaaaggggguuauccagaacggacggcugauuacagcuaauccuaucgugacggacaaagagaagcccgucaacauugaagccgagcccccuuuuggcgaguccuauaucgugauuggggugggagaaaaagcccuuaagcucagcugguucaagaaaggcucuagcaucgggaagauguuugaggcuaccgccagaggcgcucgccggauggccauccugggagauacagcgugggacuucggcuccauugggggaguuuuuaccucugucggcaaacuggugcaucagaucuucggggccgcuuacggagugcucuuuagcggcgucuccuggacaaugaagauugggaucggcgugcugcuuaccuggcugggacucaauagcagaucuacgucccugagcaugaccuguauugccguuggccuggugacacuuuaccucggggucauggugcaggcugauucuggaugcguuaucaacuggaaaggccgcgaacugaaguguggguccggaauuuucgugaccaaugagguccacacauggaccgaacaauauaaguuucaggccgacagcccgaaacggcuguccgcggccaucggcaaggcuugggaggagggggugugcggcaucagaucuguuacacgccucgaaaacauuauguggaaacagaucagcaacgagcugaaucauauucuucuggaaaacgacaugaaguucaccguggucgugggagauguggucggcauccucgcccaggggaaaaagaugauucggccccaaccuauggagcacaaauacuccuggaagucuuggggaaaggcuaaaaucaucggcgccgacguucagaauacgacauuuauuaucgaugggcccaacaccccugaaugucccgacgaucagagagccuggaauauuugggagguggaggacuauggauucggcaucuuuaccacaaacauuuggcugaagcugcgcgauagcuacacccaggcuugcgaccaccggcuuauguccgcggccaucaaagauagcaaggcugugcaugccgacaugggcuauuggaucgaaucugagaaaaaugaaacguggaagcucgccagagcuuccuucauugaggucaagacauguaucuggccgaaaagccacacccuguggucuaacggggugcuggaauccgagaugguuauuccuaagaucuacggaggccccauuagccaacauaauuaucgcccuggguacuucacacagaccgccggacccuggcaccucggcaaacuggagcuugauuuugaccugugcgaagggacaaccguggucguggaugagcacugcggaaaccggggcccuucucucagaacgaccacaguuaccggcaagaucauccaugaaugguguugccggagcuguacacugcccccgcugcgcuucaaaggggaggacggaugcugguacggcauggagauuagaccugugaaggaaaaggaggaaaaucuugucaaauccauggugagcgcggggucuggagagguugacuccuuuagccucggccugcuguguaucuccauuaugaucgaagaggugaugcggucuagauggagccgcaagaugcucaugaccgggacgcuggcugucuuccuucugcucauuaugggacagcugacauggaacgaucugauccggcuuugcauuauggugggcgccaaugccuccgacagaaugggcauggggaccacauaucuggcucucauggccaccuuuaaaaugcgccccauguucgcggugggacugcucuuuagacggcugaccucucgcgagguccuucugcucacaaucggccugagccugguugcuuccguggaacuucccaacucucuggaggaacucggggauggacuggccaugggcaucaugauucucaagcugcuuacggacuuccaaagccaccagcugugggccacccuccugucccugacauuuaucaaaaccacacuuagccugcauuacgcuuggaagaccauggccauggugcucucuauugucucccuguucccucucugucugagcacgacaucucagaagaccaccuggcuuccggugcugcuggggucccucggaugcaaaccccugacaauguuucuuaucgcugagaauaagauuuggggcagaaaaagcuggccucugaacgaaggcaucauggccguugggguggucucuauccuccuguccagccuccugaagaacgaugugccccuugcgggaccucugauugccggcgggaugcugaucgcuuguuauguuauuuccggaagcucugccgaccucagccuggagaaagcugccgagguguccugggaagaggaagccgagcacucuggcgcuagccauaauauccuugucgaagugcaggaugacgggaccaugaagauuaaagaugaggagcgggacgauacacugacgauccuccugaaggcgacccuccuggccgucuccggaguguacccccuuucuaucccugcuacacuguucguuugguauuuuuggcaaaagaaaaagcagcgcagcggcgugcugugggacacccccuccccgccugaagucgagagagccgugcucgaugacggcauuuaccggaucaugcagcgcgggcugcuuggaagaucucagguuggcgugggggucuuccaagaaaacguguuccacacaauguggcacgugacccggggagccguucugauguaucagggcaaacgccucgagcccagcugggcuuccgucaagaaagaccugauuagcuacgggggaggcuggagacuccagggcucuuggaauacgggggaggaagugcaggugaucgccgucgagccuggaaagaaccccaagaaugugcaaaccgcgccgggcacauuuaaaaccccugaaggggagguuggagcuauugcccuggauuucaagcccggcacauccgggagcccuaucgugaaccgggaaggaaaaauugucggccuuuacggcaauggggugguuaccacaucuggaacguauguguccgccaucgcucaggccaaggcgagccaggagggcccccugcccgagaucgaagacgaggucuuuagaaaacgcaaccugaccauuauggaucuccauccuggguccggaaagacacggagauaccugccggcuaucgugcgcgaagccauuaagcggaaacuuagaacccugauccucgcccccacccgcguuguggcuucugagauggccgaagcucugaagggcaugccuauucgguaucaaacaacggccgucaaaagcgagcacaccgggaaggagaucguggaccugaugugccaugcgacauucaccaugagacuccuuucccccgugcgcgucccuaauuacaacaugaucauuauggaugaagcccacuuuacagaccccagcucuaucgcugcccggggcuauauuuccaccagaguuggaaugggcgaggcugccgccaucuucaugacggcuacaccuccggggagcguggaagcguuuccccagucuaaugccgugauucaggaugaggaacgggacaucccugagcgcagcuggaacuccggauacgaguggaucaccgauuuccccggcaaaaccgucugguuugugccuucuauuaagagcgggaaugacaucgcuaacugucugagaaagaauggaaaacggguuauucagcugucccgcaagacauucgauaccgaauaucaaaaaacaaagaacaacgacugggacuacguggucaccacggauaucucugagaugggcgccaauuuuagagccgaccgggugauugaucccagacgcugccucaaaccgguuauccugaaggacgggccugaacgggugauucuugcuggccccaugcccgucacaguggccagcgcggcucagagacgcggacggaucggcagaaaccauaauaaggagggggaucaguacaucuauaugggacagccucugaacaaugacgaggaucacgcccacuggaccgaagccaaaaugcuccuggacaacauuaauacacccgagggcaucauuccugcucuguucgaaccggagcgcgaaaaguccgccgcgaucgauggggaguaccggcucagaggagaggcccgcaaaaccuucgucgaacuuaugagacggggcgaccugcccguguggcugagcuauaagguugcuucugagggguuucaauacuccgaucgcagauggugcuucgacggcgaacggaacaaucaggugcucgaggaaaacauggauguggagauuuggacgaaagagggagaacgcaagaaacugagaccucgguggcuugacgccagaaccuauagcgacccccuggcucuccgcgaguuuaaggaauucgccgcuggccggagauccgucucuggggaucugauccuggagaucggaaagcucccucagcaucuuacacagcgcgcccaaaaugcgcuggacaaccugguuaugcuccacaauagcgaacagggcgggcgggccuacagacaugcuauggaggagcugcccgauaccauugaaacacuuaugcugcucgcccugaucgcugugcugaccggaggcgugacacucuuuuuccuuuccggccgggggcugggaaaaaccucuauuggccugcucugugucauggccagcuccgugcugcuuuggauggccagcguugagccgcacuggaucgcugcgucuauuauccuggaauuuuuccucauggugcugcugaucccugagcccgaccgccagagaacgccucaggauaaccaacucgccuaugucgugauugggcuucuguuuaugauccugacagucgcugccaaugagaugggacuccuggaaaccaccaagaaagaccuuggcauugggcacguggccguugagaaccaucaccaugcuacaaugcuggauguggaccuccaccccgccuccgcguggacccuguacgccgucgcuacaacgaucauuaccccuaugaugcggcauacaaucgaaaacaccacagccaauauuagccugaccgcuaucgccaaccaggcggccauccucaugggacuugauaagggcuggcccauuucuaaaauggacaucggcgugccgcugcuggcucucgggugcuacucccagguuaauccucugacgcuuaccgccgcugugcugaugcucgucgcccacuaugcuauuaucggacccggccugcaagccaaggcgacacgcgaggcccagaagagaaccgcugccgggauuaugaaaaaccccacaguggauggaaucguggcuaucgaccuggauccuguugucuacgacgccaaguucgaaaaacagcucggccagauuaugcuucugauccuguguaccagccaaauucuccugaugcggacgacaugggcccuuugcgagucuaucacccuggcgacagggccgcucaccacccugugggagggaagccccggcaaguuuuggaauacaacgauugcuguguccauggccaacaucuuccgcggcucuuaucuggcuggggccggacucgccuuuagccuuaugaaaucccugggcgggggaagacggggcaccggggcucagggagaaacacugggcgagaaguggaagcgccagcucaaucagcugagcaaauccgaauucaacaucuacaagagaucuggcauuauggagguggaccggagcgaagccaaagaggggcuuaagagaggagagaccacacgccacgcggucucccggggcaccgccaaacugagaugguucguugaacgcaaucucgugaagccugaggggaaggugaucgaucugggauguggccgggggggauggucuuauuacugcgcuggccugaaaaaggucacggaagugaaaggcuauacaaaggggggacccggccaugaggaaccuauucccauggccaccuacggguggaaccucguuaaacuucacagcggaaaggacguguuuuucaccccuccggagaaaugugauacacugcugugcgacaucggcgaguccucucccaauccuaccauugaagaggggagaacacuccgcguccugaagaugguggaacccuggcuucggggaaaccaauuuuguaucaagauucugaauccuuacaugcccagcguuguggagacgcucgagcagaugcagagaaaacauggcggcaugcugguccgcaacccgcugucccggaauagcacccacgaaauguauugggugucuugcgggacaggaaacaucguguccgcugucaauaugaccagcagaaugcuccugaaccgcuucacaauggcccaccggaagccuaccuacgagagagauguugaccuuggcgcggggacgcgccauguggccguggaacccgaggucgcuaaccuggauaucauuggacagagaaucgaaaauauuaaacacgagcauaagucuaccuggcacuaugacgaggauaaccccuacaaaacaugggccuaucauggcuccuacgaagugaagccuagcgggucugcuuccagcaugguuaauggaguggucaagcuccugaccaaacccugggacgugaucccuaugguuacacaaauugccaugaccgauacaaccccguuuggccagcagcggguguucaaggagaaagucgacacgcgcacacccaaggcuaaaagaggcaccgcccaaaucauggaagugaccgcgcgguggcuuuggggguuucuguccagaaacaagaagccucggaucuguacacgcgaggaauucacgagaaaaguucggagcaaugccgcuauuggagccguguuugucgacgagaaccaguggaauucugcuaaggaggccguggaagaugagcgcuucugggaccucguccagaaagaaagagagcugcacaagcagggcaaaugcgccaccugcguguauaacaugauggggaagcgggaaaagaaacugggagaguuuggcaaggcgaaagggagccgcgcuaucugguacauguggcucggcgccagauuccuggaguuugaagcccuuggauucaugaaugaggaucacugguucucccgggaaaacucucugagcggcguugagggggagggacuccauaagcugggcuacauucuucgcgacaucuccaaaauucccgggggaaauauguaugcugaugacacagccggcugggauaccagaaucacagaagacgaucugcaaaacgaggcuaagaucaccgacauuauggaaccugagcacgcccuccuggcgacaucuaucuuuaaacugaccuaccagaauaaggugguccgggugcagcgccccgccaagaacgggacggugauggauguuauuagcagacgggaccagcgcggcuccggacaagugggcaccuaugggcucaauacauucaccaacauggaagcucagcugaucagacagauggagucugagggaauuuuucuuccgagcgaacuggagacaccuaaccucgccgaacggguccuggauuggcuugagaaacauggcguggaaagacugaagcgcauggcuaucuccggggacgacuguguugugaaacccaucgaugaccgguucgccaccgcgcucacggcccugaaugauaugggaaaggucagaaaagacauuccucagugggagcccagcaagggcuggaacgauuggcaacaggugccuuuuugcucucaccacuuccaucagcugaucaugaaggacgggcgcgagauugucgugcccugucggaaucaggaugaacucguuggcagagcucgcgugucccaaggagccggcuggagccugcgggagacagcuugccuugggaaaucuuacgcccagauguggcagcugauguauuuucacagacgcgaccuccggcuggcugccaacgcgaucuguuccgccgucccgguggauuggguuccuaccagcagaacaaccugguccauucaugcucaccaucaauggaugacgaccgaagacaugcuuucuguguggaaucgcgucuggaucgaggaaaaccccuggauggaggauaagacacacgugagcuccuggggagacgugcccuaccugggcaaacgggaggaccaguggugcgggagccucauuggacugaccgccagagccacaugggcuucuaauauccagguugccaucaaccagguccggagacugauuggcaaugaaaacuaucucgauuacaugaccuccaugaagcgcuucaaaaaugagggggacccugaaggcgcgcugugguga

SEQ ID NO: 19147 - RNA, 9879 nt, Artificial Sequence
  derived and/or modified CDS sequence (opt5) from DENV-1__GU131688__SS-prME
agcgugaccaugcugcucaugcugaugcccacagcccuugcuuuccaccugacgaccagaggcggggaaccucauaugaucgucuccaagcaggaacggggaaaaucucuccuguuuaagacaagcgccggcguuaacaugugcacccuuauugcgauggaccugggggaguucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacagauccugccguucuccgcaaacugugcauugaagcgaagaucuccaacaccacgacagacagcagauguccgacccaaggagaggccacccuuguggaagaacaagaugcuaauuuugugugccggcgcacauucgucgacagaggcuggggcaacggguguggacuguuuggcaaagggucucucaugaccugcgccaaguucaagugcgugacaaaacuggagggaaagauuguucaguacgaaaaucuuaaauauuccgugaucgucacggugcacaccggcgaccagcaucaaguugggaacgagagcacagaacacggaaccacagcuaccaucacgccccaggccccuucuaccgagauucagcugacagauuacggcgcccucacccuggacuguagcccccggacaggccuggauuuuaaugaaauggugcuccugaccaugaaggagaaaagcuggcuuguccauaagcagugguuccuggaccucccucugcccuggacguccggggcuucuacaagccaagagaccuggaaccgcaaagaucuucuggugacauuuaagaccgcgcacgccaagaaacaggaagucgugguucucggaucccaggagggcgcuaugcacaccgcccugacaggggccacggaaauccaaaccagcggaacaaccacaauuuucgcuggccaucugaagugcagacucaaaauggacaagcugacccuuaaagggaugucuuaugugauguguacgggcuccuucaagcuggagaaggaagucgccgagacacagcacggaaccgugcucguucagaucaaauacgagggcaccgaugcgccgugcaagauuccuuuuagcacacaggacgaaaaaggggugacccaaaauggacggcugaucacagcuaaccccaucgucacggauaaggagaaaccugugaauauugaagccgagccgcccuucggcgagucuuauaucgugauuggggccggagaaaaggcucugaaacuuagcugguuuaaaaagggcuccucuaucgggaaaauguucgaggccaccgcuagaggcgcccgccggauggcgauucucggagacacagccugggauuuuggcagcaucgggggaguuuucaccuccgucggcaagcuggugcaucagaucuuugggacagcuuacggagugcuguucagcggcgucucuuggaccaugaaaauugggaucggcgugcuccugacguggcuuggacugaacuccagaagcaccucucucuccaugacauguauugccguuggccuggugacccuguaccuuggggucauggugcaggcugacagcggaugcguuaucaauuggaagggccgcgaacucaaguguggguccggaauuuuugugacaaacgagguccacaccuggacagaacaguauaaauuccaagccgacucuccuaagcggcugagcgcggccaucggcaaggcuugggaggagggggugugcggcauuagauccgccacccgccuggaaaauaucauguggaagcagaucucuaacgagcucaaccauauucugcuugaaaaugauaugaaauuuacgguuguggucggagacguggcuggcauccuggcccaggggaagaaaaugauucggccgcagcccauggaguacaaguauagcuggaaguccuggggaaaagccaagaucauuggcgcugaugugcaaaacacaaccuucaucaucgacgggccuaauacccccgaauguccugaugaccagagagcguggaacauuugggaggucgaggauuacggauuuggcaucuucacaaccaauauuuggcucaaacugcgcgacagcuauacgcagguuugcgaucaccggcugaugucugccgcuaucaaggacuccaaagccgugcacgccgauaugggcuacuggauugaaagcgagaagaacgaaacauggaaacuugcuagagccucuuucaucgaggugaaaaccuguaucuggcccaagucccauacacucuggagcaaugggguccuggaaucugagaugauuaucccgaaaauuuauggaggcccuaucagccagcacaacuaccgccccggguacuuuacccaaacagcgggaccuuggcaucugggcaagcucgagcuggacuucgaucuuugcgaagggaccacggugguuguggacgagcacugcggaaaucggggccccucccugagaaccacaaccgucacaggcaaaauuauccacgaaugguguugccggagcuguacccucccuccccugcgcuuuaagggggaggacggaugcugguauggcauggagaucagaccggugaaggaaaaagaggaaaaccugguuaagucuaugguguccgcugggagcggagaggucgauuccuucucucuuggccuccuguguauuagcaucaugauugaagaggugaugcgguccagauggucucgcaaaaugcugaugacggggacacucgccgucuuuuuccugcuuaucaugggacagcugaccuggaaugaccucauucggcugugcaucauggugggcgccaacgcuagcgauagaaugggcauggggacaaccuaccuggcccuuauggcgaccuuuaagaugcgcccuauguucgcugucggacugcucuuuagacggcugacaucccgcgaggugcuccugcuuacgauuggccugucucucguggccagcgucgaacugcccaauucccuggaggaacuuggggacggacuggccaugggcaucaugauccucaaacugcucaccgauuuccagagccaucaacugugggcuacacuucugucucucaccuuuauuaagacaaccuucucccugcacuaugccuggaagacgauggcuaugguucugagcaucgugucucuuuuuccccugugucucuccacaaccagccagaaaaccacauggcugccugugcuccuggggucucuuggaugcaagccgcugaccauguuccugauugccgagaacaaaaucuggggcagaaaguccuggccccucaaugaaggcauuauggcggucgggaucgugagcauccugcuuuccgcccugcucaaaaacgacguuccucuggcuggaccccucauugccggcgggaugcugaucgcuuguuacgugauuagcggaucuagcgccgaucuuucccuggagaaggccgcugaggucucuugggaagaggaagcggagcauagcggcgccucccacaacauccugguggaaguucaggacgaugggacaaugaaaauuaaggacgaggagcgggaugacacgcucaccauccugcuuaaggcuacacugcucgccgugucuggagucuauccucugagcauccccgccacccucuucgugugguacuuuuggcagaaaaagaaacaacgcuccggcguccugugggauacaccuucucccccggaaguggagagagcuguucuugacgacggcauuuaucggaucaugcagcgcgggcugcugggaagaagccaggugggcgucgggguguuccaggaaaauguuuuucauaccauguggcacgugacgcggggagccguccucauguaccaaggcaagcgccuggagccuuccugggcgagcgugaaaaaggaucuuauuucuuacgggggaggcuggagacugcagggcuccuggaacaccggggaggaagugcagguuaucgcugucgagcccggaaagaauccuaaaaacgugcagacagcccccggcaccuucaagacaagcgaaggggaggugggagccauugcucucgacuuuaaaccgggcaccucuggguccccuaucgucaaucgggaaggaaagauugugggccuguauggcaacgggguugugacaacgagcggaaccuacgucuccgccaucgcgcaagcuaaagccucucaggagggcccccucccugagaucgaagaugagguguucagaaagcgcaaucugacaauuauggaccuucaccccgggagcggaaagacccggagauaucugcccgccaucguucgcgaagcuauuaaacggaagcugagaacccucauccuggccccuacacgcguggucgcuuccgagauggccgaagcgcuuaaaggcaugccgauucgguaccagacgaccgccgugaaguccgagcauacagggaaagagaucguugaucugaugugccacgcuaccuuuacaaugagacuccugucucccgugcgcgucccuaacuauaauaugaucauuauggacgaagcccauuucaccgaucccuccagcaucgcugcccggggcuacauuucuacgagagugggaaugggcgaggccgcugcgaucuuuaugacagccaccccucccgggagcguggaggcuuucccucaauccaacgccgucauucaggacgaagaacgggauaucccggagcgcucuuggaauagcggauaugaguggaucaccgacuuucccggcaagacaguuugguucgugccuuccauuaagucugggaacgauaucgccaauugucugcgcaagaacggaaagcgggugauucagcucagccgcaaaaccuucgacacagaauaccagaagaccaaaaauaacgacugggauuacgucgugacgacagacaucuccgagaugggcgcuaacuuuagagccgaucggguuauugaccccagacgcugccuuaagccugugauccugaaggaugggcccgaacgggucauucuggcgggcccgaugccugugaccguugcuagcgccgcccaaagacgcggacggaucggcagaaaucacaacaaagagggggaccaguauaucuacaugggacagccccucaauaacgaugaggaccaugcucacuggacagaagccaagaugcugcuugauaauauuaacacccccgagggcaucauuccugcgcuguucgaacccgagcgcgaaaaaucugccgcuaucgacggggaguaucggcucagaggagaggcccgcaagacguuuguggaacugaugagacggggcgaucugccugucuggcucuccuacaaaguggcuagcgagggguuccaguauuccgaccgcagauggugcuuugauggcgaacggaauaaccaaguccuugaggaaaauauggacguggagauuuggaccaaggagggagaacgcaaaaagcugagaccgcgguggcuggacgccagaacauacucugauccccucgcucugcgcgaguucaaggaauuugccgcgggccggagaagcguuuccggggaccuuauccuggagaucggaaaacucccucagcaccugacccagcgcgcccagaacgcucuggauaaucucgugaugcuucauaacucugaacaaggcgggcgggccuauagacacgcuauggaggagcugcccgacacaauugaaacccugaugcuccuggcccuuaucgccgugcugacaggaggcgucacccucuucuuucugagcggccgggggcugggaaagacguccauuggccuccuuuguguuauggcuagcucugugcugcuguggauggcguccguggagccucauuggaucgccgcuagcauuauccucgaguucuuucugaugguccuucugauccccgagccggaucgccagagaacaccucaggacaaucagcucgccuacgugguuauugggcugcuguucaugauccucaccguggccgcuaacgagaugggacuucuggaaaccaccaagaaggaucugggcauugggcacgucgccguggagaaucaccaucacgcggccaugcucgacgucgaucugcaucccgcuucugccuggacccuuuacgcuguggccacaacgaucauuaccccuaugaugcggcacacaaucgaaaacaccacagcgaacauuucccugaccgccaucgcuaaucaagccgcuauccucaugggacuggacaaaggcuggcccauuagcaagauggauaucggcguuccucugcucgcccuugggugcuauucucaggugaacccccugacgcugaccgcugccguccucaugcugguggcgcauuacgccauuaucggaccgggccuucaggcuaaggccacacgcgaggcucagaagagaaccgccgccgggauuaugaagaauccuacaguugacggaaucguggcgaucgaucuggaccccgucguguaugacgcuaaauuugaaaagcagcucggccagauuaugcugcugauccucuguaccagccagauucuucugaugcggacgacaugggcccugugcgaguccaucacccucgcuacagggccccugaccacccuuugggagggaucuccuggcaaauucuggaacacaacgauugccgugagcauggccaauaucuuccgcggcuccuaccuggcuggggccggacucgcguuuagccugaugaagucccugggcgggggaagacggggcaccggggcccaaggagaaacacucggcgagaaguggaaacgccagcuuaaccagcugucuaagagcgaguucaauaccuauaaaagauccggcaucauggagguugaucggucugaagcuaaggaggggcugaaaagaggagagacaaccaagcacgccgucagccgcggcacggcuaagcuccggugguuuguggaaagaaaccuggugaaaccggaggggaaggucauugaccuuggauguggccgcgggggaugguccuacuauugcgccggccugaaaaagguuacagaagugaaaggcuacaccaaagggggacccggccacgaggaaccuauccccauggcgaccuacggguggaaucucgugaaacugcauucuggaaaggaugucuucuuuauuccucccgagaagugugacacacugcucugcgauaucggcgagagcuccccuaacccgaccauugaagaggggcggacacuuagagugcugaaaaugguugaacccuggcugcgcggaaaucaguucuguaucaagauucucaacccuuauaugcccagcguggucgagacgcuggagcaaaugcagcggaaacacggcggcaugcuugugagaaauccucugucucgcaacuccacccaugaaauguacuggguuagcugcgggacaggaaauaucgugucugccgucaacaugaccucccggaugcuccugaauagauuuacaauggcucaccgcaagcccaccuaugagcgggacguggaucugggcgccgggacgagacacguggcugucgaaccggagguugccaaccucgacaucauuggacagcgcaucgaaaacauuaaacaugagcacaagagcaccuggcauuacgaugaggacaauccuuauaagacaugggcuuaccacggcucuuaugaagugaaacccuccgggagcgccuccagcauggugaacggagucgugaagcugcuuaccaaacccugggauguuaucccuauggugacacagauugcgaugaccgacacaacccccuucggccaacagagagucuuuaaggagaaaguggacacgcggacaccuaaggccaagcgcggcaccgcucagaucauggaaguuaccgccaaauggcuguggggguuccucucuagaaauaagaaaccgcggaucuguacaagagaggaauuuacgcggaaggugcgcagcaacgcugccauuggagccgucuucguggaugagaaucaauggaacuccgcgaaagaggcuguugaagacgagagauuuugggaucuggugcaucgggaacgcgagcuucacaagcagggcaagugcgccacaugcgucuacaauaugauggggaaaagagaaaagaaacugggagaguucggcaaggccaaagggucucgggcuaucugguacauguggcucggcgcccgcuuccuggaguuugaagcucugggauucaugaacgaggaccacugguuuagcagagaaaauucccucucuggcguggagggggagggacugcauaaacuuggcuauauucugcgggauaucagcaaaauucccgggggaaacauguacgccgacgauacagcgggcugggacacccgcaucacagaagaugaccuccagaaugaggccaagaucaccgauauuauggaaccugagcacgcucugcuugccaaguccaucuucaaacugacauaucagaacaaggucgugagaguucaacggcccgcuaaaaaugggaccgugauggacgucauuucucgcagagaucagcggggcagcggacaggugggcacguacgggcucaacaccuuuacaaauauggaagcccagcugauccgccaaauggaguccgagggaauuuucagcccuucugaacuggagacccccaaccucgcgggcagagugcuggacuggcuugaaaagcaugggguugagcggcugaaaagaauggccaucuccggagacgauuguguggucaagccgaucgacgaucgcuuugcugccgcucucacagcccugaacgacaugggcaaggugcggaaagauauuccucagugggaacccagcaagggguggaaugacuggcagcagguuccuuucugcucucaccacuuucaucaacuuaucaugaaagauggcagagagauugugguccccugucgcaaccaggacgagcuggugggacgggcuagagucucccagggcgccggguggagccuccgcgaaaccgcgugccugggaaaguccuaugcccagauguggcaacugauguacuuccaccggagagaucuccgccuggcugccaaugccaucuguucugcugugccuguugacugggugcccacgagccggacaaccugguccauucaugcccaccaucaguggaugacaaccgaggauaugcuuagcgucuggaacagaguguggaucgaagagaauccguggauggaagacaaaacgcacauuucuuccuggggcgacguuccuuaucuggggaagcgcgaggaucaguggugcggaagccucaucggccugaccgcgcgggcuacaugggccaccaacauccaaguggccauuaaucaggucagacggcuuaucgggaacgagaauuaccuggacuacaugacaucuaugaagagauuuaaaaacgaaagcgaucccgagggcgcucucugguga

SEQ ID NO: 19148 - RNA, 9879 nt, Artificial Sequence
  derived and/or modified CDS sequence (opt5) from DENV-1__GU131689__SS-prME
agcgugaccauguuccugaugcucaugcccacagcccuggcuuuucaccuuacgaccagaggaggggaaccucauaugaucgucuccaagcaggaacggggaaaaucucuccuguucaagacaagcgccggcguuaacaugugcacccugauugcgauggaccuuggggaguuuugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucugcgccaccccggcuucaccgugaucgcccucuuucuggcgcaugccauugggacaucuaucacccagaagggaaucauuuucauccuucugaugcucgucaccccuagcauggcuaugagaugcgugggcauugggucccgggauuuuguugagggacugagcggcgccacauggguggacgucgugcuugagcacgggucuugugugacgaccauggcuaaggauaaacccacacuggacaucgaacuccugaagaccgaggucacaaacccugccguucugcgcaaacucugcauugaagcgaagaucuccaauaccacgacagauagcagauguccgacccaaggagaggccacccugguggaagaacaagacgcuaacuucgugugccggcgcacauuugucgauagaggcuggggcaauggguguggacuuuucggcaaagggucucugauuaccugcgccaaguuuaagugcgugacaaaacucgagggaaagaucguucaguacgaaaaccugaaauauuccgugaucgucacggugcacaccggcgaccagcaucaaguugggaaugagagcacagaacacggaaccacagcuaccauuacgccccaggccccuucuaccgagauccagcuuacagacuacggcgcccugacccucgauuguagcccccggacaggccuggacuucaacgaaauggugcugcucaccaugaaggagaaaagcuggcugguccauaagcagugguuucuugaucugccucuccccuggacguccggggcuucuacaagccaagagaccuggaaucgccaggaccugcuugugacauucaaaaccgcgcacgccaagaagcaggaagucgugguucugggaucccaagagggcgcuaugcacaccgcccucacaggggccacggaaauucagaccagcggaacaaccacaaucuucgcuggccaucugaaaugcagacugaagauggauaaacucacccugaaggggaugucuuaugugauguguacgggcuccuuuaaacuugagaaggaagucgccgagacacagcacggaaccgugcugguucagauuaaguacgagggcaccgacgcgccgugcaaaaucccuuucagcacacaagaugaaaagggggugacccagaacggacggcucaucacagcuaaucccauugucacggacaaagagaagccugugaacaucgaagccgagccgcccuuuggcgagucuuauauugugaucggggccggagaaaaagcucugaagcugagcugguucaagaaaggcuccucuauugggaagauguuugaggccaccgcuagaggcgcccgccggauggcgauccuuggagauacagccugggacuucggcagcaucgggggaguuuuuaccuccgucggcaaacucgugcaucagauuuucgggacagcuuacggagugcuguuuagcggcgucucuuggaccaugaagaucgggauuggcgugcugcucacguggcugggacuuaauuccagaagcaccucucuguccaugacauguaucgccguuggccucgugacccuguaccugggggucauggugcaggcugauagcggaugcguuauuaacuggaaaggccgcgaacuuaaguguggguccggaaucuucgugacaaaugagguccacaccuggacagaacaauauaaguuucaggccgacucuccuaaacggcucagcgcggccauuggcaaggcuugggaggagggggugugcggcaucagauccgccacccgccuggaaaacaucauguggaaacagauuucuaacgagcugaaucauauccuccuggaaaacgacaugaaacuuacgguuguggucggagauguggcuggcauucuggcccaggggaaaaagaugauccggccgcaacccauggaguacaaauauagcuggaaguccuggggaaaggccaaaauuaucggcgcugacgugcagaauacaaccuucaucauugaugggccuaacacccccgaauguccugacgaucagagagcguggaauaucugggaggucgaggacuacggauuuggcauuuucacaaccaacaucuggcucaagcugcgcgauagcuauacgcagguuugcgaccaccggcugaugucugccgcuauuaaagauuccaaggccgugcacgccgacaugggcuacuggaucgaaagcgagaaaaaugaaacauggaaacuugcuagagccucuuucaucgaggugaagaccugugucuggcccaaaucccauacacucuggagcaacggggugcuggaaucugagaugauuaucccgaagauuuauggaggcccuaucagccaacacaauuaccgccccggguacuuuacccagacagcgggaccuuggcaucugggcaaacucgagcuggauuucgaccuuugcgaagggaccacgguuguggucgaugagcacugcggaaaccggggccccucccugagaaccacaaccgugacaggcaagauuauccacgaaugguguugccggagcuguacccucccuccccugcgcuuuaaaggggaggacggaugcugguauggcauggagaucagaccgguuaaggaaaaggaggaaaaucuggugaaaucuauggucuccgcugggagcggagagguggacuccuucucucuuggccuccuguguauuagcaucaugauugaagagguuaugcgguccagauggucucgcaagaugcugaugacggggacacucgccguguuuuuccugcuuaucaugggacagcugaccuggaacgaucucauucggcugugcaucauggucggcgccaaugcuagcgacagaaugggcauggggacaaccuaccuggcccuuauggcgaccuuuaaaaugcgcccuauguucgcugugggacugcucuuuagacggcugacaucccgcgaggugcuccugcuuacgauuggccugucucucgucgccagcguugaacugcccaacucccuggaggaacuuggggauggacuggccaugggcaucaugauccucaagcugcucaccgacuuccaaagccaucagcugugggcuacacuucugucucucaccuuuauuagaacaaccuucucccugcacuaugccuggaaaacgauggcuauggugcugagcaucgugucucuuuuuccccugugucucuccacaaccagccagaagaccacauggcugccuguccuccuggggucucuuggaugcaagccgcugaccauguuccugauugccgagaauaaaaucuggggccggaaguccuggccccucaacgaaggcauuauggcgguggggaucguuagcauccugcuuuccagccugcucaaaaacgaugugccucuggccggaccccucauugcuggcgggaugcugaucgccuguuacgucauuucuggaagcuccgcugaccuuucucuggagaaggccgccgaggugagcugggaagaggaagcugagcauuccggcgcgucucacaauauccugguugaagugcaggaugacgggacaaugaaaauuaaggaugaggagcgcgacgauacgcucaccauccugcuuaaagccacacugcucgcugucagcggaguguauccucuguccauccccgccacccucuucgucugguacuuuuggcaaaagaagaaacagagaucuggcgugcugugggacacaccuuccccucccgaaguugagcgggccgugcuugaugacggcauuuaucgcaucaugcagagagggcugcugggacggucccaggucggcguggggguuuuccaagaaaacguguuucauaccauguggcacgucacgcgcggagcugugcucauguaccagggcaagagacuggagcccagcugggccucugugaaaaaggaccuuauuuccuacgggggaggcuggcggcugcagggcagcuggaauaccggggaggaaguucaggucaucgcgguggagcccggcaagaauccuaagaaugugcaaacagcucccggcaccuucaagacaucugaaggggaggucggagccauugcccucgauuuuaaaccgggcaccuccgggagcccuaucgugaacagagaaggaaagauuguuggccuguauggcaaugggguggucacaacguccggaaccuacgugucugcuaucgcccaggcgaaagcuagccaggagggcccccucccugagaucgaagacgagguuuuccgcaagcggaaccugacaauuauggaucuucaccccggguccggaaaaaccagacgcuaucugcccgccaucgugcgggaagccaugaagagacgccugcggacccucauucuggcuccuacaagagucguggccagcgagauggcugaagcccuuaagggcaugccgauccgcuaccaaacgaccgcgguuaaaucugagcauacagggaaggagauuguggaccugaugugccacgccaccuuuacaaugcggcuccugucccccgucagagugccuaauuauaacaugaucaucauggaugaagcucauuucaccgaccccagcucuauugccgcucggggcuacaucagcacgcgcgugggaaugggcgaggccgccgcuauuuuuaugacagcgaccccucccggguccgucgaagccuucccucagucuaaugcuguuauccaggaugaggaaagagacauuccggagcggagcuggaacuccggauaugaguggaucaccgauuuucccggcaaaacagugugguucgugccuucuaucaagagcgggaaugacauugccaacugucugcgcaaaaauggaaagagagucauccagcucucccggaagaccuucgauacagaauaccagaagaccaagaacaacgacugggacuacgugguuacgacagauauuagcgagaugggcgccaauuuuagagcugaccgcgugaucgauccccggagaugccuuaaaccugucauucugaaggacgggcccgaacgcgugauccuggccggcccgaugccuguuaccguggcgucugcugcccagcggagaggacgcauuggccggaaccacaauaaagagggggaucaguauaucuacaugggacagccccucaacaaugacgaggaucaugcccacuggacagaagcuaagaugcugcuugacaacaucaauacccccgagggcauuaucccugcccuguucgaacccgagagagaaaaguccgcggccauugauggggaguaucgccucagaggagaggcucggaaaacguuugucgaacugaugcgcagaggcgaccugccuguguggcucagcuacaaggucgccuccgagggguuccaauauucugaucggcgcuggugcuuugacggcgaaagaaacaaucaggugcuugaggaaaacauggauguugagaucuggaccaaagagggagaacggaagaaacugagaccgcgcuggcuggacgcucggacauacagcgacccccucgcccugagagaguucaaggaauuugcugccggccgccgguccgugucuggggaucuuauucuggagaucggaaaacucccucagcaccugacccagagagcgcaaaaugcccuggacaaccucgugaugcuucauaauagcgaacagggcgggcgggcuuaucgccacgccauggaggagcugcccgauacaaucgaaacccugaugcuccuggcucuuauugccguccugacaggaggcguuacccucuucuuucuguccggcagagggcugggaaagacgagcaucggccuccuuugugugauggccucuuccgugcugcuguggauggcuagcgucgagccucauuggauugcggccucuaucauucucgaguucuuucugauggugcuucugauccccgagccggaccggcagcgcacaccucaggauaaccaacucgcuuacguugugaucgggcugcuguucaugauucucaccgucgccgccaaugagaugggacuucuggaaaccacaaagaaagaccugggcaucgggcacguggcugucgagaaccaccaucacgccgcgaugcucgauguggaccugcaucccgccuccgcuuggacccuuuacgccguugcuacaacgauuaucaccccuaugaugagacacacaauugaaaacaccacagccaauaucagccugaccgcgauugccaaccaggcugccauccucaugggacuggauaagggcuggcccaucucuaaaauggacauuggcgugccucugcucgcucuugggugcuauagccaggucaauccccugacgcugaccgccgcugugcucaugcugguugcccauuacgcgaucauuggaccgggccuucaagccaaggcuacacgggaggcccagaaacgcaccgcugccgggaucaugaagaacccuacaguggauggaauugucgccaucgaccuggaucccgugguguaugacgcgaaguuugaaaaacagcucggccagaucaugcugcugauucucuguaccucccaaauccuucugaugagaacgacaugggcucugugcgagucuauuacccucgccacagggccccugaccacccuuugggagggaagcccuggcaaguucuggaauacaacgaucgcuguuuccauggccaacauuuuccggggcagcuaccuggccggggcuggacucgccuuuucccugaugaaaucucugggcgggggacgcagaggcaccggggcgcagggagaaacacucggcgagaaguggaaacggcagcuuaaucagcugagcaaguccgaguucaacaccuauaagagaucuggcaucauggaggucgaccgcagcgaagccaaagaggggcugaagcggggagagacaaccaaacacgcuguguccagaggcacggccaagcuccgcugguuuguggaacggaaucuggucaaaccggaggggaagguuaucgaucuuggauguggcagagggggauggucuuacuauugcgcuggccugaagaaagugacagaagugaagggcuacaccaaagggggacccggccacgaggaaccuauucccauggccaccuacggguggaaccucgucaagcugcauagcggaaaagacguguucuuuaucccucccgagaagugugauacacugcucugcgacauuggcgaguccagcccuaauccgaccaucgaagaggggcgcacacuucggguucugaaaaugguggaacccuggcugagaggaaaccaauucuguauuaagauccucaauccuuauaugcccucugucguggagacgcuggagcagaugcagcgcaagcacggcggcaugcuuguucggaacccucuguccagaaauagcacccaugaaauguacugggugucuugcgggacaggaaacauugucuccgcggugaauaugaccagccgcaugcuccugaaccgguuuacaauggcccacagaaaacccaccuaugagcgcgauguggaccugggcgcugggacgagacacgucgccguugaaccggaggaagcuaaccucgauaucaucggacagcggauugagaauaucaagcaugagcacaaaucuaccuggcauuacgacgaagauaacccuuauaagacaugggccuaccacggcuccuaugaggugaaacccagcggguccgcuagcucuauggugaauggagucgugaagcugcuuaccaagcccugggacguuauuccuauggugacacaaaucgccaugaccgauacaacccccuucggccagcagcgcgucuuuaaagaaaagguggacacgagaacaccuaaagcgaagcggggcaccgcccaaauuauggagguuaccgcuaaauggcuguggggguuccucagcagaaacaagaagccgcggaucuguacacgcgaagaguuuacgagaaaagugcgguccaaugccgcuaucggagccgucuucguggacgagaaccaguggaacucugccaaggaagcgguugaggaugaacgcuuuugggaccuggugcauagagagcgggaacuucacaaacagggcaagugcgcuaccugcgucuacaacaugauggggaaacgcgagaagaagcugggagaguucggcaaagccaaggggagcagagccauuugguacauguggcucggcgcucgguuccuggaauuugaggcccugggauucaugaaugaagaucacugguuuucccgcgagaacucucucagcggcguggagggggaaggacugcauaaacuuggcuauauccugagagacauuuccaagauccccgggggaaauauguacgcugaugacacagccggcugggauacccggauuacagaggacgaucuccagaacgaagcgaaaaucaccgacaucauggagccugaacacgcccugcuugcuaagucuauuuucaaacugacauaucaaaauaaggucgugcgcguucagagacccgccaagaacgggaccgugauggaugucaucagccggcgcgaccagagaggcuccggacaggugggcacguacgggcucaauaccuuuacaaacauggaggcucaacugauucggcagauggagagcgaaggaaucuucucuccuuccgagcuggaaacccccaaccucgccggcagagugcuggauuggcuugagaaacaugggguugaacgccugaagcggauggcgauuagcggagacgacuguguggucaaaccgaucgaugacagauuugccacagcucucaccgcccugaaugauaugggcaaggugcgcaaagacaucccucagugggagcccucuaagggguggaacgauuggcagcaaguuccuuucugcucccaccacuuucaucagcuuauuaugaaggacggccgggagaucgugguccccuguagaaaucaggaugaacuggugggacgcgcucgggucagccagggcgccggguggucccucagagagacggcuugccugggaaaaucuuaugcccaaauguggcagcugauguacuuccaccgccgggaccucagacuggcggccaacgcuauuuguagcgccgugccuguugauugggugcccacaucccgcaccacauggagcauccaugcccaccaucaguggaugaccacggaagacaugcuuucugucuggaaucggguguggauugaggaaaacccguggauggaggauaagacccacguuuccagcuggggcgacgugccuuaucuggggaaaagagaggaccaauggugcggaucucucaucggccugacagcucgggccaccugggcgacaaauauucaggucgcuaucaaccaggugagacgccuucuggggaaugaaaacuaccucgauuacaugaccagcaugaagcgguuuaaaaaugaguccgaccccgaaggcgcccugugguga

SEQ ID NO: 19149 - RNA, 9879 nt, Artificial Sequence
  derived and/or modified CDS sequence (opt5) from DENV-1__GU131690__SS-prME
agcgugaccaugcugcucaugcugaugcccacagcccuugcuuuccaccugacgaccagaggcggggaaccucauaugauugucuccaagcaggaacgggggaaaucucuccuguuuaagacaagcgccggcguuaacaugugcacccuuauugccauggaccugggggaacucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgugacacgccuggaaaacaucauguggaaacagauuuccaacgagcuuaaucauauccugcucgaaaacgacaugaaguucaccguuguggucggagauguggcuggcauucuggcccaggggaaaaagaugauccggccgcaacccauggagcacaaauacucuuggaaaagcuggggaaaggcuaagauuaucggcgccgacgugcagaauaccacauuuaucauugaugggccuaacacccccgaauguccugacgaucagagagccuggaauaucugggaggucgaggacuauggauucggcauuuuuacgacaaacaucuggcugaaacuucgcgauuccuacacccagguuugcgaccaccggcucaugagcgcugcgauuaaagauucuaaggccgugcaugcugacaugggcuauuggaucgaauccgagaaaaaugaaacauggaagcuggccagagccagcuucaucgaggugaagaccuguauuuggcccaaaucucacacacugugguccaacgggguccucgaaagcgagaugaucauuccgaagaucuacggaggcccuauuucucaacauaauuaucgccccggguacuucacccagacggcuggaccuuggcaccugggcaaacuugagcuggauuuugaccucugcgaagggaccacagugguuguggaugagcacugcggaaaccggggccccagccugagaaccacaaccgucacgggcaagaucauccaugaaugguguugccgguccuguacacugccuccccuucgcuucagaggggaggacggaugcugguacggcauggagauucggccggugaaagaaaaggaggaaaaucucguuaagagcauggugucugccggguccggagaggucgacagcuuuucccugggccugcucuguaucucuauuaugaucgaagaggugaugagaagccgcuggucccggaaaaugcugaugaccgggacacuugcgguuuucuuucugcucauugugggacagcugaccuggaacgaucugaucagacuuugcauuauggucggcgcuaaugccucugaccgcaugggcauggggaccacauaucuggcccucauggcuacguucaagaugagaccuauguuugccgugggacugcuguuccggcgccugaccagcagagaggugcuucugcucacaaucggccugucccuggucgcgucuguugaacuucccaacagccuggaggaacucggggauggacuggcuaugggcaucaugauucucaaacugcuuaccgacuuucaaucccaccagcugugggccacacuccugagccugaccuucaucaagacgacauuuucucuucauuacgccuggaaaaccauggcuauggugcuguccguggucagccucuucccccugugucucucuaccacaucccagaagaccacauggcugccugugcuucuggggagccugggaugcaagccgcucacgauguuucugauugccgagaauaaaaucuggggccggcgcucuuggccccuuaacgaaggcauuauggcuguugggaucguguccauccugcucagcucccugcucaagaacgaugucccucuggccggaccccuuauugcgggcgggaugcugaucgccuguuaugugauuagcggaucuagcgcugaccugucccucgagaaagccgcugagguuucuugggaagaggaagccgagcacagcggcgccucccauaauauccugguggaaguccaggaugacgggaccaugaagauuaaagaugaggagagagacgauacacuuaccauccugcucaaggcuacacugcucgcggugucuggagucuacccucugagcauccccgccacccuuuucgugugguauuucuggcagaagaagaagcagcgguccggcguucugugggacacgccuucucccccggaaguggagcgcgcuguccuggaugacggcauuuacagaaucaugcagcgggggcuccugggacgcagccaggugggcguugggguguuucaagaaaacgucuuccacaccauguggcacgugacaagaggagccgugcuuauguaucagggcaaacggcuggagccuuccugggccagcguuaagaaagaccucauuucuuacgggggaggcuggagacugcagggcuccuggaauaccggggaggaaguccaggugaucgcuguggagcccggaaagaacccuaaaaauguccaaacagcccccggcaccuuuaagacaccggaaggggaggugggagcgauugcucucgauuucaagccuggcacgagcgggucucccaucguuaaccgcgaaggaaaaauugugggccuguacggcaauggggucgugaccacauccggaaccuauguuagcgccaucgcccaggcuaaggccucccaggagggcccucuucccgagaucgaagacgagguguuucggaaaagaaaccugaccauuauggaucugcaucccgggucuggaaagacacgccgguaccucccugcgaucgucagagaagcuauuaaacgcaagcugcggacgcuuauccuggccccgaccagagugguugccagcgagauggcugaagcccucaagggcaugcccauucgcuaucaaacaaccgcugugaaauccgagcacacagggaaggagaucgucgaccugaugugccaugccaccuucacgaugcggcugcucagcccugugagagugcccaauuacaacaugaucauuauggaugaagcgcacuuuacagacccuucuuccaucgccgcucggggcuauauuagcacccgcgucggaaugggcgaggccgcugccaucuucaugaccgccacacccccugggucuguugaggcuuuuccgcagagcaaugcggugauucaggaugaggaaagagacauccccgagcgguccuggaacucuggauacgaguggaucaccgauuucccuggcaaaacagugugguuuguccccagcauuaaguccgggaaugacaucgccaacugucuucgcaaaaauggaaagagagugauucagcugucucggaagaccuucgauacggaauaucagaagaccaagaacaacgacugggacuacguugugaccacagauaucagcgagaugggcgcuaauuucagagccgaccgcgucauugauccucggagaugccugaaacccgugauccucaaggacgggccggaacgcguuauucuggccggcccuaugcccgugaccgucgcuuccgccgcgcagcggagaggacgcaucggccggaaccauaauaaagagggggaucaguacaucuauaugggacagccccuuaacaaugacgaggaucacgcucacuggacggaagccaagaugcugcucgacaacauuaauaccccugagggcaucauucccgcccuguuugaaccugagagagaaaagagcgcugccaucgauggggaguaccgccugagaggagaggcgcggaaaacauucguggaacucaugcgcagaggcgaccuuccggucuggcugucuuauaagguggccuccgagggguuucaauacagcgaucggcgcuggugcuucgacggcgaaagaaacaaucagguucuggaggaaaacauggauguggagauuuggaccaaagagggagaacggaagaaacucagaccccgcuggcuggacgcucggacauauuccgacccucuugcccugagagaguuuaaggaguucgcugccggccgccggucugugagcggggaucucauccuggagaucggaaaacugccccagcaucucacccagagagcucaaaaugcccuugacaaccuggucaugcugcacaauuccgaacagggcgggcgggcguaccgccaugccauggaggagcucccugauacaauugaaacccugaugcuucuggcucucaucgccguucugacgggaggcgugacacuguuuuuccucucuggcagagggcuuggaaagaccagcauuggccugcugugugugauggcuuccagcguccuccuguggauggccucuguggagccccacuggaucgccgcuuccauuauccuugaauuuuuccugaugguucuccugaucccggagccugaccggcagcgcacaccccaggauaaccaacuggcguauguggucauugggcuccuuuuuaugauccugacaguggccgcuaaugagaugggacugcucgaaaccacaaagaaagaccugggcauugggcacgucgccguggagaaccaucaccaugccgcuaugcuugauguugaccugcacccugccagcgcguggacgcucuacgccguggcuaccacaaucauuacccccaugaugagacauacaaucgaaaacaccacggccaauauuucucugaccgcuaucgccaaccaggcggccauccugaugggacucgauaagggcuggccuauuuccaaaauggacaucggcgucccccuucuggcucuggggugcuacagccaggugaauccgcucacacugaccgccgcuguucuuaugcugguggcccacuaugcuauuaucggaccuggccuccaagccaaggcgacacgggaggcccagaaacgcaccgcugccgggauuaugaagaaccccacggucgauggaaucguggcuaucgaccuggaucccgugguuuacgacgccaaguucgaaaaacagcugggccagauuaugcuccuuauccuguguacaucucaaauucugcucaugagaaccacaugggcccugugcgagagcaucacccuugcgaccgggccucugacaacgcucugggagggauccccgggcaaguuuuggaauaccacaauugcugucucuauggccaacaucuuccggggcagcuaucuggcuggggccggacuggccuucucccucaugaaaagccuuggcgggggacgcagaggcaccggggcucagggagaaacacugggcgagaaguggaaacggcagcugaaucagcucuccaagucugaauuuaacaccuacaagagaagcggcaucauggagguggaccgcuccgaagccaaagaggggcugaagcggggagagacgacaaaacacgcggugucuagaggcaccgccaaacuucgcugguucgucgaacggaaucugguuaaacccgaggggaaggugauugaucucggauguggcagagggggauggagcuauuacugcgcuggccugaagaaagugaccgaagucaagggcuauacaaaagggggaccuggccaugaggaacccaucccuauggccaccuacggguggaaccuggugaagcuccacuccggaaaagacguguuuuucauucccccugagaagugugauacacuucugugcgacaucggcgagucuagcccgaaucccacgauugaagaggggcgcacccugcggguucucaaaauggucgaaccuuggcugagaggaaaccaauuuuguaucaagauucuuaaucccuacaugccuuccgugguugagacacuggagcagaugcagcgcaagcauggcggcaugcucgugcggaacccccugagcagaaauucuacccacgaaauguauugggucuccugcgggacaggaaacaucgugagcgcugugaauaugaccucucgcaugcugcucaaccgguucacgauggcccacagaaaaccgaccuacgagcgcgaugucgaccugggcgcggggacaagacauguugccguggaaccugagguggcuaaccuugauaucauuggacagcggaucgaaaauauuaagcacgagcauaaauccaccuggcacuaugacgaggauaaccccuacaagacaugggccuaucauggcagcuacgaagucaaacccucuggguccgcuagcuccauggugaauggaguugugaagcugcucaccaagccuugggacgucauccccauggugacacaaauugccaugaccgauacgacaccuuuuggccagcagcgcguuuucaaagagaagguggacaccagaaccccgaaagcuaagcggggcacagcccaaaucauggaagucacggcgaaauggcuguggggguuucuuagcagaaacaagaagccccggaucuguacccgcgaggaguucacaagaaaagugcggucuaaugccgcuauuggagccguuuuuguggacgagaaccaguggaauagcgcuaaggaggccgucgaagaugagcgcuucugggaccuggugcacagagaacgggagcuccacaaacagggcaagugcgcgaccugcgucuauaacaugauggggaaacgcgaaaagaagcugggagaguuuggcaaagcgaagggguccagagcuaucugguacauguggcugggcgcccgguuccucgaguucgaagcccugggauuuaugaaugaggaucauugguucucucgcgaaaacagccuuuccggcguggagggggagggacugcacaaacucggcuacauucugagagacaucucuaagauuccugggggaaauauguaugcugaugacacagccggcugggauacccggaucacagaagacgaucuucagaacgaggcucgcaucaccgacauuauggaacccgagcaugcccugcucgcgaaaagcaucuuuaagcugacguaccaaaauaaaguugugagaguccagcggccugccaagaacgggaccgugauggaugugauuucccgcagagaccagcggggcucuggacagguuggcacauaugggcugaauaccuucacaaacauggaagcucaacucaucagacagauggagagcgagggaaucuuuucccccagcgaacuggagaccccgaaccuugccgaacgcgugcuggauuggcucgagaaguacggcgucgaacggcugaaaagaauggcuaucucuggggacgacugugugguuaagccuaucgaugaccgcuucgccacggcgcuuacagcccugaaugauaugggaaaagugcggaaggacauuccccagugggagccuuccaaaggcuggaacgauuggcagcaaguccccuuuugcagccaccacuuccaucagcucaucaugaaggacgggagagagauuguggucccuugucgcaaucaggaugaacuggugggccgggcuagaguuucucagggagccggcuggucccugcgcgagaccgcuugccucggaaagagcuaugcccaaauguggcagcugauguacuuucaccggagagaccuucgccuggcugccaacgcgaucuguuccgccgugcccgucgauuggauuccgacaucucggaccacguggagcauccaugcucaccaucaguggaugaccacagaagacaugcucuccguguggaauagaguuuggauugaggaaaacccuuggauggaggauaaaacccacaucagcucuuggggagacgugcccuaucugggcaagcgggaggaccaauggugcgggucccuuaucggacugacagccagagccaccugggcuacaaauauucaggucgccaucaaccaggugcgccggcucauuggcaaugaaaacuaccuggauuacaugaccagcaugaaaagauucaagaaugagucugaccccgaaggggcgcugugguga

SEQ ID NO: 19150 - RNA, 9879 nt, Artificial Sequence
  derived and/or modified CDS sequence (opt5) from DENV-1__GU131695__SS-prME
uccgugaccaugcugcucaugcugaugcccacagcccuugcuuuccaccugacgaccagaggaggggaaccucauaugaucgucuccaagcaggaacggggaaaaucucuccuguuuaagaccagcgccggaguuaauaugugcacccuuaucgcgauggaccugggggagcucugugaagauacaaugaccuacaaaugcccgcgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacggaaugaaguucaccguuguggucggcgacguggccgggauucucgcucagggcaagaagaugauccggccgcaacccauggaguacaaauauucuuggaaaagcuggggcaaggccaagauuaucggggccgaugugcagaauaccacauuuaucauugacggaccuaacacccccgaauguccugaugaccagagagcuuggaauaucugggaggucgaggauuacggcuucggcauuuuuacgacaaacaucuggcugaagcugcgcgacuccuauacccagguuugcgaucaccggcuuaugagcgcggccauuaaagacucuaaggcugugcacgccgauaugggguacuggaucgaauccgagaaaaaugaaacauggaagcucgccagagcuagcuucaucgaggugaagaccuguauuuggcccaaaucucauacacugugguccaacggaguccuggaaagcgagaugaucauuccgaagaucuauggcgggccuauuucucaacacaauuaccgccccggauacuucacccagacggccggcccuuggcaucucgggaaacuggagcuugacuuugaucugugcgaaggaaccacagugguuguggacgagcacugcggcaaccggggccccagccucagaaccacaaccgucacggggaagaucauccacgaaugguguugccggacauguacccugccuccccugcgcuucagaggagaggauggcugcugguaugggauggagauucggccggugaaagaaaaggaggaaaaucuuguuaaguccauggugagcgcgggaucuggcgaggucgacuccuuuagccucgggcugcuguguaucuccauuaugaucgaagaggugaugagaucucgcuggagccggaaaaugcucaugacaggaacccuggcuguuuucuuucuucugauuaugggccagcucaccuggaacgaccugaucagacugugcauuauggugggcgccaaugccuccgaucgcauggggaugggaacaacguaccuugcucugauggccaccuucaagaugagaccuauguuugcggucggccuccuguuccggcgccucacaucuagagaggugcugcuucugaccaucgggcucagccugguggcuuccgucgaacugcccaacucucuugaggaacugggagacggccucgccauggggaucaugauucugaaacuccugacagauuuucaaagccaucagcuuugggccacccugcucucccugacguucaucaagacaaccuuuagccugcacuaugcuuggaaaaccauggccaugguucuuucuauugugucccuguucccccucugucugagcacaaccucucagaagacaacguggcucccugugcugcuuggaucccugggcugcaagccgcugaccauguuucucaucgcugagaauaaaauuuggggccggcgcagcuggccccugaacgaagggaucauggccgucggaaucgugucuauucuucuguccagccuccugaagaacgacguuccucucgcgggcccccugaucgccgggggaaugcuuauugcuuguuacgugaucuccggcagcucugccgaucugagccuggagaaagcugccgaggucuccugggaagaggaagccgagcauucuggggcuagccacaauauucucguggaaguucaggacgauggaacaaugaagaucaaagacgaggagagagaugacacccugacaauccuucugaaggcgacccuccuggccguguccggcgucuauccucucucuauucccgcuacgcuguucgugugguacuucuggcagaaaaagaagcagcggagcggcguccuuugggauaccccuagcccucccgaaguggagcgcgccguucuggacgaugggaucuauagaauuaugcagcggggacugcucggccgcucucaggugggggucggaguguuucaagaaaacguuuuccauacaauguggcacgugaccagaggcgccguccugauguaccaggggaaacggcuugagcccagcugggcuuccgugaagaaagaccugaucagcuacggaggcggcuggagacuccaggggucuuggaauacaggagaggaagugcagguuauugccgucgagcccggcaagaacccuaaaaaugugcaaaccgcgcccgggacauuuaagacgccggaaggagaggugggcgcuaucgcccuggacuucaagccugggaccuccggaagccccauugucaaccgcgaaggcaaaaucgugggccucuaugggaauggaguugugacaaccucuggcaccuacgucuccgccaucgcucaggccaaggcgagccaggaggggccucugcccgagauugaagaugagguguuucggaaaagaaaccuuacaaucauggaccugcaccccggauccggcaagacgcgccgguaucugccugcuauuguuagagaagccaucaaacgcaagcuccggacccugauucuugccccgacaagaguggucgcuucugagauggccgaagcucugaaggggaugcccauccgcuaccaaaccacagccgugaaaagcgagcauaccggcaaggagaucguugaucucaugugccacgcgacguucacaaugcggcugcuguccccugugagaguccccaauuauaacaugauuaucauggacgaagcccauuuuaccgauccuagcucuauugcugcccggggauacaucuccacccgcgugggcaugggggaggcugccgccauuuucaugacagcuacacccccuggaagcguggaagcguuuccgcagucuaaugccgucauccaggacgaggaaagagauauccccgagcggagcuggaacuccggcuaugaguggauuacagacuucccugggaaaaccguuugguuugugcccucuaucaagagcggaaaugauauugcuaacugucuccgcaaaaauggcaagagagugauccagcuuucccggaagacguucgacacagaauaccagaaaaccaagaacaacgauugggacuacgucgugacaaccgacauuucugagaugggggccaauuucagagccgaucgcguuaucgacccucggagaugccugaaacccgugauucugaaggauggcccggaacgcgucauccucgcuggaccuaugcccgugacgguugccagcgcggcucagcggagaggccgcaucgggcggaaccacaauaaagagggagaccaguauauuuacaugggccagccccugaacaaugaugaggaccaugcccacuggaccgaagccaagaugcuucuggauaacaucaauacaccugaggggauuauccccgcucucuuugaaccugagagagaaaaguccgccgcgauugacggagaguaucgccugagaggcgaggcccggaaaaccuucguggaacugaugcgcagaggggaucucccggucuggcuuagcuacaagguggcuucugagggcuuucaauauuccgaccggcgcuggugcuucgauggagaaagaaacaaucagguccuggaggaaaacauggacguggagaucuggacaaaagagggcgaacggaagaaacugagaccccgcuggcucgaugcccggaccuacagcgacccucuggcucuuagagaguuuaaggaguucgccgcugggcgccgguccguuucuggagaccugauccucgagauuggcaaacugccccagcaccugacacagagagcccaaaaugcgcucgauaaccuugugaugcugcauaauagcgaacaagggggacgggccuaucgccacgcuauggaggagcugccugacaccaucgaaacgcucaugcugcuugcccugauugcugugcucacaggcggcgucacccuguuuuuccuguccgggagaggacucggcaagaccucuaucgggcuucuguguguuauggccagcuccgugcugcucuggauggccagcguggagccccauuggauugcugcgucuaucauccuggaauuuuuccuuaugguccugcucauuccggagccugaucggcagcgcacaccccaggacaaccaacuggccuacgugguuaucggacugcucuuuaugauucuuaccguggcugccaaugagaugggccugcuggaaacaacgaagaaagaucucgggaucggacacgucgccguggagaaccaccaucacgcugccaugcuggacgucgaucuucauccugcguccgccuggacccuguacgcuguggccacaaccauuaucacacccaugaugagacacaccauugaaaacacgaccgcuaauaucagccucacagccaucgcgaaccaggccgcuauucugaugggccuggacaagggcuggccuaucucuaaaauggauauugggguuccccuccuugcccugggaugcuauucccaggugaauccgcugacccucacagcugccguccugaugcuuguggcucauuacgccaucauuggcccugggcugcaagcgaaggccacccgggaggcucagaaacgcacggccgcuggaaucaugaagaaccccacaguugacggcaucguggccauugaucucgaccccgucguguaugaugccaaguucgaaaaacagcuggggcagaucaugcugcucauucuuuguaccagccaaauccugcugaugagaacaaccugggcgcucugcgagucuauuacccuggcuacaggaccucuuacgacccugugggagggcagcccgggcaaguuuuggaauacaaccaucgccguguccauggcuaacaucuuccgggggucuuaccucgccggagccggccuggcuuucagccugaugaaaucccucgggggaggccgcagagggacaggagcccagggcgaaacccuuggcgagaaguggaaacggcagcugaaucagcugagcaaguccgaauuuaacacguauaagagaucugggauuauggagguugaccgcagcgaagcgaaagagggacucaagcggggcgagacaaccaaacacgccgucuccagagggaccgcuaagcugcgcugguucguggaacggaaucuugugaaacccgagggaaaggucaucgaccugggcugugggagaggaggcuggucuuacuauugcgccggccucaagaaaguuacagaagugaagggguacaccaaaggaggcccugggcacgaggaacccauuccuauggcuacauacggauggaaccuggugaagcugcauagcggcaaagaugucuuuuucauucccccugagaagugugacacgcuccuuugcgauauuggggaguccucuccgaaucccaccaucgaagagggacgcacacugcgggugcugaaaaugguugaaccuuggcucagaggcaaccaauuuuguauuaagauccugaaucccuauaugccuagcguggucgagacccuugagcagaugcagcgcaagcacggcgggaugcuggugcggaacccccucuccagaaauagcacacaugaaauguacuggguuucuugcggaaccggcaacaucguguccgccgucaauaugacgagccgcaugcugcugaaccgguucaccauggcgcacagaaaaccgacauaugagcgcgacguggaucucggggccggaaccagacacguggcugucgaaccugagguugccaaccuggacauuaucggccagcggauugaaaauaucaagcaugagcacaaaucuacauggcauuacgaugaggacaaccccuauaagaccugggcuuaccacggguccuaugaagugaaacccagcggaucugccuccagcauggugaauggcgucgugaaacuucugacaaagccuugggauguuauucccauggugacccaaaucgcuaugacggacacaaccccuuuuggccagcagcgcgucuucaaagagaagguggauaccagaacaccgaaagccaagcgggggacggcgcaaaucauggaaguuaccgccaaauggcucuggggauuucuguccagaaacaagaagccccggauuuguacacgcgaggaguucaccagaaaagugcggagcaaugcugccaucggcgcugucuuuguggacgagaaccaguggaacucugccaaggaggccguugaagacgagcgcuucugggaucuugugcauagagaacgggagcugcacaaacaggggaagugcgcgacaugcgucuacaacaugaugggaaaacgcgaaaagaagcucggcgaguuugggaaagcuaagggcagcagagccauuugguacauguggcugggagcccgguuccuggaguucgaagcucucggcuuuaugaaugaggaccacugguucucccgcgaaaacucucugagcgggguggagggagagggccuucauaaacugggguauauccucagagauauuuccaagaucccuggaggcaauauguacgccgacgauaccgcugggugggacacacggaucaccgaagaugaccugcagaacgaggcccgcauuacggauaucauggaacccgagcacgcgcuucuggccagaucuauuuuuaaacucaccuaucaaaauaaggucgugcggguucagcgcccugcuaaaaacggcacagugauggacgucaucagcagacgggaucagagaggauccggccagguggggaccuacggacugaauacauucaccaacauggaagcccaacugauucgccagauggagucugagggcaucuuuagccccuccgaacucgagacgccgaaccuggcugaacgggugcuugacuggcuggagaaguaugggguugaaagacucaagcgcauggccaucagcggagaugacuguguggucaaaccuauugacgaucgguucgcgacagcccugaccgcucuuaaugacaugggcaaggugagaaaagauaucccccagugggagccuucuaagggguggaacgacuggcagcaaguucccuuuugcucccaucacuuccaccagcugauuaugaaagauggccgcgagaucguggucccuugucggaaucaggacgaacucgugggcagagcccgcgucagccagggcgcuggguggucucugcgggagacagccugccugggaaaguccuacgcucaaauguggcagcucauguauuuucauagacgcgaucugcggcuugccgcgaacgccauuuguagcgcugugcccguugacuggaucccgaccuccagaacgaccuggucuauucacgcccaucaccaguggaugacaaccgaagauaugcugagcguguggaaucgggucuggaucgaggaaaacccuuggauggaggacaagacacauaucuccagcuggggcgaugugcccuaccucgggaaaagagaggaccaauggugcggaucucugauuggccuuaccgcccgcgcuacaugggccaccaauauccagguugcgauuaaccaggugcggagacugaucgggaaugaaaacuaccucgacuauaugacguccaugaagcgcuucaaaaaugagagcgaucccgaaggcgcucugugguga

SEQ ID NO: 19151 - RNA, 9879 nt, Artificial Sequence
  derived and/or modified CDS sequence (opt5) from DENV-1__GU131697__SS-prME
uccgugaccaugcugcucaugcugaugcccaccgcccuugcuuuccaccugacgaccagaggaggggaaccucauaugaucgucuccaagcaggaacggggaaagucucuccuguuuaagaccagcgccggcguuaauaugugcacccuuaucgcgauggaccugggggagcucugugaagauacaaugaccuacaagugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccaguaccaaguugggaaugagagcacagaacauggaaccacagcuaccauuacgccccaggccccuaccacagagauccagcucaccgacuauggcgcccugacacuggauuguucuccccggaccggccucgacuucaacgaaauggugcugcuuacgaugaaggagaaauccuggcugguccacaagcagugguuucucgaucugccucuucccuggacaagcggggcuuccaccucucaagagacauggaauaaacaggaccugcucgugaccuucaagaccgcgcaugccaagaaacaggaagucgugguucugggaagccaagagggcgcuaugcacacagcccugacgggggccaccgaaauucagacauccggaaccacaaccaucuuugcuggccaccucaagugccgccugaaaauggauaaacuuacgcugaaagggaugagcuacgugauguguacaggcucuuucaagcucgagaaggaagucgccgagacccagcauggaaccgugcugguucagauuaaauaugagggcacagacgcgccgugcaagaucccuuucuccacccaagaugaaaaaggggugacacagaacggaagacugaucacggcuaaucccauugucaccgacaaggagaaaccugugaacaucgaagccgagccgcccuuuggcgagagcuacauugugaucggggccggagaaaaggcucuuaagcucucuugguucaaaaagggcagcuccauugggaaaauguuugaggccacagcucggggcgccagacgcauggcgauccugggagauaccgccugggacuucggcucuaucgggggaguuuuuacaagcgucggcaagcugauucaccagaucuucgggaccgcuuacggagugcucuuuuccggcgugagcuggacgaugaaaauugggaucggcguccugcuuaccuggcugggacucaauucucgguccacaagccugucuaugaccuguauugccgugggccugguuacacuuuaucucggggugaugguccaggcugauuccggaugcgugaucaacuggaagggcagagaacugaagugugggagcggaauuuucguuaccaaugaggugcauacauggaccgaacaauacaaauuucaggccgacuccccuaagcgccugucugcggccaucggcaaggcuugggaggagggggucugcggcauccggagcgccacgagacucgaaaacauuauguggaagcagaucuccaacgagcugaaucacauucuucuggaaaacgacaugaaacucacagugguugugggagaugucgcuggcauccuggggcagggaaagaaaaugauucgcccgcaacccauggaguauaaguacucuuggaaaagcuggggcaaggccaagaucaucggggccgacgcucagaauaccaccuucauuaucgauggaccuaacacacccgaauguccugacgaucagcgggcguggaauauuugggagguggaggacuauggcuuuggcaucuucaccacgaacauuuggcugaaacuuagagauuccuacacacaggugugcgaccaucgccucaugagcgccgcuaucaaggauucuaaagccguccacgccgacaugggguauuggaucgaauccgagaagaaugaaaccuggaagcuggcucgggccagcuuuauugagguuaaaacauguaucuggcccaagucucacacccugugguccaacggagugcucgaaagcgagaugauuaucccgaaaauuuacggcgggccuaucucucaacauaauuacagacccggauauuucacacagaccgcgggcccuuggcaccuggggaaacuugagcuggauuucgaccucugcgaaggaacgaccguggucguggaugagcauugcggcaaccgcggccccagccugcggacaaccacaguuaccgggaaaaucauucacgaaugguguugcagauccuguacgcugccuccccuucgguuucgcggagaggacggcugcugguacgggauggagaucagaccggugaaggaaaaggaggaaaaucucgucaaaagcauggugucugcuggauccggcgagguugacagcuucucccuggggcugcucuguauuucuaucaugauugaagaggugaugcggagcagauggucccgcaagaugcugaugacaggaacccuugccgucuuuuuccugcucaucaugggccagcugacauggaacgaucugauucggcuuugcaucauggugggcgccaaugcuuuugacagaauggggaugggaaccaccuaucuggcccucauggcgacauucaaaaugcgcccuauguuugcuguuggccuccuguucagacggcugacgucucgcgaggugcuucugcucaccaucgggcugagccuggucgccuccguggaacuucccaacucucuggaggaacucggagauggccuggccauggggauuaugauccucaagcugcuuacagacuuucaaagccaccagcugugggcuacccuccugucccugacauucauuaaaaccacguuuagccuucauuacgccuggaagacaauggcuauggugcugucuaucgucucccucuucccccugugucucagcaccaccucucagaagacaaccuggcugccuguucuucugggaucccugggcugcaaaccgcucacaauguuucugauugccgagaauaagaucuggggcagaaaaagcuggccccuuaacgaagggaucauggcggugggaauugugucuauccugcucuccagccugcucaagaacgaugucccucuggccggcccccuuauugcugggggaaugcugaucgccuguuaugugauuuccggcagcucugcugaccugagccucgagaaagccgccgagguuuccugggaagaggaagcugagcacucuggggcgagccauaauauccugguggaaguccaggaugacggaacgaugaagaucaaagaugaggagcgggacgauacccuuacaauucugcucaaggccacccugcucgcuguguccggcguuuacccucugucuauccccgccacacuuuucgugugguauuucuggcaaaagaaaaagcagcgcagcggcguccugugggacaccccuagcccucccgaaguggagagagccguccuggaugacgggauuuaccggaucaugcagcgcggacuccugggcagaucucagguggggguuggaguguuucaagaaaacgucuuccacacgauguggcaugugacccggggcgcuguucuuauguaccaggggaaacgccuggagcccagcugggccuccgugaagaaagaccucauuagcuauggaggcggcuggagacugcgggggucuuggaauacaggagaggaaguccaggugaucgcgguggagcccggcaagaacccuaagaauguucagaccgcucccgggacauuuaaaaccccggaaggagaggucggcgccauugcccucgauuucaagccugggacauccggaagccccaucgugaacagagaaggcaaaaucgugggccuguacgggaauggagucgugacgaccucuggcacauauguuuccgcuauugcccaagcgaaggcuagccaggaggggccucuucccgagaucgaagacgagguguuucgcaaacggaaccugaccauuauggaucugcaccccggauccggcaagaccagacgcuaccucccugccaucguccgggaagccauuaagagaaaacugcgcacacuuauccuggcuccgacgcgggugguugccucugagauggcugaagcccucaaggggaugcccaucagauaucagaccacagcggugaaaagcgagcacaccggcaaggagauugucgaccugaugugccaugccacauucaccaugcgccugcucuccccugugcggguucccaauuacaacaugaucauuauggaugaagcucacuuuacggacccuagcucuaucgccgcuagaggauauauuuccacacgggugggcaugggggaggccgccgcuaucuucaugaccgcgacacccccuggaagcgucgaagccuuuccgcaaucuaaugcugugauccaggaugaggaacgcgacauucccgagagaagcuggaacuccggccaugaguggaucacagauuucccugggaaaaccgugugguuuguccccucuauuaagagcggaaaugacaucgccaacugucuucggaagaauggcaaacgcguuauucagcuguccagaaagacauucgauaccgaauaccagaaaacgaagaacaacgacugggacuacguggugacaaccgauaucucugagaugggggccaauuuccgggcugacagagucauugauccucgccggugccugaaacccgugauccucaaggacggcccggaaagaguuauccuggccggaccuaugcccgugacagucgcgagcgcugcccaacgccggggcagaauugggcgcaaccacaauaaggagggagaucaguauaucuacaugggccagccccuuaacaaugacgaggaucaugcccacuggaccgaagcuaaaaugcugcucgacaacauuaauacgccugaggggaucauucccgcccuguuugaaccugagcgggaaaaguccgcggccguggauggagaguauagacugcgcggcgaggcuagaaaaaccuucguugaacucaugcggcgcggggaccuuccgguguggcugagcuacaaggucgccucugagggcuuucaguauuccgauagacgguggugcuucgacggagaacgcaacaaucaagugcuggaggaaaacauggaugucgagaucuggacaaaagagggcgaaagaaagaaacuccggcccagauggcuggacgcucgcaccuacagcgacccucuugcccugcgggaguuuaaggaguucgcugccgggagacgcuccgugucuggagaucucauccuggagauuggcaagcugccccagcaccucacacagcgggcgcagaaugcccuugacaaccugguuaugcugcauaauagcgaacaagggggcagagcuuaucggcacgccauggaggagcucccugauaccaucgaaacacugaugcuucuggcucucauugccgugcugaccggcggcgugacgcuguuuuuccucuccgggcgcggacuuggcaaaacaucuaucgggcugcugugugucauggccagcuccguucuccuguggauggcuagcguggagccccauuggauugcggccucuaucauccuugaauuuuuccugauggugcuccugauuccggagccugacagacagcggacaccccaggauaaccagcuggcuuacgucgugaucggacuccuuuuuaugauucugaccguugccgccaaugagaugggccugcucgaaacaaccaagaaagaccuggggaucggacacguggcugucgagaaccaccaucacgccgcgaugcuugauguggaccugcauccugccuccgcuuggacacucuacgccgucgcuacgaccauuaucacacccaugaugcgccacaccauugaaaacacaaccgccaauaucagccugacggcgaucgccaaccaagcugccauucugaugggccucgauaagggcuggccuaucucuaaaauggacauuggggugccccuucuggcucugggaugcuauucccagguuaauccgcucacccugacagccgcugugcuuaugcuggucgcccauuacgcgaucauuggcccugggcuccaggccaaggcuaccagagaggcccaaaagcggacagcugccggaaucaugaaaaaccccaccguggauggcaucguugccauugaccuggaucccguggucuaugacgcgaaguucgaaaaacagcuggggcagaucaugcuccuuauucuguguacgagccagauccugcucaugcgcacaaccugggcucugugcgagucuauuacacuugccaccggaccucugaccacacucugggagggcagcccgggcaaguuuuggaauacgaccaucgcuguguccauggccaacaucuucagagggucuuaccuggccggagcuggccuggccuucagccucaugaaaucccuugggggaggccggcgcgggacaggagcgcaaggcgaaacccugggcgagaaguggaagagacagcugaaucagcucagcaaauccgaauuuaacacauauaagcggucugggauuauggagguggacagaagcgaagccaaagagggacugaagcgcggcgagaccacgaaacacgcuguuucccgggggacagccaaacuuagaugguucgucgaacgcaaucuggugaagcccgagggaaaagugaucgaucucggcugugggcggggaggcuggucuuacuauugcgcuggccugaagaaagucaccgaaguuaagggguacaccaaaggaggcccugggcacgaggaacccauuccuauggccacauacggauggaaccuggugaagcuccauagcggcaaagacguguuuuucauucccccugagaagugugauacccuucugugcgacauuggggaguccucuccgaaucccacaaucgaagagggaagaacgcugcgcguccucaagaugguggaaccuuggcugcggggcaaccaguuuuguauuaaaauccuuaaucccuauaugccuagcguuguggagacccuggagcaaaugcagagaaagcacggcgggaugcucguccgcaacccccugucccggaauagcacacaugaaauguacugggugucuugcggaaccggcaacaucguuuccgcggugaauaugacaagcagaaugcugcucaaccgcuucaccauggcccaccggaaaccgacguaugagagagaugucgaccuggggaccggaacacgccacguggcuguggaaccugaggucgccaaccuugauauuaucggccagagaauugaaaauaucaagcaugagcacaaaucuaccuggcauuacgacgaggauaaccccuauaagacaugggcuuaccacggguccuaugaaguuaagcccagcggaucugccuccagcauggugaauggcguggucaaacugcucaccaagccuugggacgugauucccaugguuacacagaucgcuaugaccgauacgacaccuuuuggccaacagcggguguucaaagagaaggucgacacccgcaccccgaaagccaagagagggacagcgcagaucauggaagugacggcccgguggcuguggggauuucuuuccagaaacaagaaaccccggauuuguacccgcgaggaguucacaagaaagguucggagcaaugcugccaucggcgcuguguuugucgacgagaaccaauggaacucugccaaagaggccguggaagaugagcgcuucugggaccugguucauagagaacgggagcuccacaagcaggggaaaugcgcgaccugcguguacaacaugaugggaaagcgcgaaaagaaacugggcgaguuugggaaggcuaaaggcagcagagccauuugguacauguggcugggagcccgguuccucgaguucgaagcucugggcuuuaugaaugaggaucacugguucucccgcgaaaacucucuuagcggggucgagggagagggccugcauaagcucggguauauccugagagacauuuccaaaaucccuggaggcaauauguacgccgaugacacagcugggugggauacccggaucacagaagacgaucuucagaacgaggccaagauuaccgacaucauggaacccgagcacgcgcugcucgccaaagcuauuuuuaagcugacguaucagaauaaggugguccgcgugcaaagaccugccaaaaacggcaccguuauggaugugaucucucggcgcgaccagagaggaagcggccaggucgggacauacggacugaauaccuucacaaacauggaagcucagcucauucggcaaauggaguccgagggcaucuuuucucccagcgaacuggagaccccgaaccuugccgaaagagcgcuggauuggcucgagaaguaugggguggaacgccugaaacggauggccaucuccggagacgacugugugguuaagccuauugaugacagauucgcuacggcccuuacagcucugaaugauaugggcaaagugcgcaaggacaucccccagugggagccuagcaagggguggaacgauuggcagcagguccccuuuugcucucaucacuuccaccaacucauuaugaaagacggccgggagaucgugguuccuuguagaaaucaggaugaacuggugggacgcgcccgggucucccagggcgcuggguggagccugagagagaccgccugccucggaaagucuuacgcgcagauguggcaacugauguauuuucaucgccgggaccuuagacuggccgcuaacgccauuuguuccgccgugcccgucgauugggugccgacaagccgcaccacgugguccauccacgcucaucaccaguggaugaccacagaagacaugcucucuguuuggaaucggguguggauugaggaaaacccuuggauggaggauaaaacccauaucagcuccugggaggacguccccuaccugggcaagagagaagaccaguggugcgggagccuuaucggacugacagcccgggcgaccugggcuacaaauauucaaguggccaucaaccagguuagacgccucauuggcaaugagaacuaccuggauuauaugaccucuaugaaacgguucaagaaugaauccgaccccgagggggcccugugguga

SEQ ID NO: 19152 - RNA, 9879 nt, Artificial Sequence
  derived and/or modified CDS sequence (opt5) from DENV-1__GU131700__SS-prME
agcgugaccaugcugcugaugcugaugcccaccgcccuugcuuuccaccugacgaccagaggaggggagccucauaugaucgucuccaagcaggaacggggaaagucucuccuguuuaagacaagcgccggcguuaacaugugcacccuuauugcgauggaccugggggaguucugugaagauacaaugaccuacaagugcccgcgcaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagccacacacagguuugcgaccaccggcugaugucugccgcuaucaaggauuccaaagccgugcaugccgacaugggcuauuggauugaaagcgagaagaaugaaaccuggaaacuugcuagagccucuuucaucgaggugaaaacauguaucuggcccaagucccacacccucuggagcaacgggguccuggaaucugagaugauuaucccgaaaauuuacggaggcccuaucagccagcauaauuaucgccccggguacuuuacacaaaccgcgggaccuuggcaccugggcaagcucgagcuggauuucgaccuuugcgaagggacgaccgugguuguggaugagcacugcggaaaccggggccccucccugagaacaaccacagucaccggcaaaauuauccaugaaugguguugccggagcuguacgcucccuccccugcgcuuuaagggggaggacggaugcugguacggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaucuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaccaacugugggcuacccuucugucucucacauuuauuaagaccacguucucccugcauuacgccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuaugugauuucuggaagcuccgcugaccuuucucuggagaaggccgccgaggucagcugggaagaggaagcugagcacuccggcgcgucucauaauauccugguggaaguucaggaugacgggacgaugaaaauuaaggaugaggagcgggacgauacccucacaauccugcuuaaggccacccugcucacagugagcggagucuacccucuguccauccccgcuacccucuucgugugguauuuuuggcagaaaaagaaacaacgcucuggcguccugugggacacgccuuccccucccaagguggaaagagccguucuugaugacggcauuuaccggaucaugcagcgcgggcugcugggaagaucccaggugggcgucgggguguuccaggagaacguuuuucacaccauguggcacgugacacggggagccguccucauguaucaaggcaaacgccuggaacccagcugggcuucugugaagaaggaccuuauuuccuacgggggaggcuggagacugcagggcagcuggaauaccggggaggaggugcagguuaucgccgucgaacccggcaagaauccuaagaaugugcagacagcgcccggcaccuucaaaacaucugagggggaagugggagcuauugcccucgauuuuaagccgggcacguccgggagcccuaucgucaaccgggagggaaaaauugugggccuguacggcaaugggguugugaccacauccggaaccuaugucucugccaucgcucaagccaaggcgagccaggaaggcccccucccugagaucgaggacgaaguguucagaaagcgcaaccugaccauuauggaucuucaucccggguccggaaaaacacggagauaccugcccgcuaucguucgcgaggccauuaagcggaaacugagaacgcucauccuggccccuacccgcguggucgcuagcgaaauggccgaggcucuuaagggcaugccgauucgguaucagacaaccgccgugaaaucugaacacacagggaaggagaucguugaccugaugugccaugcgaccuuuacgaugagacuccugucccccgugcgcgucccuaauuacaacaugaucauuauggaugaggcccacuucacagaccccagcucuaucgcugcccggggcuauauuagcaccagagugggaaugggcgaagcugccgccaucuuuaugaccgcuacaccucccggguccguggaggcguucccucaaucuaaugccgucauucaggaugaagaacgggacaucccggaacgcagcuggaacuccggauacgaguggaucaccgauuuucccggcaagacaguuugguucgugccuucuauuaaaagcgggaaugacaucgcuaacugucugagaaagaauggaaaacgggugauucagcucucccgcaagaccuucgauacggaguaucagaaaacaaagaacaacgacugggacuacgucgugaccacagauaucagcgaaaugggcgccaauuuuagagccgaccggguuauugaucccagacgcugccuuaagccugugauccugaaagacgggcccgagcgggucauucuggcuggcccgaugccugugaccguugccucugcggcucaaagacgcggacggaucggcagaaaccauaauaaggaaggggaucaguacaucuauaugggacagccccucaacaaugacgaggaucacgcccacuggacggaggccaaaaugcugcuugacaacauuaauacccccgaaggcaucauuccugcucuguucgagcccgaacgcgagaaguccgccgcgaucgauggggaauaccggcucagaggagaggcccgcaaaacauuuguggagcugaugagacggggcgaccugccugucuggcucagcuauaagguggcuuccgaaggguuccaguacucugaucgcagauggugcuuugacggcgagcggaacaaucaaguccuugaagagaacauggauguggaaauuuggaccaaagagggagagcgcaagaagcugagaccgcgguggcuggacgccagaacauauagcgacccccucgcucugcgcgaguucaaagaguuugccgcuggccggagauccguuucuggggaucuuauccuggaaaucggaaagcucccucagcaucugacccagcgcgcccagaaugcgcuggacaaccucgugaugcuucacaauagcgagcaaggcgggcgggccuacagacaugcuauggaggaacugcccgauacaauugagaccaugaugcugcucgcccugaucgcugugcuuacgggaggcgucacacuguucuuucucuccggccgggggcugggaaaaaccagcauuggccugcucuguguuauggccucuuccgugcuucuguggauggccagcguggaaccucacuggaucgcugcgucuauuauccuggaguucuuucucaugguccugcuuauccccgaaccggaccgccagagaaccccucaggauaaccagcuggccuaugugguuauugggcuccuguucaugauccugacaguggcugccaaugagaugggacuccuugagaccacaaagaaagaccugggcauugggcacgucgccguggaaaaccaucaccaugcugccaugcuggaugucgaccuccaccccgcguccgccuggacgcuguacgcuguggccaccacaaucauuaccccuaugaugcggcauacaaucgagaacaccacggcuaauauuagccuuaccgccaucgcgaaccaagccgcuauccugaugggacucgauaagggcuggcccauuucuaagauggacaucggcguuccucugcuggcccucgggugcuacagccaggugaauccccuuacacugaccgcugccguccugaugcucguggcucacuaugccauuaucggaccgggccugcaggcgaaagccacacgcgaagcucaaaagagaaccgccgcugggauuaugaaaaacccuacgguugauggaaucguggccaucgaccuugaucccgucguguacgacgccaaguuugagaaacagcugggccagauuaugcuccugauccuguguacaucccagauucuccuuaugcggaccacaugggcgcugugcgaaucuaucacccuggcuaccgggccccucacaacgcugugggagggaagcccuggcaaguucuggaauaccacaauugccguguccauggcuaacaucuuccgcggcagcuaucuugccggggccggacuggcuuuuucccucaugaagucucugggcgggggaagacggggcaccggggcccaaggagagacacugggcgaaaaauggaagcgccagcucaaucagcuuagcaaauccgaguucaacaccuacaagagaucuggcaucauggaaguugaccggagcgaggcgaaagaagggcugaagagaggagagacgacaaagcacgccgucucccgcggcaccgcuaaacugcggugguuuguggagagaaaucucgugaagccggaagggaaagucauugaucugggauguggccgcgggggauggucuuauuacugcgccggccuuaagaaaguuaccgaggugaagggcuauacaaaagggggacccggccaugaggaaccuauccccauggcuaccuacggguggaaccuggugaagcuccacagcggaaaggacgucuucuuuauuccucccgaaaaaugugauacacugcugugcgacaucggcgaguccagcccuaauccgacgauugaggaagggcggacccucagagugcuuaagaugguugagcccuggcugcgcggaaaccaguucuguaucaaaauucugaauccuuacaugcccucuguggucgaaacacucgagcaaaugcagcggaagcauggcggcaugcuggugagaaacccucuuucccgcaauagcacccacgagauguauuggguuucuugcgggacaggaaacaucguguccgccgucaauaugaccagccggaugcugcucaacagauuuacgauggcgcaccgcaaacccaccuacgaacgggauguggaccugggcgccgggacaagacauguggcugucgagccggaaguugccaaccuggauaucauuggacagcgcaucgagaauauuaagcacgaacauaagucuaccuggcacuaugacgaggauaacccuuacaaaacaugggcuuaucauggcuccuacgaggugaagcccagcggguccgccagcucuauggugaauggagucgugaaacuccugaccaagcccugggacguuaucccuauggugacacagauugcuaugaccgauacgacacccuucggccaacagagagucuuuaaagaaaagguggacacccggaccccuaaggccaaacgcggcacagcgcagaucauggagguuacggccaaguggcuuuggggguuccugagcagaaacaaaaagccgcggaucuguaccagagaagaguuuacacggaaagugcgcuccaaugcugccauuggagcugucuucguggacgaaaaccaauggaacucugccaaggaggccguugaggaugaaagauuuugggaccucgugcaccgggagcgcgaacugcacaagcagggcaaaugcgcgaccugcgucuauaacaugauggggaagagagagaagaaacuuggagaguucggcaaagcuaaagggagccgggccaucugguacauguggcugggcgcccgcuuccucgaguuugaggcucugggauucaugaaugaagaucauugguuuuccagagagaacucucugagcggcguggaaggggagggacuccacaaacugggcuacauucuucgggacaucuccaagauucccgggggaaauauguaugccgaugacacagcuggcugggauacccgcaucacagaggacgaucugcagaacgaagccaagaucaccgacauuauggagccugaacaugcgcuccuggccaaaucuaucuucaaacuuacguaccagaauaaagucgugagaguucaacggcccgcuaagaacgggaccgugauggaugucauuagccgcagagaccagcggggcuccggacaggugggcacauaugggcugaauaccuuuacaaacauggaggcccagcucauccgccaaauggaaagcgagggaauuuucucuccuuccgagcuggaaacccccaaccuggcuagacgggugcucgauuggcuggagaaacacggcguugaaagacuuaagcgcauggccaucagcggggacgacuguguggucaagccgaucgaugaccgguuugcgacggcccugacagcucucaaugauaugggaaaagugagaaaggacauuccucagugggagcccucuaaaggcuggaacgauuggcagcagguuccuuucugcucccaccauuuucaccaacugaucaugaaggacgggcgcgaaauugugguccccugucggaaucaggaugagcuugugggcagagcccgcgucagccagggagcuggcuggucccugcgggagaccgccugccucgggaaaucuuacgcucagauguggcaacugauguauuuccauagacgcgaccugcggcucgccgcgaacgccaucuguagcgcugugccuguugauugggugcccacauccagaaccacguggagcauucacgcccaucaccaguggaugaccacagaagacaugcugucugucuggaaucgcguguggaucgaggaaaacccguggauggaggauaagacccacauuuccagcuggggagacguuccuuaccuuggcaagcgggaagaccaguggugcgggucucugaucggacucacagccagagcuaccugggccacaaauauccaaguggcgauuaaccagguccggagacugaucggcaaugagaacuaucuugauuacaugaccagcaugaaacgcuuuaagaaugaguccgaccccgaaggggcucugugguga

SEQ ID NO: 19153 - RNA, 9879 nt, Artificial Sequence
  derived and/or modified CDS sequence (opt5) from DENV-1__GU131701__SS-prME
agcgugaccaugcugcucaugcugaugcccacagcucuugcuuuccaccugacgaccagaggaggggaaccucauaugaucgucuccaagcaagaacggggaaaaucucuccuguuuaagacaagcgccggcguuaauaugugcacccuuauugcgauggaccugggggaacucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaccgcucuuuuucuggcccaugucaucgggaccucuauuacacagaagggaaucaucuucauucuccugaugcuugugacgccuagcauggcgaugagaugcguuggcaucgggucccgggauuuuguggagggacugagcggcgccaccugggucgacguggugcucgagcacgggucuugugucacaaccauggcuaaggauaaacccacacuggacauugaacugcucaagaccgagguuacgaacccugccgugcugcgcaaacuuugcaucgaagcuaagauuuccaauacaaccaccgauagcagauguccgacacaaggagaggccacccugguggaagaacaagacgcgaacuucgucugccggcgcacauuuguggauagaggcuggggcaauggguguggacucuucggcaaagggucucugaucacgugcgccaaguuuaagugcguuaccaaacuugagggaaagauugugcaguacgaaaaccugaaauauuccgucaucgugacaguucacaccggcgaccagcaucaaguggggaaugagagcacagaacacggaaccacggcuaccaucacaccccaggccccuaccacagagauucagcucaccgacuacggcgcucugacgcuggauuguucuccccggacaggccucgacuucaacgaaaugguccugcuuaccaugaaggagaaauccuggcuggugcauaagcagugguuucucgaucugccucuucccuggacaagcggggccuccaccucucaagagaccuggaaucgccaggaccugcucgucacauucaaaacggcccacgcuaagaagcaggaagugguugugcugggaagccaagagggcgcgaugcacaccgcccugacaggggcuaccgaaauccagacauccggaaccacgacaauuuuugccggccaucucaaaugcagacugaagauggauaaacuuacccugaaggggaugagcuaugucauguguaccggcucuuucaaacucgagaaggaaguggccgagacacagcacggaaccguucuggugcagaucaaguacgagggcacagacgcuccgugcaaaauuccuuucuccacgcaagaugaaaagggggucacccagaacggacggcugaucacagccaaucccaccgugacagacaaagagaagccugugaacaucgaagcggagccgcccuuuggcgagagcuauauuaucauuggggcuggagaaaaagcccuuaagcucucuugguucaagaaaggcagcuccaucgggaagauguuugaggccaccgcuagaggcgcccgccggauggcuauucugggagauacggccugggacuucggcucuaucgggggaguuuuuaccagcgucggcaaacuggugcaucagaucuucgggacagcguacggagugcucuuuuccggcgucagcuggaccaugaagauugggaucggcgugcugcuuacauggcugggacucaauucuagauccaccagccugucuaugacauguauugccguuggccuggugacccuuuaccucggggucauggugcaggcugauuccggaugcguuaucaacuggaaaggccgcgaacugaagugugggagcggaauuuucgugacgaaugagguccacacauggaccgaacaauauaaguuucaggccgacuccccuaaacggcugucugcugccaucggcaaggcgugggaggagggggugugcggcauuagaagcgccacccgccucgaaaacaucauguggaaacagaucuccaacgagcugaaucauauucuucuggaaaacgacaugaaguucacaguuguggucggagauguggcuggcauccucgcccaggggaaaaagaugauucggccgcaacccauggaguacaaauauucuuggaaaagcuggggaaaggcuaagaucauuggcgccgacgugcagaauaccacguuuaucaucgaugggccuaacacacccgaauguccugacgaucagagagccuggaauauuugggaggucgaggacuacggauucggcaucuuuaccacaaacauuuggcugaagcugcgcgauuccuauacccagguuugcgaccaccggcuuaugagcgcugcgaucaaagauucuaaggccgugcacgcugacaugggcuacuggauugaauccgagaaaaaugaaacauggaagcucgccagagccagcuucaucgaggugaagaccuguaucuggcccaaaucucauacgcugugguccaacgggguccuggaaagcgagaugauuaucccgaagauuuauggaggcccuaucucucaacacaaucaucgccccggguacuucacccagacagcuggaccuuggcaccucggcaaacuggagcuugauuuugaccugugcgaagggaccacagugguuguggaugagcacugcggaaaccggggccccagccucagaaccacgacagucaccggcaagauuauccaugaaugguguugccgguccuguacacugccuccccugcgcuucagaggggaggacggaugcugguacggcauggagauccggccggugaaagaaaaggaggaaaaucuuguuaagagcauggugucugccggguccggagaggucgacagcuuuucccucggccugcuguguauuucuaucaugauugaagaggugaugagaagccgcuggucccggaaaaugcucaugaccgggacccuggcgguuuucuuucuucugaucaugggacagcucacauggaacgaucugauuagacugugcaucauggugggcgcuaaugccucugaccgcaugggcauggggacgaccuaucuugcccugauggcuacauucaagaugagaccuauguuugccgucggacuccuguuccggcgccucaccagcagagaggugcugcuucugacaauuggccucucccugguggcgucugucgaacugcccaacagccuugaggaacugggggauggacucgcuaugggcaucaugauccugaaacuccugaccgacuuucaaccccaccagcuuugggccacgcugcucucccugacauucauuaagaccaccuuuagccugcauuacgccuggaaaacaauggcuaugguucuuucuaucgugucccuguucccucucugucugagcaccacaucucagaagacgaccuggcucccggugcugcuugggucccugggaugcaagccccugacaauguuucucauugccgagaauaaaaucuggggccggcgcagcuggccucugaacgaaggcauuauggcugucgggaucgugucuauccuucuguccagccuccugaagaacgauguuccccucgccggaccucugauugcgggcgggaugcuuaucgccuguuaugugauuuccggaagcucugcugaccugagccuggagaaagccgcugaggucuccugggaagaggaagccgagcacucuggcgccagccauaauauccucguggaaguucaggaugacgggaccaugaagauuaaagaugaggagagagacgauacacugaccauccuucugaaggcuacgcuccuggcgguguccggagucuacccccucucuaucccugccacccuguucgugugguauuucuggcagaagaagaagcagcggagcggcguccuuugggacacacccuccccgccugaaguggagcgcgcuguucuggaugacggcauuuacagaaucaugcagcgggggcugcucggacgcucucaggugggcgucgggguguuucaagaaaacguuuuccacaccauguggcacgugacaagaggagccguccugauguaucagggcaaacggcuugagcccagcugggccuccgugaagaaagaccugauuagcuacgggggaggcuggagacuccagggcucuuggaauaccggggaggaagugcagguuaucgcugucgagccuggaaagaaccccaaaaaugugcaaacagccccgggcacguuuaagaccccugaaggggaggugggagcgauugcucuggauuucaagcccggcacauccgggagcccuaucgucaaccgcgaaggaaaaauugugggccucuacggcaaugggguugugaccaccucuggaacauaugucuccgccaucgcccaggcuaaggccagccaggagggcccccugcccgagaucgaagacgagguguuucggaaaagaaaccuuacgauuauggaucugcauccuggguccggaaagacccgccgguaccugccggcgaucguuagagaagcuauuaaacgcaagcuccggacacugauccuugcccccaccagaguggucgccucugagauggcugaagcccugaagggcaugccuauucgcuaucaaacaaccgcugugaaaagcgagcacacggggaaggagaucguugaccucaugugccaugccacauucaccaugcggcugcugucccccgugagagucccuaauuacaacaugaucauuauggaugaagcgcacuuuaccgaccccagcucuaucgccgcucggggcuauauuuccacacgcgugggaaugggcgaggccgcugccaucuucaugaccgccacaccuccggggagcguggaggcuuuuccccagucuaaugcggucauucaggaugaggaaagagacaucccugagcggagcuggaacuccggauacgaguggaucaccgauuuccccggcaaaacgguuugguuugugccuucuauuaagagcgggaaugacaucgccaacugucuccgcaaaaauggaaagagagugauucagcuuucccggaagacauucgauaccgaauaucagaaaacaaagaacaacgacugggacuacgucgugaccacggauaucucugagaugggcgcuaauuucagagccgaccgcguuauugauccccggagaugccugaaaccggugauccugaaggacgggccugaacgcgucauucucgccggccccaugcccgugaccguugcuagcgccgcgcagcggagaggacgcaucggccggaaccauaauaaagagggggaucaguacaucuauaugggacagccucugaacaaugacgaggaucacgcucacuggacagaagccaagaugcuucuggacaacauuaauacccccgagggcaucauuccugcccucuuugaaccggagagagaaaaguccgcugccaucgauggggaguaccgccugagaggagaggcgcggaaaacauucguggaacugaugcgcagaggcgaccuccccgucuggcuuagcuauaagguggccucugagggguuucaauacuccgaucggcgcuggugcuucgacggcgaaagaaacaaucagguccuggaggaaaacauggauguggagauuuggaccaaagagggagaacggaagaaacugagaccucgcuggcucgacgcucggacauauagcgacccccuggcccuuagagaguuuaaggaguucgcugccggccgccgguccguuucuggggaucugauccucgagaucggaaaacugccucagcaucugacccagagagcucaaaaugcccucgacaaccuugugaugcugcacaauagcgaacagggcgggcgggcguaccgccaugccauggaggagcugcccgauacgauugaaacacucaugcugcuugcucugaucgccgugcucaccggaggcgucacccuguuuuuccuguccggcagagggcucggaaagacaucuauuggccuucuguguguuauggcuagcuccgugcugcucuggauggccagcguggagccgcacuggaucgccgcuucuauuauccuggaauuuuuccuuaugguccugcucaucccugagcccgaccggcagcgcaccccucaggauaaccaacuggcguaugugguuauugggcugcucuuuaugauccuuacaguggccgcuaaugagaugggacugcuggaaacgaccaagaaagaccucggcauugggcacgucgccguggagaaccaucaccaugccgcuaugcuggaugucgaccuucaccccgccuccgcguggacacuguacgccguggcuaccacaaucauuaccccuaugaugagacauacgaucgaaaacaccacagccaauauuagccucaccgcuaucgccaaccaggcggccauccugaugggacuggauaagggcuggcccauuucuaaaauggacaucggcguuccgcuccuugcucuggggugcuacucccaggugaauccucugacacucaccgccgcuguccugaugcuuguggcccacuaugcuauuaucggacccggccugcaagccaaggcgacgcgggaggcccagaaacgcacagcugccgggauuaugaagaaccccaccguugauggaaucguggcuaucgaccucgauccugucguguacgacgccaaguucgaaaaacagcugggccagauuaugcugcucauccuuuguacaagccaaauucugcugaugagaaccaccugggcccucugcgagucuaucacacuggcgacggggccgcuuaccacacugugggagggaagccccggcaaguuuuggaauaccacaauugcuguguccauggccaacaucuuccggggcucuuaucucgcuggggccggacuggccuucagccugaugaaaucccucggcgggggacgcagaggcaccggggcucagggagaaacgcuuggcgagaaguggaaacggcagcugaaucagcugagcaaguccgaauuuaacacauacaagagaucuggcaucauggagguugaccgcagcgaagccaaagaggggcucaagcggggagagaccaccaaacacgcggucuccagaggcacagccaagcugcgcugguucguggaacggaaucuugugaaaccugaggggaaggucauugaucugggauguggcagagggggauggucuuauuacugcgcuggccucaagaaaguuaccgaagugaagggcuauacaaaagggggacccggccaugaggaaccuauccccauggccacguacggguggaaccuggugaagcugcacagcggaaaagacgccuuuuucauuccuccggagaagugugauacccuccuuugcgacaucggcgaguccucucccaauccuacaauugaagaggggcgcacccugcggguccugaaaaugguggaacccuggcucagaggaaaccaauuuuguaucaagauucugaauccuuacaugcccagcguuguggagacacuugagcagaugcagcgcaagcauggcggcaugcugguccggaacccgcucuccagaaauagcacccacgaaauguauugggugucuugcgggacgggaaacaucguuuccgccaucaauaugaccagccgcaugcugcugaaccgguucacaauggcgcacagaaaaccuaccuacgagcgcgauguggaccucggcgccgggacaagacaugucgcuguggaacccgagguggccaaccuggauauuaucggacagcggauugaaaauaucaagcacgagcauaaaucuaccuggcacuaugacgaggauaaccccuacaagacaugggcuuaucauggcuccuacgaagucaaaccuagcgggucugccuccagcaugguuaauggaguggugaaacuucugaccaagcccugggacgucauuccuauggugacgcaaaucgcuaugacagauaccaccccguuuggccagcagcgcguuuucaaagagaagguggacacaagaacgcccaaagccaagcggggcaccgcgcaaaucauggaagucacagccaaauggcucuggggguuucuguccagaaacaagaagccucggauuuguacccgcgaggaguucacaagaaaagugcggagcaaugcugccaucggagcuguuuuuguggacgagaaccaguggaacucugccaaggaggccgucgaagaugagcgcuucugggaccuugugcacagagaacgggagcugcacaaacagggcaagugcgcgaccugcguuuauaacaugauggggaaacgcgaaaagaagcucggagaguuuggcaaagcuaaggggagcagagccauuugguacauguggcugggcgcccgguuccuggaguucgaagcucucggauuuaugaaugaggaucauugguucucccgcgaaaacucucugagcggcguggagggggagggacuucacagacugggcuacauccuccgggacauuuccaaaauccccgggggaaauauguaugccgaugacacagcuggcugggauacccgcaucacggaagacgaucugcagaacgaggccagaauuaccgacaucauggaaccugagcaugcgcuucuggccaagucuauuuuuaaacucacauaccaaaauaaggucgugcggguccagcgccccgggaaaaacggcaccgugauggauguuaucagcagacgggaccagagaggauccggccagguggggacauauggacugaauaccuucacgaacauggaagcucaacugauucgccagauggagucugagggcaucuuuagcccguccgaacucgagacaccuaaccuggccgaacggguccuugauuggcuggagaaguacgggguggaaagacucaagcgcauggcuaucagcggagacgacugugugguuaaacccauugaugaccgguucgccaccgcgcugacagcccuuaaugauaugggcaaggugagaaaagacaucccucagugggagcccucuaagggguggaacgauuggcagcaagucccuuuuugcucccaccacuuccaucagcugauuaugaaagacggccgcgagaucgugguucccugucggaaucaggaugaacucgugggcagagcucgcgucagccagggcgccggguggucucugcgggagaccgcuugccugggaaaguccuaugcccaaauguggcagcucauguacuuucacagacgcgaccugcggcuugcugccaacgcgauuuguagcgccgugccggucgauuggaucccuacguccagaaccacauggucuauucaugcucaccaucaguggaugaccacagaagacaugcugagcguguggaaucggguuuggaucgaggaaaaccccuggauggaggauaagacccacaucuccagcuggggcgacgugcccuaucucgggaaaagagaggaccaauggugcggaucucugauuggccuuacagcccgcgccaccugggcuacgaauauccaggucgccauuaaccaggugcggagacugaucgggaaugaaaacuaccucgauuacaugacauccaugaagcgcuucaaaaaugagagcgacccugaaggcgcgcugugguga

SEQ ID NO: 19154 - RNA, 9879 nt, Artificial Sequence
  derived and/or modified CDS sequence (opt5) from DENV-1__GU131703__SS-prME
agcgugaccaugcugcucaugcugaugcccacagcccuugcuuuccaccugacgaccagaggcggggaaccucauaugaucguguccaagcaggaacggggaaaaucucuccuguuuaagaccagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuauucugcgcaaacuuugcaucgaagccaagauuuccaauacgacaaccgauagcagauguccgacccaaggagaggcgacacugguugaagaacaagacgccaacuucgugugccggcgcaccuuuguggauagaggcuggggcaauggguguggacucuucggcaaagggucucugaucacaugcgcuaaguuuaagugcgucacgaaacuugagggaaagaucgugcaguacgaaaaccugaaauauuccguuauugugaccguccacacaggcgaccagcaucaaguggggaaugagagcaccgaacacggaacaaccgccacgaucacaccccaagcuccuaccaccgagauucagcucacagacuacggcgcccugacccuggauuguucuccccggacgggccucgacuucaacgaaaugguucugcuuacaaugaaggagaaauccuggcuggugcauaagcagugguuucucgaucugccucuucccuggaccagcggggccuccacaucucaagagaccuggaaucgccaggaccugcucgucaccuucaaaacagcucacgcgaagaagcaggaaguggucgugcugggaagccaagagggcgccaugcacacggcucugaccggggccacagaaauccagaccuccggaacaaccacgauuuuugccggccaucucaaaugcagacugaagauggauaaacuuacacugaaggggaugagcuauguuauguguaccggcucuuucaaacucgagaaggaaguggcugagacccagcacggaacaguccuggugcagaucaaguacgagggcaccgacgccccgugcaaaaucccuuucuccacacaagaugaaaaggggguuacgcagaacggacggcugauuaccgcgaaucccaucgugacagacaaagagaagccugucaacauugaagcugagccgcccuuuggcgagagcuauaucgugauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauuccuauacccaggucugcgaccaccggcuuaugagcgcggccaucaaagauucuaaggcuguucacgccgacaugggcuacuggaucgaauccgagaaaaaugaaacauggaagcucgccagagcuagcuucauugaggugaagaccuguaucuggcccaaaucucauacacugugguccaacggggugcuggaaagcgagaugauuaucccgaagauuuauggaggcccuaucucucaacacaauuaccgccccggguacuucacccagacggccggaccuuggcaucucggcaaacuggagcuugauuuugaccugugcgaagggaccacagucgugguugaugagcacugcggaaaccggggccccagccucagaaccacaaccgugacgggcaagaucauucacgaaugguguugccgguccuguacacugccuccccugcgcuucagaggggaggacggaugcugguauggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugaccgggacacuggcuguguuccuucugcucaucaugggacagcugaccuggaacgaucugauuagacuuugcaucaugguuggcgccaaugccucugaccgcaugggcauggggaccacauaccuggcucucauggccacguuuaagaugagaccuauguucgcggugggacugcucuuucggcgccugaccagcagagagguccuucugcucacaaucggccugucccugguggcuucuguggaacuucccaacagccuggaggaacucggggauggacuggccaugggcauuaugauccucaaacugcuuaccgacuuccaaucccaucagcugugggccacacuccugagccugaccuuuauuaagacgacauucucucuucacuaugcuuggaaaaccauggccaugguccuguccaucguuagccucuuuccccugugucucucuaccacaucccagaagaccacauggcugccugugcuucuggggagccugggaugcaagccgcucacgauguuccugauugcugagaauaaaaucuggggccggcgcucuuggccccuuaacgaaggcaucauggccguggggauugucuccauccugcucagcucccugcucaagaacgaugugccucuggcgggaccccuuauugccggcgggaugcugaucgcuuguuacguuauuagcggaucuagcgccgaccugucccucgagaaagcugccgaggugucuugggaagaggaagccgagcauagcggcgcuucccacaauauccuggucgaagugcaggaugacgggaccaugaagaucaaagaugaggagagagacgauacacuuaccauucugcucaaggcgacacugcucgccguuucuggaguguauccucugagcauccccgcuacccuuuuugucugguacuucuggcagaagaagaagcagcgguccggcgugcugugggacacgccuucucccccggaagucgagcgcgccgugcuggaugacggcauuuauagaaucaugcagcgggggcuccugggacgcagccagguuggcgugggggucuuccaagaaaacguguuucauaccauguggcacguuacaagaggagccgugcuuauguaccagggcaaacggcuggagccuuccugggcuagcgucaagaaagaccucauuucuuacgggggaggcuggagacugcagggcuccuggaauaccggggaggaaguccaggugaucgccguugagcccggaaagaacccuaaaaauguccaaacaacccccggcacauucaagacgccggaaggggaggugggagcgauugcucucgauuuuaagccuggcaccagcgggucucccaucgugaaccgcgaaggaaaaaucgucggccuguauggcaauggggugguuacaaccuccggaaccuacgugagcgccauugcccaggcuaaggccucccaggagggcccucuucccgagaucgaagacgaggucuuccggaaaagaaaccugacaauuauggaucugcaccccgggucuggaaagacgcgccgguaucucccugcgaucgugagagaagcuauuaaacgcaagcugcggacccuuauccuggccccgacaagaguuguggccagcgagauggcugaagcccucaagggcaugcccauccgcuaccaaaccacagcugucaaauccgagcauaccgggaaggagauuguggaccugaugugccacgccacguuuacaaugcggcugcucagcccuguuagagugcccaauuauaacaugaucauuauggaugaagcgcauuucaccgacccuucuuccaucgccgcucggggcuacauuagcacccgcgucggaaugggcgaggccgcugccaucuuuaugacagccacacccccugggucuguggaggcuuucccgcagagcaaugcggugauccaggaugaggaaagagacauucccgagcgguccuggaacucuggauaugaguggaucacagauuuuccuggcaaaaccgucugguucguucccagcauuaaguccgggaaugacaucgccaacugucuucgcaaaaauggaaagagagugauucagcugucucggaagacguuugauacagaauaccagaaaaccaagaacaacgacugggacuacguggucacaaccgauaucagcgagaugggcgcuaauuucagagccgaccgcgugauugauccucggagaugccugaaacccguuauccucaaggacgggccggaacgcgugauccuggccggcccuaugcccgucacgguggcuuccgccgcgcagcggagaggacgcauuggccggaaccacaauaaagagggggaucaguauaucuacaugggacagccccuuaacaaugacgaggaucaugcucacuggaccgaagccaagaugcugcucgacaacauuaauacaccugagggcaucauucccgcccuguucgaaccugagagagaaaagagcgcugccaucgauggggaguaucgccugagaggagaggcgcggaaaaccuuuguugaacucaugcgcagaggcgaccuuccgguguggcugucuuacaaggucgccuccgagggguuccaauauagcgaucggcgcuggugcuuugacggcgaaagaaacaaucaggugcuggaggaaaacauggaugucgagaucuggacaaaagagggagaacggaagaaacucagaccccgcuggcuggacgcucggaccuacuccgacccucuugcccugagagaguucaaggaauuugcugccggccgccggucugugagcggggaucucauucuggagaucggaaaacugccccagcaccucacacagagagcucaaaaugcccuugacaaccugguuaugcugcauaauuccgaacagggcgggcgggcguaucgccacgccauggaggagcucccugauaccauugaaacgcugaugcuucuggcucucaucgccgugcugacaggaggcgugacccuguucuuucucucuggcagagggcuuggaaagaccagcauuggccugcugugugucauggcuuccagcguucuccuguggauggccucuguggagccccauuggaucgccgcuuccaucauucuugaguucuuucugauggugcuccugaucccggagccugaccggcagcgcacaccccaggauaaccaacuggcguacgucgugauugggcuccuuuucaugauccugaccguugccgcuaaugagaugggacugcucgaaacaacgaagaaagaccugggcauugggcacguggccgucggaaaccaccaucacgccgcuaugcuugauguggaccugcauccugccagcgcguggacccucuacgccgucgcuacaaccaucauuacacccaugaugagacacaccaucgagaacacgaccgccaauaucucucugacagcuauugccaaccaggcggccauccugaugggccucgauaagggcuggccuauuuccaaaauggacaucggggugccccuucuggcucugggaugcuauagccagguuaauccgcucacccugacagccgcugugcuuaugcuggucgcccauuacgcuauuaucggcccugggcuccaagccaaggcgacccgggaagcccagaaacgcacggcugccggaaucaugaagaaccccacaguggauggcauuguugcuaucgaccuggaucccguggucuaugacgccaaguuugagaaacagcuggggcagauuaugcuccuuauccuguguaccucucaaauucugcucaugagaacaaccugggcccugugcgaaagcaucacccuugcgacaggaccucugacgacccucugggagggcuccccgggcaaguucuggaauacaaccaucgcugugucuauggccaacauuuuucgggggagcuaccuggcuggagccggccuggccuucucccucaugaaaagccuugggggaggccgcagagggacaggagcucagggcgagacccugggcgaaaaguggaaacggcagcugaaucagcucuccaagucugaguucaacacguauaagagaagcgggaucauggaaguggaccgcuccgaggccaaagaaggacugaagcggggcgagacaaccaaacacgcgguuucuagagggaccgccaaacuucgcugguuugucgagcggaaucuggugaaacccgaaggaaaggugauugaucucggcugugggagaggaggcuggagcuacuauugcgcuggccugaagaaagucacagagguuaagggguacaccaaaggaggcccugggcacgaagaacccaucccuauggccacauacggauggaaccuggugaagcuccauuccggcaaagacguguucuuuauucccccugaaaagugugauacgcuucugugcgacaucggggagucuagcccgaaucccaccauugaggaaggacgcacacugcggguccucaaaaugguggagccuuggcugagaggcaaccaauucuguaucaagauccuuaaucccuauaugccuuccguuguggaaacccuggagcagaugcagcgcaagcacggcgggaugcucguccggaacccccugagcagaaauucuacacaugagauguacuggguguccugcggaaccggcaacauuguuagcgcugugaauaugacgucucgcaugcugcucaaccgguuuaccauggcccacagaaaaccgacauaugaacgcgaugucgaccugggggcgggaaccagacacguggccguggagccugaagucgcuaaccuugauaucauuggccagcggaucgagaauauuaagcaugaacacaaauccacauggcauuacgacgaggauaaccccuauaagaccugggccuaccacgggagcuaugagguuaaacccucuggauccgcuagcuccauggugaauggcguggucaagcugcucacaaagccuugggacgugauccccaugguuacccaaaucgccaugacggauacaaccccuuucggccagcagcgcguguuuaaagaaaaggucgacaccagaacaccgaaagcuaagcgggggacggcccaaauuauggaggugaccgcgaaauggcuguggggauuccuuagcagaaacaagaagccccggaucuguacacgcgaagaguuuaccagaaaaguucggucuaaugccgcuauuggcgccguguucgucgacgaaaaccaguggaauagcgcuaaggaggccguggaggaugaacgcuuuugggaccugguucauagagagcgggaacuccacaaacaggggaagugcgccacaugcguguacaacaugaugggaaaacgcgagaagaagcugggcgaguucgggaaagcgaagggcuccagagcuaucugguacauguggcugggagcccgguuucucgaguucgaggcccugggcuucaugaaugaagaucacugguuuucucgcgagaacagccuuuccggggucgaaggagagggccugcauaaacucggguauauucugagagacaucucuaagaucccuggaggcaauauguacgcugaugacaccgccgggugggauacacggauuaccgaggacgaucuucagaacgaagcucgcaucacggacauuauggagcccgaacacgcccugcucgcgaaaagcaucuucaagcugaccuaucaaaauaaaguggucagagugcagcggccugccaagaacggcacaguuauggaugugauuucccgcagagaccagcggggaucuggccaggucgggaccuacggacugaauacauuuaccaacauggaggcucaacucaucagacagauggaaagcgagggcaucuucucccccagcgagcuggaaacgccgaaccuugccgagcgcgugcuggauuggcucgaaaaguaugggguggagcggcugaaaagaauggcuauuucuggagacgacuguguugugaagccuaucgaugaccgcuuugccacagcgcuuaccgcccugaaugauaugggcaaaguccggaaggacauuccccagugggaaccuuccaaaggguggaacgauuggcagcaagugcccuucugcagccaucacuuucaccagcucaucaugaaggacggcagagagauuguugugccuugucgcaaucaggaugagcuggucggacgggcuagagugucucagggcgccggguggucccugcgcgaaacagcuugccucggaaagagcuacgcccaaauguggcagcugauguauuuccaucggagagaccuucgccuggcugccaacgcgaucuguuccgccguccccguggauuggauuccgaccucucggacgaccuggagcauccacgcucaucaccaguggaugacaaccgaggacaugcucuccguuuggaauagaguguggaucgaagagaacccuuggauggaagauaaaacacauauuagcucuuggggcgacguccccuaccuggggaagcgggaggaccaauggugcggaucccuuaucggccugaccgccagagccacaugggcuaccaauauucagguggccaucaaccagguucgccggcucauugggaaugagaacuaccuggauuauaugacgagcaugaaaagauuuaagaaugaaucugaccccgagggcgcgcugugguga

SEQ ID NO: 19155 - RNA, 9879 nt, Artificial Sequence
  derived and/or modified CDS sequence (opt5) from DENV-1__GU131706__SS-prME
agcgugaccaugcugcucaugcugaugcccaccgcccuugcuuuccaccugacgaccagaggaggggaaccucauaugaucgucuccaagcaggaacggggaaaaucucuccuguuuaagaccagcgccggcguuaacaugugcacccuuaucgcgauggaccugggggagcucugugaagauaccaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucagaaagggcagcuccauugggaaaauguuugaggcuaccgcccgcggcgcucggagaauggccauccugggagauacagcgugggacuucggcucuaucgggggaguuuuuaccagcgucggcaagcuggugcaucagauuuucgggacggccuacggagugcucuuuuccggcgucagcuggaccaugaaaaucgggauuggcgugcugcuuacauggcugggacucaauucucgcuccaccagccugucuaugacauguaucgcuguuggccuggugacccuuuaccucggggucauggugcaggccgauuccggaugcguuauuaacuggaagggccgggaacugaaaugugggagcggaaucuucgugacaaaugagguccacaccuggacggaacaauauaaguuucaggcugacuccccuaagagacugucugccgcgauuggcaaagccugggaggagggggugugcggcauccgcagcgcuacacggcucgaaaacaucauguggaagcagauuuccaacgagcugaaucauauccuucuggaaaacgacaugaaauucaccguuguggucggagauguggccggcauucucgcucaggggaagaaaaugaucagaccgcaacccauggaguacaaguauucuuggaaaagcuggggaaaggccaagauuaucggcgccgacgugcagaauaccacauuuaucauugaugggccuaacacccccgaauguccugacgaucagcgcgcuuggaauaucugggaggucgaggacuacggauucggcauuuuuacgacaaacaucuggcugaaacugcgggauuccuauacccagguuugcgaccacagacuuaugagcgcggccauuaaggauucuaaagcugugcacgccgacaugggcuacuggaucgaauccgagaagaaugaaacauggaaacucgcccgcgcuagcuucaucgaggugaagaccuguauuuggcccaagucucauacacugugguccaacgggguccuggaaagcgagaugaucauuccgaaaaucuauggaggcccuauuucucaacacaauuaccggcccggguacuucacccagacggccggaccuuggcaucucggcaagcuggagcuugauuuugaccugugcgaagggaccacagugguuguggaugagcacugcggaaacagaggccccagccuccggaccacaaccgucacgggcaaaaucauccacgaaugguguugccgcuccuguacacugccuccccugagauucagaggggaagacggaugcugguauggcauggagauucggccggugaaggaaaaagaggaaaaucuuguuaagagcauggugucugcgggguccggagaggucgacagcuuuucccucggccugcuguguaucucuauuaugaucgaagaggugaugcgcagccggugguccagaaagaugcucaugaccgggacacuggcuguuuucuuucuucugauuaugggacagcucaccuggaacgaucugauccgccugugcauuauggugggcgccaaugccucugacagaaugggcauggggaugaccuaccuugcucugauggccacauucaaaaugcggccuauguuugcggucggacuccuguuccgcagacucacgagccgggaggugcugcuucugaccaucggccucucccugguggcuucugucgaacugcccaacagccuugaggaacugggggauggacucgccaugggcaucaugauucugaagcuccugacagacuuucaaucccaucagcuuugggccacccugcucagccugacauucaucaaaaccacguuuucucugcacuaugcuuggaagacaauggccaugguucuuuccauugugagccuguucccccucugucugucuaccaccucccagaaaacaaccuggcucccugugcugcuugggagccugggaugcaagccgcugacaauguuucucaucgcugagaauaagauuuggggccgcagaucuuggccccugaacgaaggcaucauggccgucgggaucguguccauucuucugagcucccuccugaaaaacgauguuccucucgcgggaccccugaucgccggcgggaugcuuauugcuuguuacgugaucagcggaucuagcgccgaccugucccuggagaaggcugccgaggucucuugggaagaggaagccgagcauagcggcgcuucccacaauauucucguggaaguucaggaugacgggacgaugaaaaucaaggaugaggagcgggacgauacccugacaauccuucugaaagcgacccuccuggccgugucuggagucuauccucucagcauucccgcuacacuguucgugugguacuucuggcaaaagaaaaagcagcgcuccggcguccuuugggacaccccuucucccccggaaguggagagagccguucuggaugacggcaucuaucggauuaugcagcgcgggcugcucggaagaagccaggugggcgucgggguguuucaagaaaacguuuuccauacgauguggcacgugacccggggagccguccugauguaccagggcaagagacuugagccuuccugggcuagcgugaaaaaggaccugaucucuuacgggggaggcuggcgccuccagggcuccuggaauacaggggaggaagugcagguuauugccgucgagcccggcaagaacccuaagaaugugcaaaccgcgcccggcacauuuaaaaccccggaaggggaggugggagcuaucgcccuggauuucaagccuggcacaagcgggucucccauugucaaccgggaaggaaagaucgugggccucuauggcaaugggguugugacgaccuccggaacauacgucagcgccaucgcucaggccaaagcgucccaggagggcccucugcccgagauugaagacgagguguuuagaaagcgcaaccuuaccaucauggaucugcaccccgggucuggaaaaacccggagauaucugccugcuauuguucgcgaagccaucaagcggaaacucagaacacugauucuugccccgacgcgcguggucgcuagcgagauggccgaagcucugaagggcaugcccauccgguaccaaaccacagccgugaaguccgagcauaccgggaaagagaucguugaccucaugugccacgcgacauucaccaugagacugcugagcccugugcggguccccaauuauaacaugauuaucauggaugaagcccauuuuacggacccuucuuccauugcugcccgcggcuacaucagcacaagagugggaaugggcgaggcugccgccauuuucaugaccgcuacacccccugggucuguggaagcguuuccgcagagcaaugccgucauccaggaugaggaacgggacauccccgagcgcuccuggaacucuggauaugaguggauuacagauuucccuggcaagaccguuugguuugugcccagcaucaaauccgggaaugacauugcuaacugucucagaaagaauggaaaacgggugauccagcuuucuagaaagacauucgauaccgaauaccaaaagacgaaaaacaacgacugggacuacgucgugacaaccgauauuagcgagaugggcgccaauuuccgcgccgaccggguuaucgauccuagacgcugccugaagcccgugauucugaaagacgggccggaacgggucauccucgcuggcccuaugcccgugacaguugccuccgcggcucagagacgcggacggaucggcagaaaccacaauaaggagggggaucaguauauuuacaugggacagccccugaacaaugacgaggaucaugcccacuggaccgaagccaaaaugcuucuggacaacaucaauacgccugagggcauuauccccgcucucuuugaaccugagcgcgaaaagagcgccgcgauugauggggaguauagacugcggggagaggcccgcaagaccuucguggaacugaugagacggggcgaccucccggucuggcuuucuuacaaaguggcuuccgagggguuucaauauagcgaucgcagauggugcuucgacggcgaacggaacaaucagguccuggaggaaaacauggauguggagaucuggacaaaggagggagaacgcaagaagcugcgcccccgguggcucgacgccagaaccuacuccgacccucuggcucuuagagaguuuaaagaguucgccgcuggccggagaucuguuagcggggaucugauccucgagauuggaaagcugccccagcaccugacacagcgggcccaaaaugcgcucgacaaccuugugaugcugcauaauuccgaacagggcgggcgcgccuauagacacgcuauggaggagcugccugauaccaucgaaacacucaugcugcuugcccugauugcugugcucaccggaggcgucacgcuguuuuuccugucuggccgggggcucggaaaaacaagcaucggccuucuguguguuauggccuccagcgugcugcucuggauggccucuguggagccccauuggauugcugcguccaucauccuggaauuuuuccuuaugguccugcucauuccggagccugaccgccagagaacaccccaggauaaccaacuggccuacgugguuaucgggcugcucuuuaugauucuuaccguggcugccaaugagaugggacugcuggaaacaaccaagaaggaccucggcaucgggcacgucgccguggagaaccaccaucacgcugccaugcuggaugucgaccuucauccugcgagcgccuggacacuguacgcuguggccacgaccauuaucacacccaugaugcggcacaccauugaaaacacaaccgcuaauaucucucucacggccaucgcgaaccaggccgcuauucugaugggacuggauaaaggcuggccuaucuccaagauggacauuggcguuccccuccuugcccuggggugcuauagccaggugaauccgcugacccucacagcugccguccugaugcuuguggcucauuacgccaucauuggaccuggccugcaagcgaaagccacccgcgaggcucagaagagaacagccgcugggaucaugaaaaaccccaccguugauggaaucguggccauugaccucgaucccgucguguaugacgccaaguucgaaaagcagcugggccagaucaugcugcucauucuuuguacgucucaaauccugcugaugcggacaaccugggcgcucugcgagagcauuacacuggcuaccgggccucuuaccacacugugggagggauccccgggcaaauuuuggaauacgaccaucgccgugucuauggcuaacaucuuccgcggcagcuaccucgccggggccggacuggcuuucucccugaugaaaagccucggcgggggaagacggggcacaggggcccagggagaaacccuuggcgagaaauggaagagacagcugaaucagcuguccaaaucugaauuuaacacauauaagcgcagcggcauuauggagguugaccgguccgaagcgaaggaggggcucaaaagaggagagaccacgaagcacgccgucucucgcggcacagcuaaacugcggugguucguggaaagaaaucuugugaagcccgaggggaaagucaucgaucugggauguggccgcgggggauggagcuacuauugcgccggccucaagaagguuaccgaagugaaaggcuacaccaaaggcgggccugggcacgaggaacccauuccuauggcuacauacggguggaaccuggugaaacugcauuccggaaaggacgucuuuuucauucccccugagaaaugugauacccuccuuugcgacauuggcgagucuagcccgaaucccacaaucgaagaggggcggacgcugagagugcugaagaugguugaaccuuggcuccgcggaaaccaauuuuguauuaaaauccugaaucccuauaugccuuccguggucgagacccuugagcagaugcagcggaagcacggcggcaugcuggugagaaacccccucagccgcaauucuacacaugaaauguacuggguuuccugcgggaccggaaacaucgugagcgccgucaauaugacaucucggaugcugcugaacagauucaccauggcgcaccgcaagccgacguaugagagagauguggaccucggcgccgggacccggcacguggcugucgaaccugagguugccaaccuggauauuaucggacagcgcauugaaaauaucaaacaugagcacaaguccacauggcauuacgacgaggauaaccccuauaaaaccugggcuuaccacggcagcuaugaagugaagcccucuggguccgccagcuccauggugaauggagucgugaaacuucugacaaagccuugggacguuauucccauggugacccaaaucgcuaugacagauaccacgccuuuuggccagcagagagucuucaaggagaaaguggacacacggaccccgaaggccaaaagaggcaccgcgcaaaucauggaaguuacagccaaguggcucuggggguuucugagccggaacaaaaagccccgcauuuguacgagagaggaguucacccggaaggugcgcucuaaugcugccaucggagcugucuuuguggacgagaaccaguggaauagcgccaaagaggccguugaagaugagagauucugggaccuugugcaucgggaacgcgagcugcacaagcagggcaaaugcgcgacaugcgucuacaacaugauggggaagagagagaaaaagcucggagaguuuggcaaggcuaaagggucccgggccauuugguacauguggcugggcgcccgcuuccuggaguucgaagcucucggauuuaugaaugaggaucacugguucucuagagaaaacagccuguccggcguggagggggagggacuucauaagcugggcuauauccuccgggacauuucuaaaaucccugggggaaauauguacgccgaugacaccgcuggcugggauacacgcaucaccgaagacgaucugcagaacgaggccagaauuacagacaucauggaacccgagcacgcgcuucuggccaagagcauuuuuaaacucaccuaucaaaauaaggucgugcggguucagcgcccugcuaaaaacgggacggugauggaugucaucuccagacgggaccagagaggcucuggacaggugggcaccuacgggcugaauacauucaccaacauggaagcccaacugauucgccagauggagagcgagggaaucuuuucccccagcgaacucgagacaccgaaccuggcugaacgggugcuugauuggcuggagaaguauggcguugaaagacucaagcgcauggccaucucuggggacgacuguguggucaaaccuauugaugaccgguucgcgaccgcccugacggcucuuaaugauaugggaaaggugagaaaagacaucccccagugggagccuuccaagggcuggaacgauuggcagcaaguucccuuuugcagccaucacuuccaccagcugauuaugaaagacgggcgcgagaucguggucccuugucggaaucaggaugaacucgugggcagagcccgcgucucucagggagcuggcuggucccugcgggagacagccugccugggaaagagcuacgcucaaauguggcagcucauguauuuucauagacgcgaccugcggcuugccgcgaacgccauuuguuccgcugugcccguugauuggaucccgaccucuagaacaaccuggagcauucacgcccaucaccaguggaugacgaccgaagacaugcuguccguguggaaucgggucuggaucgaggaaaacccuuggauggaggauaagacacauaucagcucuuggggagacgugcccuaccucggcaaaagagaggaccaauggugcgggucccugauuggacuuaccgcccgcgcuacaugggccaccaauauccagguugcgauuaaccaggugcggagacugaucggcaaugaaaacuaccucgauuauaugacaagcaugaagcgcuucaaaaaugagucugaccccgaaggggcucugugguga

SEQ ID NO: 19156 - RNA, 9879 nt, Artificial Sequence
  derived and/or modified CDS sequence (opt5) from DENV-1__GU131708__SS-prME
agcgugaccaugcugcucaugcugaugcccacagcccuugcuuuccaccugacgaccagaggaggggagccucauauggucguuuccaagcaggaacggggaaagucucuccuguuuaagaccagcgccggcgugaauaugugcacccuuaucgcgauggaccugggggagcucugugaagauacaaugaccuacaaaugcccgcgcauuacagaggcugaacccgacgauguggacuguuggugcaaugccaccgauacgugggucaccuauggaacauguucccaaaccggcgagcacagacgggacaagcgcucuguggcccuggcuccucauguugggcugggacucgagacaagaaccgaaacguggaugagcuccgagggcgccuggaaacagauccagcggguggaaacaugggcucugcgccaccccggcuucaccgucauugcccuuuuucuggcgcaugccaucgggacaucuauuacccagaagggaaucaucuucauucuccugaugcuugugaccccuagcauggcuaugagaugcguuggcaucgggucccgggauuuuguggagggacugagcggcgccacaugggucgacguggugcucgagcacgggucuugugucacgaccauggcuaaggauaaacccacacuggacauugaacugcucaagaccgagguuacaaacccugccauccugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaucuuccuucaaacucgagaaggaagucgccgagacccagcacggcaccgugcugguucagauuaaguacgagggaacagacgcgccgugcaaaaucccuuucagcacccaagaugaaaagggcgugacacagaacgggcggcugaucacggcuaaucccauugucaccgacaaagagaagccugugaacaucgaagccgagccgcccuuuggagagucuuauauugugaucggcgccggggaaaaagcucuuaagcucagcugguucaagaaaggauccucuauuggcaagauguuugaggccacagcuagaggggcccgccggauggcgauccugggcgauaccgccugggacuucggaagcaucggcgggguuuuuacauccgucggaaaacuggugcaucagauuuucggcaccgcuuacggggugcucuuuagcggagucucuuggacgaugaagaucggccugggggugcuucugaccuggcucggccucaauuccagaagcacaucucuguccaugaccuguauugccguuggacuugugacacucuaccugggcgucauggugcaggcugauagcgggugcguuaucaacuggaaaggacgcgaacugaaguguggcuccgggauuuucgugaccaaugagguccacacauggaccgaacaauauaaguuucaggccgacucuccuaaacggcucagcgcggccaucggaaaggcuugggaggagggcgugugcgggauuagauccgccacgcgccuggaaaacguuauguggaaacagaucucuaacgagcuuaaucauauccugcucgaaaacgacaugaaguucacaguggucgugggcgauguggcuggcauucuggcccagggcaaaaagaugauccggccgcaacccauggaguacaaauauagcuggaaguccugggggaaggccaaaauuaugggagcugacguccagaauaccaccuuuaucauugauggcccuaacacacccgaauguccugacgaucagagagcguggaauaucugggagguugaggacuacggguucggaaucuuuaccacgaacauuuggcugaaacuucgcgauagcuauacacaggugugcgaccaccggcucaugucugccgcuaucaaagauuccaaggccgugcacgccgacaugggcuacuggauugaaagcgagaaaaaugaaaccuggaagcuggcuagagccucuuucaucgaggucaagacauguauuuggcccaaaucccauacccuguggagcaacggcgugcucgaaucugagaugaucaucccgaagauuuaugggggaccuaucagccaacacaauuaccgccccggcuacuucacacagaccgcggggccuuggcaucugggaaaacuugagcuggauuuugaccucugcgaaggcacgaccguuguggucgaugagcacugcgggaaccggggacccucccugagaacaaccacagugaccggcaagauuauccacgaaugguguugccggagcuguacgcugccuccccuucgcuucagaggcgaggacgggugcugguauggaauggagauucggccgguuaaagaaaaggaggaaaaucucgugaagucuauggucuccgcuggcagcggggagguggacuccuuuucucugggacugcucuguaucagcaucaugauugaagagguuaugagaucccgcuggucucggaaaaugcugaugacaggcacccuugccguguuccugcuccugaucauggggcagcugacauggaacgaucuuauuagacugugcaucauggucggagccaaugcuagcgaccgcaugggcaugggcaccaccuaccucgcccugauggcgacauuuaagaugagaccuauguucgcuguggggcuccuguuucggcgccuuacguccagagaggugcugcuccugaccauuggacugucucuugucgccagcguugaacugcccaacucccucgaggaacugggcgaugggcucgccaugggaaucaugauucugaaacuucugacagacuuccaaagccaucagcucugggcuacccugcugucucuuacauuuaucaagaccacguucucccugcacuaugccuggaaaacaauggcuauggugcucagcaucgugucucuguuuccccucugucuguccaccaccagccagaagacaaccuggcuuccuguccugcugggcucucucgggugcaagccgcugacaauguuccuuauugccgagaauaaaaucuggggacggcgcuccuggccccugaacgaaggcauuauggcggugggcaucguuagcauucuccuguccagccuccugaagaacgaugugccucuugccgggccccugaucgcuggaggcaugcugaucgccuguuacgucauuucugggagcuccgcugaccucucucuggagaaagccgccgaggugagcugggaagaggaagcugagcauuccggagcgucucacaauauccuuguugaagugcaggaugacggcacgaugaagauuaaagaugaggagagagacgauacccugacaauccuccugaaggccacccuccuggcugucagcgggguguauccucuuuccauucccgccacacuguuugucugguacuucuggcagaagaagaagcagcggucuggagugcugugggacaccccuagcccucccgaaguugagcgcgccgugcucgaugacggcaucuauagaaucaugcagcggggccugcuugggcgcucccaggucggagugggcguuuuccaagaaaacguguuucauacgauguggcacgucaccagaggggcugugcugauguaccagggaaaacggcucgagcccagcugggccucugugaagaaagaccugauuuccuacggcgggggauggagacuccagggcagcuggaauacaggcgaggaaguucaggucaucgcgguggagcccgggaagaacccuaaaaaugugcaaaccgcucccggaacauucaagaccccggaaggcgaggucggggccauugcccuggauuuuaagccuggaacaucuggcucccccaucgugaaccgcgaagggaaaauuguuggacuuuauggcaauggcguggucacgaccagcgggacauacguguccgcuaucgcccaggcgaaggcuucucaggagggaccucugcccgagauugaagacgagguuuuccggaaaagaaaccugaccaucauggaucuccaccccggcagcgggaagacccgccgguaucugccugccaucgugagagaagccauuaaacgcaaacuucggacacugauccucgcuccgacgagagucguggccuccgagauggcugaagcccugaagggaaugcccauucgcuaccaaaccacagcgguuaaaagcgagcauaccggcaaggagaucguggaccugaugugccacgccacauuuaccaugcggcuccuuucuccugucagagugcccaauuauaacaugauuaucauggaugaagcucauuucacggacccuuccagcaucgccgcucggggguacauuucuacacgcgugggcaugggagaggccgccgcuaucuuuaugaccgcgacacccccuggcagcgucgaagccuucccgcaguccaaugcuguuauucaggaugaggaaagagacauccccgagcggucuuggaacagcggguaugaguggauuacagauuuuccuggaaaaaccgugugguucgugcccuccaucaagucuggcaaugacaucgccaacugucugcgcaaaaaugggaagagagucauucagcugagccggaagacauuugauaccgaauaccagaagacgaagaacaacgacugggacuacgugguuacaaccgauaucuccgagaugggagccaauuucagagcugaccgcgugauugauccucggagaugccucaaacccgucauccugaaggacggcccggaacgcgugauucuugccgggccuaugcccguuacaguggcgagcgcugcccagcggagaggccgcaucggacggaaccacaauaaagagggcgaucaguauauuuacauggggcagccccugaacaaugacgaggaucaugcccacuggaccgaagcuaagaugcuccuggacaacaucaauacgccugagggaaucauucccgcccuguucgaaccugagagagaaaagucugcggccaucgauggcgaguaucgccucagaggggaggcucggaaaaccuuugucgaacuuaugcgcagaggagaccugccgguguggcuguccuacaaggucgccagcgagggcuuccaauauuccgaucggcgcuggugcuuugacggggaaagaaacaaucaggugcucgaggaaaacauggauguugagauuuggacaaaagagggcgaacggaagaaacugagaccccgcuggcuugacgcucggaccuacucugacccucuggcccucagagaguucaaggaauuugcugccggacgccggagcguguccggcgaucugauccuggagauugggaaacucccccagcaccuuacacagagagcgcaaaaugcccuggacaaccuggugaugcuccauaauucugaacagggaggccgggcuuaucgccacgccauggaggagcugccugauaccaucgaaacacuuaugcugcucgcucugaucgccguccugaccgggggaguuacgcuguucuuucuuagcggcagaggccuggggaagacauccauuggacugcucugugugauggccagcucugugcugcuuuggauggcuuccgucgagccccauuggaucgcggccagcauuauccuggaguucuuucucauggugcugcugauuccggagccugaccggcagcgcacaccccaagauaaccaacucgcuuacguugugaucggccuucuguucaugauccugaccgucgccgccaaugagauggggcuccuggaaaccaccaagaaagaccuuggaauuggccacgcugccguggggaaccaccaucacgcggccaugcuggaugucgaccuccauccugcuucugccuggacacuguacgcuguggccacgaccaucauuacacccaugaugagacacaccaucgagaacacaaccgcgaauauuucccugacggccaucgcuaaccaggccgcuauucucaugggacuugauaagggcuggccuaucagcaaaauggacaucggcguuccccugcuggcccucgggugcuauucucaggugaauccgcugacccuuacagcugccguccugaugcucguggcgcauuacgccauuaucggaccuggccugcaagcuaaggccacccgggaagcucagaaacgcacagccgccgggauuaugaagaaccccaccguugauggaaucguggcgauugaccuggaucccgucguguaugacgcuaaguuugagaaacagcucggccagaucaugcuucugauccuguguacgagccaaauucuccugaugagaacaaccugggcccuuugcgaauccaucacacuggcuaccgggccucucaccacacugugggagggaucuccgggcaaguucuggaauacgaccauugccgugagcauggccaacaucuuucggggcuccuaccuggcuggggccggacucgcguucagccuuaugaaaucccugggcgggggacgcagaggcacaggggcccagggagagacccugggcgaaaaguggaaacggcagcucaaucagcugucuaagagcgaguucaacacauauaagagauccggcauuauggaaguugaccgcucugaggcuaaagaagggcuuaagcggggagagaccacgaaacacgccgucagcagaggcacagcuaagcugcgcugguuuguggagcggaaucucgugaaacccgaagggaaggucaucgaucugggauguggcagagggggaugguccuacuauugcgccggccugaagaaaguuaccgaggugaagggcuacaccaaagggggaccuggccacgaagaacccaucccuauggcgacauacggguggaaccucgugaaacuucauucuggaaaagacgucuucuuuauucccccugaaaagugugauacccugcugugcgacaucggcgagagcuccccgaaucccacaauugaggaagggcgcacgcuccgggugcugaaaaugguugagccuuggcuuagaggaaaccaauucuguaucaagauucugaaucccuauaugccuagcguggucgaaacccucgagcagaugcagcgcaagcacggcggcaugcuggugcggaacccccugucuagaaauuccacacaugagauguacuggguuagcugcgggaccggaaacaucgugucugccgucaauaugacaucccgcaugcuccugaaccgguuuaccauggcucacagaaaaccgacguaugaacgcgauguggaccuuggcgccgggaccagacacguggcugucgagccugaaguugccaaccuggauauuaucggacagcggaucgagaauauuaagcaugaacacaaaagcacauggcauuacgacgaggauaaccccuauaagaccugggcuuaccacggcucuuaugaggugaaacccuccgggagcgccuccagcauggugaauggagucgugaagcuccugacaaagccuugggacguuauccccauggugacccaaauugcgaugacagauaccacgccuuucggccagcagcgcgucuuuaaagaaaagguggacacaagaaccccgaaagccaagcggggcaccgcucaaaucauggagguuacagccaaauggcuuuggggguuccugucuagaaacaagaagccccggauuuguacgcgcgaagaguuuaccagaaaagugcggagcaaugcugccaucggagccgucuucguggacgaaaaccaguggaacuccgcgaaggaggcuguugaggaugaacgcuuuugggaccucgugcauagagagcgggaacugcacaaacagggcaagugcgccacaugcgucuacaacaugauggggaaacgcgagaagaagcugggagaguucggcaaagccaaggggucuagagcuaucugguacauguggcucggcgcccgguuucuggaguucgaggcucuuggauucaugaaugaagaucacugguuuagccgcgagaacucccugucuggcguggaaggggagggacuccauaaacugggcuauauucuuagagacaucagcaagauuccugggggaaauauguacgccgaugacaccgcgggcugggauacacggaucaccgaggacgaucugcagaacgaagcccgcauuacagacaucauggagcccgaacacgcucuccuggccaaauccaucuucaagcugaccuaucaaaauaaagucgugagaguucagcggccugcuaagaacgggacggugauggaugucauuucucgcagagaccagcggggcagcggacaggugggcaccuacgggcucaauacauuuaccaacauggaggcccaacugaucagacagauggaauccgagggaauuuucagccccucugagcuugaaacaccgaaccuggcggagcgcgugcucgauuggcuggaaaaguauggcguugagcggcuuaaaagaauggccaucuccggggacgacuguguggucaagccuauugaugaccgcuuugcuaccgcccugacggcucucaaugauaugggaaaagugcggaaggacaucccccagugggaaccuagcaaaggcuggaacgauuggcagcaaguucccuucugcucucaucacuuucaccagcugaucaugaaggacgggagagagauuguggucccuugucgcaaucaggaugagcuggugggccgggccagagucucccagggagcuggcuggagccuccgcgaaacagccugccuggggaaguccuacgcgcaaauguggcagcuuauguauuuccaucggagagaccugcgccucgccgcuaacgccaucuguucugccgugcccguugauuggauuccgaccagccggacaaccugguccauccacgcucaucaccaguggaugacgaccgaggacaugcugagcguguggaauagagucuggauugaagagaacccuuggauggaagauaaaacacauaucucuuccuggggagacgugcccuaccuuggcaagcgggaggaccaauggugcgggagccugauuggacucaccgccagagcgacaugggcuaccaauauccagguugccaucaaccaggugcgccggcugauuggcaaugagaacuaccuggauuauaugacaucuaugaaaagauuuaagaaugaaagcgaccccgagggggcccucugguga

SEQ ID NO: 19157 - RNA, 9879 nt, Artificial Sequence
  derived and/or modified CDS sequence (opt5) from DENV-1__GU131710__SS-prME
agcgugaccaugcugcucaugcugaugcccaccgcucuugcuuuccaccugacgacccggggcggggaaccucauaugaucgcuuccaagcaggaacggggaaaaucucuccuguuuaagaccagcgcgggcgucaacaugugcacccuuauugcuauggaccugggggaacucugugaagauaccaugaccuacaaaugcccccgcaucacagaaaccgaacccgacgauguugacuguuggugcaaugccacggauaccugggugacauauggaaccuguucccaaacaggcgagcaccggcgggacaagcgcucuguggcccuggcuccucaugucgggcugggacucgagaccagaacggaaacauggaugagcuccgagggcgccuggaaacagauucagcggguggaaaccugggcucugcgccaccccggcuucacaguuaucgcccuuuuucuggcgcaugccauugggaccucuaucacccagaagggaaucauuuucauccuccugaugcuugugacaccuagcauggcuaugagaugcgucggcauugggucccgggauuuuguggagggacugagcggcgccacguggguugacgugguccucgagcacgggucuugugugaccacaauggcuaaggauaaacccacccuggacaucgaacugcucaagacagaggugaccaacccugccguccugcgcaaacuuugcauugaagcgaagaucuccaauacgacaaccgauagcagauguccgacccaaggagaggccacacugguugaagaacaggacgcuaacuucgugugccggcgcaccuuuguggauagaggcuggggcaauggguguggacucuucggcaaagggucucugauuacaugcgccaaguuuaagugcgucacgaaacuugagggaaagaucgugcaguacgaaaaccugaaauauuccguuaucgugaccguccacacaggcgaccagcaucaaguggggaaugagagcaccgaacacggaacaaccgcuacgauuacaccccaggccccuacaaccgagauccagcucacagacuacggcgcccugacccuggauuguucuccccggacgggccucgacuucaacgaaaugguucugcuuacaaugaaggagaaauccuggcuggugcauaagcagugguuucucgaucugccucuucccuggaccagcggggcuuccacaucucaagagaccuggaaucgccaggaccugcucgucaccuucaaaacagcgcacgccaagaagcaggaaguggucgugcugggaagccaagagggcgcuaugcacacggcccugaccggggccacagaaauucagaccuccggaacaaccacgaucuuugcuggccaucucaaaugcagacugaagauggauaaacuuacacugaaggggaugagcuauguuauguguaccggcucuuucaaacucgagaaggaaguggccgagacccagcacggaacaguccuggugcagauuaaguacgagggcaccgacgcgccgugcaaaaucccuuucuccacacaagaugaaaaggggguuacgcagaacggacggcugaucaccgcuaaucccauugugacagacaaagagaagccugucaacaucgaagccgagccgcccuuuggcgagagcuauauugugaucggggccggagaaaaagcucuuaagcucucuugguucaagaaaggcagcuccauugggaagauguuugaggccaccgcuagaggcgcccgccggauggcgauccugggagauacagccugggacuucggcucuaucgggggaguguuuaccagcguuggcaaacugguccaucagauuuucgggacggcuuacggagugcucuuuuccggcgugagcuggaccaugaagaucgggauuggcguccugcuuacauggcugggacucaauucuagauccaccagccugucuaugacauguaucgccgugggccugauuacccuuuaccucgggguuauggugcaggcugauuccggaugcgucaucaacuggaaaggccgcgaacugaagugugggagcggaauuuucgugacaaaugagguucacaccuggacggaacaauauaaguuucaggccgacuccccuaaacggcugucugcggccaucggcaaggcuugggaggagggggugugcggcaucagaagcgccacacgccucgaaaacauuauguggaaacagaucuccaacgagcugaaucauauucuucuggaaaacgacaugaaguucaccgucgugguuggagauguggcuggcauccucgcccaggggaaaaagaugauucggccgcaacccauggaguacaaauauucuuggaaaagcuggggaaaggccaagaucaucggcgcugacguccagaauaccacauuuauuaucgaugggccuaacacccccgaauguccugacgaucagagagcguggaauauuugggagguggaggacuacggauucggcaucuuuacgacaaacauuuggcugaagcugcgcgauuccuauacccaggugugcgaccaccggcuuaugagcgccgcuaucaaagauucuaaggccguccacgccgacaugggcuacuggaucgaauccgagaaaaaugaaacauggaagcucgcuagagccagcuucauugagguuaagaccuguaucuggcccaaaucucauacacugugguccaacggggugcuggaaagcgagaugauuaucccgaagauuuauggaggcccuaucucucaacacaauuaccgccccggguacuucacccaggcggcuggaccuuggcaucucggcaaacuggagcuugauuuugaccugugcgaagggacgaccguggucguggaugagcacugcggaaaccggggccccagccucagaacaaccacaguuaccggcaagaucauucacgaaugguguugccgguccuguacgcugccuccccugcgcuucagaggggaggacggaugcugguauggcauggagauccggccggugaaagaaaaggaggaaaaucuugucaagagcauggugucugccggguccggagagguugacagcuuuucccucggccugcuguguauuucuaucaugauugaagaggugaugagaagccgcuggucccggagaaugcucaugacagggacccuggccgucuucuuucuucugaucaugggacagcucacauggaacgaucugauucgccugugcaucauggugggcgcuaaugccucugacagaaugggcauggggaccaccuaccuugcgcugauggcuacauucaaaaugcggccuauguuugccguuggacuccuguuccgcagacucacgagccgggaggugcugcuucugaccaucggccucucccuggucgccucuguggaacugcccaacagccuugaggaacugggggauggacucgcuaugggcauuaugauccugaagcuccugacagacuuucaaucccaucagcuuugggccacccugcucagccugacauucauuaaaaccacguuuucucugcacuaugcuuggaagacaauggccauggugcuuuccaucgucagccuguucccccucugucugucuaccaccucccagaaaacaaccuggcucccuguucugcuugggagccugggaugcaagccgcugacaauguuucucauugcggagaauaagaucuggggccgcagaucuuggccccugaacgaaggcaucauggccguggggauuguguccauccuucugagcucccuccugaaaaacgaugucccucucgcuggaccccugauugccggcgggaugcuuaucgcuuguuacgugauuagcggaucuagcgccgaccugucccuggagaaggccgcugagguuucuugggaagaggaagcggagcauagcggcgccucccacaauauccucguggaaguccaggaugacgggacgaugaaaaucaaggaugaggagcgggacgauacccugacaauucuucugaaagcuacccuccuggccgugucuggaguuuauccucucagcauccccgccacacuguucgugugguacuucuggcaacgcaagaaacagagauccggcguccuuugggacaccccuucucccccggaaguggagcgggcuguccuggaugacggcauuuaucgcaucaugcagagagggcugcucggacggagccaggugggcguugggguguuucaagaaaacgucuuccauacgauguggcacgugaccagaggagccguucugauguaccagggcaagcgccuugagccuuccugggcgagcgugaagaaagaccugauuucuuacgggggaggcuggcggcuccagggcuccuggaauacaggggaggaaguccaggugaucgcuguggagcccggaaagaacccuaaaaauguucaaaccgcccccggcacauuuaagaccccggaaggggaggucggagccauugcucuggauuucaaaccuggcacaagcgggucucccaucgugaacagagaaggaaagaucgugggccucuauggcaauggggucgugacgaccuccggaacauacguuagcgccauugcgcaggcuaaggccucccaggagggcccucugcccgagaucgaagacgagguguuucgcaaacggaaccuuaccauuauggaucugcaccccgggucuggaaagaccagacgcuaucugccugccaucguccgggaagcuauuaaaagaaagcuccgcacacugauccuugccccgacgcgggugguugcuagcgagauggccgaagcgcugaaaggcaugcccaucagauaccaaaccacagccgugaaguccgagcauaccgggaaggagauugucgaccucaugugccacgcuacauucaccaugcggcugcugagcccugugcgcguucccaauuauaacaugaucauuauggaugaagcccauuuuacggacccuucuuccaucgcugccagaggcuacauuagcacacgggugggaaugggcgaggccgcugcgaucuucaugaccgccacacccccugggucugucgaggcuuuuccgcagagcaaugccgugauccaggaugaggaacgcgacauucccgagagauccuggaacucuggauaugaguggaucacagauuucccuggcaaaaccgugugguuuguccccagcauuaaguccgggaaugacaucgccaacugucuccggaaaaauggaaagagaguuauucagcuuucucgcaaaacauucgauaccgaauaccaaaagacgaagaacaacgacugggacuacguggugacaaccgauaucagcgagaugggcgcuaauuuccgggccgacagagucauugauccucgccggugccugaaacccgugauccugaaggacgggccggaaagaguuauccucgcgggcccuaugcccgugacagucgcuuccgccgcccagcgccggggaagaauuggccgcaaccacaauaaagagggggaucaguauaucuacaugggacagccccugaacaaugacgaggaucaugcucacuggaccgaagccaagaugcuucuggacaacauuaauacgccugagggcaucauucccgcgcucuuugaaccugagagagaaaagagcgccgcuaucgauggggaguaucggcugcgcggagaggccagaaagaccuucguggagcugaugcggcgcggcgaccucccgguuuggcuuucuuacaagguggcuuccgagggguuucaauauagcgauagacgguggugcuucgacggcgaaagaaacaaucagguccuggaggaaaacauggauguggagaucuggacaaaagagggagaacgcaagaaacugcggcccagauggcucgacgcccgcaccuacuccgacccucuggcccuucgggaguuuaaggaguucgccgcgggcagacggucugucagcggggaucugauucucgagaucggaaaacugccccagcaccugacacagcgcgcccaaaaugcucucgacaaccuugugaugcugcauaauuccgaacagggcgggagagccuaucggcacgcuauggaggagcugccugauaccauugaaacacucaugcugcuugcccugaucgccguucucaccggaggcgugacgcuguuuuuccugucuggccgcgggcucggaaagacaagcauuggccuucugugugugauggcuuccagcguccugcucuggauggcgucuguugagccccauuggaucgccgcuuccaucauucuggaauuuuuccuuauggugcugcucaucccggagccugacagacagcggacaccccaggauaaccaacuggccuacguggucauugggcugcucuuuaugauccuuaccguggccgcuaaugagaugggacugcuggaaacaaccaaaaaggaccucggcauugggcacguugccguggagaaccaccaucacgcggccaugcuggaugucgaccuucauccugcuagcgccuggacacuguacgcuguggccacgaccaucauuacacccaugaugcgccacaccaucgaaaacacaaccgcgaauaucucucucacggccauugcuaaccaggccgcuauccugaugggacuggauaagggcuggccuauuuccaaaauggacaucggcgucccccuccuugcccuggggugcuauagccaggugaauccgcugacccucacagcugccguucugaugcuuguggcgcauuacgccauuaucggaccuggccugcaagcuaaggccaccagagaggcucagaaacggacagccgccgggaucaugaagaaccccaccgucgauggaauuguggcgaucgaccucgaucccguuguguaugacgcuaaauucgaaaagcagcugggccagauuaugcugcucauccuuuguacgucucaaauucugcugaugcgcacaaccugggcccucugcgagagcaucacacuggcuaccgggccucuuaccacacugugggagggauccccgggcaaguuuuggaauacgaccaucgccgucucuauggccaacauuuucagaggcagcuaccucgcuggggccggacuggcguucucccugaugaaaagccucggcgggggacggagaggcacaggggcccagggagaaacccuuggcgagaaguggaaacgccagcugaaucagcuguccaagucugaauuuaacacauauaaacggagcggcaucauggagguggacagauccgaagcuaaggaggggcucaagcgcggagagaccacgaaacacgccgugucucggggcacagcuaagcugagaugguucguugaacgcaaucuugucaaacccgaggggaaggugauugaucugggauguggcagagggggauggagcuacuauugcgccggccucaaaaaggugaccgaagucaagggcuacaccaaagggggaccuggccacgaggaacccaucccuauggcgacauacggguggaaccugguuaagcugcauuccggaaaagacguguuuuucauucccccugagaagugugauacccuccuuugcgacaucggcgagucuagcccgaaucccacaauugaagaggggagaacgcugcgcgugcugaaaauggucgaaccuuggcuccggggaaaccaauuuuguaucaagauccugaaucccuauaugccuuccgugguugagacccuugagcagaugcagagaaaacacggcggcaugcuggugcgcaacccccucagcagaaauucuacacaugaaauguacugggucuccugcgggaccggaaacauugugagcgccguuaauaugacaucuagaaugcugcugaaccgcuucaccauggcucacagaaagccgacguaugagcgggauguggaccucggcgccgggacccgccacgucgcuguggaaccugagguggccaaccuggauaucauuggacagagaaucgaaaauauuaagcaugagcacaaauccacauggcauuacgacgaggauaaccccuauaagaccugggcuuaccacggcagcuaugaagucaaacccucuggguccgccagcuccaugguuaauggaguggugaaacuucugacaaaaccuugggacgucauccccauggugacccaaaucgcgaugacagauaccacgccuuuuggccagcagcggguuuucaaggagaagguggacacaagaaccccgaaagccaagcggggcaccgcucaaauuauggaagucacagccaaauggcucuggggguuucugagccgcaacaagaaacccagaaucuguacgcgggaggaguucacccgcaaggugagaucuaaugcugccauuggagccguuuuuguggacgagaaccaguggaauagcgcgaaggaggcugucgaagaugagcgguucugggaccuugugcaucgcgaaagagagcugcacaaacagggcaagugcgccacaugcguuuacaacaugauggggaaacgggaaaagaaacucggagaguuuggcaaggccaaggggucccgcgcuaucugguacauguggcugggcgccagauuccuggaguucgaagcucucggauuuaugaaugaggaucacugguucucucgggaaaacagccuguccggcguggagggggagggacuucauaaacugggcuauauucuccgcgacaucucuaagaucccugggggaaauauguacgccgaugacaccgcgggcugggauacaagaauuaccgaagacgaucugcagaacgaggcccggaucacagacauuauggaacccgagcacgcccuucuggccaaaagcaucuuuaagcucaccuaucaaaauaaagucgugcgcguccagagaccugcuaagaacgggacggugauggauguuauuucccggagagaccagcgcggcucuggacaggugggcaccuacgggcugaauacauucaccaacauggaagcccaacugauccggcagauggagagcgagggaaucuuuucccccagcgaacucgagacaccgaaccuggcggaaagaguccuugauuggcuggagaaauauggcguggaacgccucaagcggauggccauuucuggggacgacugugugguuaagccuaucgaugacagauucgcuaccgcccugacggcucuuaaugauaugggaaaagugcgcaaggacauuccccagugggagccuuccaaaggcuggaacgauuggcagcaaguccccuuuugcagccaucacuuccaccagcugaucaugaaggacgggcgggagauugugguuccuuguagaaaucaggaugaacucgugggccgcgcccgggucucucagggagcuggcuggucccugagagagacagccugccuggggaaaagcuacgcgcaaauguggcagcucauguauuuucaucgccgggaccugagacuugccgcuaacgccaucuguuccgccgugcccgucgauuggauuccgaccucucggacaaccuggagcauccacgcucaucaccaguggaugacgaccgaagacaugcuguccguguggaauagaguuuggaucgaggaaaacccuuggauggaggauaagacacauauuagcucuuggggagacgugcccuaccucggcaagcgcgaggaccaauggugcgggucccugaucggacuuaccgcccgggcgacaugggcuaccaauauucaggucgccaucaaccaggugagacgccugauuggcaaugaaaacuaccucgauuauaugacaagcaugaaaagauucaagaaugagucugaccccgaaggggcccugugguga

SEQ ID NO: 19158 - RNA, 9879 nt, Artificial Sequence
  derived and/or modified CDS sequence (opt5) from DENV-1__GU131717__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacagauccugccguucuccgcaaacugugcauugaagcgaagaucuccaacaccacgacagacagcagauguccgacccaaggagaggccacccuuguggaagagcaggaugcuaauuuugugugccggcgcacauucgucgacagaggcuggggcaacggguguggacuguuuggcaaagggucucucaugaccugcgccaaguucaagugcgugacaaaacuggagggaaagauuguucaguacgaaaaucuuaaauauuccgugaucgucacggugcacaccggcgaccagcaucaaguugggaacgagagcacagaacacggaaccacagcuaccaucacgccccaggccccuucuaccgagauucagcugacagauuacggcgcccucacccuggacuguuccccccggacaggccuggauuuuaaugaaauggugcuccugaccaugaaggagaaaagcuggcuuguccauaagcagugguuccuggaccucccucugcccuggacguccggggcuucuacaagccaagagaccuggaaccgcaaagaucuucuggugacauuuaagaccgcgcacgccaagaaacaggaagucgugguucucggaucccaggagggcgcuaugcacaccgcccugacaggggccacggaaauccaaaccagcggaacaaccacaauuuucgcuggccaucugaagugcagacucaaaauggacaagcugacccuuaaagggaugucuuaugugauguguacgggcuccuucaagcuggagaaggaagucgccgagacacagcacggaaccgugcucguucagaucaaauacgagggcaccgaugcgccgugcaagauuccuuuuagcacacaggacgaaaaaggggugacccaaaauggacggcugaucacagcuaaccccaucgucacggauaaggagaaaccugugaauauugaagccgagccccccuucggcgagucuuauaucgugauuggggccggagaaaagacccugaagcuuagcugguuuaaaaagggcuccucuaucgggaaaauguucgaggcuacagccagaggcgcucgccggauggccauucucggagacaccgcgugggauuuuggcagcaucgggggaguuuucacauccgucggcaagcuggugcaucagaucuuugggaccgccuacggagugcuguucagcggcgucucuuggacgaugaaaauugggaucggcgugcuccugaccuggcuuggacugaacuccagaagcacaucucucuccaugaccuguauugcuguuggccuggugacacuguaccuuggggucauggugcaggccgacagcggaugcguuaucaauuggaagggccgcgaacucaaguguggguccggaauuuuugugaccaacgagguccacacauggaccgaacaguauaaauuccaagcugacucuccuaagcggcugagcgccgcgaucggcaaagccugggaggagggggugugcggcauuagauccgcuacgcgccuggaaaauaucauguggaagcagaucucuaacgagcucaaccauauucugcuugaaaaugauaugaaauuuacaguuguggucggagacguggccggcauccuggcucaggggaagaaaaugauucggccgcagcccauggaguacaaguauagcuggaaguccuggggaaaagccaagaucauuggcgccgaugugcaaaacaccaccuucaucaucgacgggccuaauacacccgaauguccugaugaccagagagcuuggaacauuugggaggucgaggauuacggauuuggcaucuucaccacgaauauuuggcucaaacugcgcgacagcuauacacagguuugcgaucaccggcugaugucugcggccaucaaggacuccaaagcugugcacgccgauaugggcuacuggauugaaagcgagaagaacgaaaccuggaagcuugccagagcuucuuucaucgaggugaaaacauguaucuggcccaagucccauacccucuggagcaaugggguccuggaaucugagaugauuaucccgaaaauuuauggaggcccuaucagccagcacaacuaccgccccggguacuuuacacaaaccgccggaccuuggcaucugggcaagcucgagcuggacuucgaucuuugcgaagggacgaccgugguuguggacgagcacugcggaaaucggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaccugguuaagucuaugguguccgcggggagcggagaggucgauuccuucucucuuggccuccuguguauuagcaucaugauugaagaggugaugcgguccagauggucucgcaaaaugcugaugacagggacccucgcuguuuuuuuccugcuuaucaugggacagcugacauggaaugaccucauucggcugugcaucauggugggcgccaacgccagcgauagaaugggcauggggaccaccuaccuggcucuuauggccacauuuaagaugcgcccuauguucgcggucggacugcucuuuagacggcugacgucccgcgaggugcuccugcuuaccauuggccugucucucguggcuagcgucgaacugcccaauucccuggaggaacuuggggacggacuggccaugggcaucaugauccucaaacugcucacagauuuccagagccaucaacugugggccacccuucugucucucacauuuauuaagaccacguucucccugcacuaugcuuggaagacaauggccaugguucugagcaucgugucucuuuuuccccugugucucuccaccaccagccagaaaacaaccuggcugccugugcuccuggggucucuuggaugcaagccgcugacaauguuccugauugcugagaacaaaaucuggggcagaaaguccuggccccucaaugaaggcauuauggccgucgggaucgugagcauccugcuuuccgcgcugcucaaaaacgacguuccucuggccggaccccucauugcuggcgggaugcugaucgccuguuacgugauuagcggaucuagcgcugaucuuucccuggagaaggccgccgaggucucuugggaagaggaagcugagcauagcggcgcgucccacaacauccugguggaaguucaggacgaugggacgaugaaaauuaaggacgaggagcgggaugacacccucacaauccugcuuaaggccacccugcucgcugugucuggagucuauccucugagcauccccgccacacucuucgugugguacuuuuggcagaaaaagaaacaacgcuccggcguccugugggauaccccuucucccccggaaguggagagagccguucuugacgacggcauuuaucggaucaugcagcgcgggcugcugggaagaagccaggugggcgucgggguguuccaggaaaauguuuuucauacgauguggcacgugacccggggagcuguccucaugcaccaaggcaagcgccuggagccuuccugggccagcgugaaaaaggaucuuauuucuuacgggggaggcuggagacugcagggcuccuggaacacaggggaggaagugcagguuaucgcggucgagcccggaaagaauccuaaaaacgugcagaccgcucccggcacauucaagaccagcgaaggggaggugggagccauugcccucgacuuuaaaccgggcacaucuggguccccuaucgucaaucgggaaggaaagauugugggccuguacggcaacgggguugugacgaccagcggaacauaugucuccgcuaucgcccaagcgaaagcuucucaggagggcccccucccugagaucgaagaugagguguucagaaagcgcaaucugaccauuauggaccuucaucccgggagcggaaagacccggagauaccugcccgccaucguucgcgaagccauuaaacggaagcugagaacacucauccuggcuccuacgcgcguggucgccuccgagauggcugaagcccuuaaaggcaugccgauucgguaucagaccacagcggugaagagcgagcacaccgggaaagagaucguugaucugaugugccaugccacauuuaccaugagacuccugucucccgugcgcgucccuaacuacaauaugaucauuauggacgaagcucacuucacggaucccuccagcaucgccgcucggggcuauauuucuacaagagugggaaugggcgaggccgccgcuaucuuuaugaccgcgaccccucccgggagcguggaagccuucccucaauccaacgcugucauucaggacgaggaacgggauaucccggagcgcucuuggaauagcggauacgaguggaucacagacuuucccggcaagaccguuugguucgugccuuccauuaagucugggaacgauaucgccaauugucugagaaaaaacggaaagcgggugauucagcucagccgcaaaacauucgacaccgaauaucagaagacgaaaaauaacgacugggauuacgucgugacaaccgacaucuccgagaugggcgccaacuuuagagcugaucggguuauugaccccagacgcugccuuaagccugugauccugaaggaugggcccgaacgggucauucuggccggcccgaugccugugacaguugcgagcgcugcccaaagacgcggacggaucggcagaaaucauaacaaagagggggaccaguacaucuauaugggacagccccucaauaacgaugaggaccacgcccacuggaccgaagcuaagaugcugcuugauaauauuaacacgcccgagggcaucauuccugcccuguucgaacccgagcgcgaaaaaucugcggccaucgacggggaguaccggcucagaggagaggcucgcaagaccuuuguggaacugaugagacggggcgaucugccugucuggcucuccuauaaaguggccagcgagggguuccaguacuccgaccgcagauggugcuuugauggcgaacggaauaaccaaguccuugaggaaaauauggacguggagauuuggacaaaggagggagaacgcaaaaagcugagaccgcgguggcuggacgcuagaaccuauucugauccccucgcccugcgcgaguucaaggaauuugcugccggccggagaagcguuuccggggaccuuauccuggagaucggaaaacucccucagcaucugacacagcgcgcgcagaacgcccuggauaaucucgugaugcuucacaacucugaacaaggcgggcgggcuuacagacaugccauggaggagcugcccgacaccauugaaacacugaugcuccuggcucuuaucgccgugcugaccggaggcgucacgcucuucuuucugagcggccgggggcugggaaagacauccauuggccuccuuuguguuauggccagcucugugcugcuguggauggcuuccguggagccucacuggaucgcggccagcauuauccucgaauucuuucugaugguccuucugauccccgagccggaucgccagagaaccccucaggacaaucagcucgcuuaugugguuauugggcugcuguucaugauccucaccguggccgccaacgagaugggacuucuggaaacaaccaaaaaggaucugggcauugggcacgucgcuguggagaaucaucaccaugccgcgaugcucgacgucgaucugcaccccgccucugcuuggacacuuuacgccguggcuacgaccaucauuacaccuaugaugcggcauaccaucgaaaacacaaccgccaacauuucccugacggcgaucgccaaucaagcugccauccucaugggacuggacaaaggcuggcccauuagcaagauggauaucggcguuccucugcucgcucuugggugcuacucucaggugaacccccugacccugacagccgcuguccucaugcugguggcccacuaugcgauuaucggaccgggccuucaggccaaggcuacccgcgaggcccaaaaaagaacagcugccgggauuaugaagaauccuaccguugacggaaucguggccaucgaucuggaccccgucguguacgacgcgaaauuugaaaagcagcucggccagauuaugcugcugauccucuguacgagccagauucuucugaugcggacaaccugggcucugugcgaguccaucacacucgccaccgggccccugaccacacuuugggagggaucuccuggcaaauucuggaacacgaccauugcugugagcauggccaauaucuuccgcggcuccuaucuggccggggcuggacucgccuuuagccugaugaagucccugggcgggggaagacggggcacaggggcgcaaggagaaacccucggcgagaaguggaaacgccagcuuaaccagcugucuaagagcgaauucaauacauacaaaagauccggcaucauggagguugaucggucugaagccaaggaggggcugaaaagaggagagaccacgaagcacgcugucagccgcggcacagccaagcuccggugguuuguggaaagaaaccuggugaaaccggaggggaaggucauugaccuuggauguggccgcgggggaugguccuauuacugcgcuggccugaaaaagguuaccgaagugaaaggcuauaccaaggggggacccggccaugaggaaccuauccccauggccacauacggguggaaucucgugaaacugcacucuggaaaggaugucuucuuuauuccucccgagaagugugacacccugcucugcgauaucggcgagagcuccccuaacccgacaauugaagaggggcggacgcuuagagugcugaaaaugguugaacccuggcugcgcggaaaucaguucuguaucaagauucucaacccuuacaugcccagcguggucgagacccuggagcaaaugcagcggaaacauggcggcaugcuugugagaaauccucugucucgcaacuccacacacgaaauguauuggguuagcugcgggaccggaaauaucgugucugcggucaacaugacaucccggaugcuccugaauagauuuaccauggcccaccgcaagcccacguacgagcgggacguggaucugggcgcugggaccagacauguggccgucgaaccggagguugcuaaccucgacaucauuggacagcgcaucgaaaacauuaaacacgagcauaagagcacauggcacuaugaugaggacaauccuuacaagaccugggccuaucauggcucuuacgaagugaaacccuccgggagcgcuuccagcauggugaacggagucgugaagcugcuuacaaaacccugggauguuaucccuauggugacccagauugccaugacagacaccacgcccuucggccaacagagagucuuuaaggagaaaguggacacacggaccccuaaggcgaagcgcggcaccgcccagaucauggaaguuacagcuaaauggcuguggggguuccucucuagaaauaagaaaccgcggaucuguacgagagaggaauuuacccggaaggugcgcagcaacgccgcuauuggagccgucuucguggaugagaaucaauggaacuccgccaaagaggcgguugaagacgagagauuuugggaucuggugcaccgggaacgcgagcuucacaagcagggcaagugcgcuacaugcgucuauaauaugauggggaaaagagaaaagaaacugggagaguucggcaaggccaaagggucucgggccaucugguacauguggcucggcgcucgcuuccuggaguuugaagcccugggauucaugaacgaggaccauugguuuagcagagaaaauucccucucuggcguggagggggagggacugcacaagcuuggcuacauucugcgggauaucagcaaaauucccgggggaaacauguaugcugacgauaccgccggcugggacacacgcaucaccgaagaugaccuccagaaugaggcgaagaucacagauauuauggaaccugagcaugcccugcuugcuaaguccaucuucaaacugaccuaccagaacaaggucgugagaguucaacggcccgccaaaaaugggacggugauggacgucauuucucgcagagaucagcggggcagcggacaggugggcaccuaugggcucaacacauuuaccaauauggaagcucagcugauccgccaaauggaguccgagggaauuuucagcccuucugaacuggagacacccaaccucgccggcagagugcuggacuggcuugaaaagcacgggguugagcggcugaaaagaauggcgaucuccggagacgauuguguggucaagccgaucgacgaucgcuuugccgcugcccucaccgcucugaacgacaugggcaaggugcggaaagauauuccucagugggaacccagcaagggguggaaugacuggcagcagguuccuuucugcucucaccauuuucaccaacuuaucaugaaagauggcagagagauugugguccccugucgcaaccaggacgagcuggugggacgggccagagucucccagggcgcuggguggagccuccgcgaaacggccugccugggaaaguccuacgcgcagauguggcaacugauguauuuccaucggagagaucuccgccuggccgcuaaugccaucuguucugccgugccuguugacugggugcccacaagccggaccacaugguccauucacgcucaucaccaguggaugaccacggaggauaugcuuagcgucuggaacagaguguggaucgaagagaauccguggauggaagacaaaacccacauuucuuccuggggcgacguuccuuaccuggggaagcgcgaggaucaguggugcggaagccucaucggccugacagcccgggcgaccugggcuacaaacauccaaguggccauuaaucaggucagacggcuuaucgggaacgagaauuaucuggacuacaugaccucuaugaagagauuuaaaaacgaaagcgaucccgagggcgcccucugguga

SEQ ID NO: 19159 - RNA, 9879 nt, Artificial Sequence
  derived and/or modified CDS sequence (opt5) from DENV-1__GU131718__SS-prME
agcgugaccaugcugcucaugcugaugcccaccgcccuugcuuuccaccugacgacccggggcggggagccucauaugaucgucacaaagcaggaacggggaaagucccuccuguuuaagaccucugccggcguuaacaugugcacacuuauugccauggaccugggggagcucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccauugaacacggaaccacagcuaccaucacgccccaggccccuaccagcgagauucagcucacagacuacggcgcccugacccuggauuguucuccccggacaggccucgacuucaacgaaaugguucugcuuaccaugaaggagaaauccuggcuggugcauaagcagugguuucucgaucugccucuucccuggacgagcggggcuuccacaucucaagagaccuggaaucgccaggaccugcucgucacauucaaaaccgcgcacgccaagaagcaggaaguggucgugcugggaagccaagagggcgcuaugcacaccgcccugacaggggccacggaaauccagaccuccggaacaaccacaauuuuugcuggccaucucaaaugcagacugaagauggauaaacuuacccugaaggggaugagcuauguuauguguacgggcucuuucaaacucgagaaggaaguggccgagacacagcacggaaccguccuggugcagaucaaguacgagggcaccgacgcgccgugcaaaaucccuuucuccacacaagaugaaaaggggguuacccagaacggacggcugauuacagcuaaucccaucgugauugacaaagagaagccugucaacaucgaagccgagccgcccuuuggcgagagcuauauugugaucggggccggagaaaaagcucuuaagcucucuugguucaagaaaggcagcuccaucgggaagauguuugaggccacggcuagaggcgcccgccggauggcgauucugggagauaccgccugggacuucggcucuaucgggggaguguuuacaagcauuggcaaacugguucaucagaucuucgggaccgcuuacggaguccucuuuuccggcgugagcuggacaaugaagauugggaucggcgugcugcuuaccuggcugggacucaauucuagauccacgagccugucuaugaccuguauugccgucggccuggugacacuuuaccucgggguuauggugcaggcugauuccggaugcgucaucaacuggaaaggccgcgaacugaagugugggagcggaaucuucgugaccaaugagguucacacauggaccgaacaauauaaguuucaggccgacuccccuaaacggcugucugcggccauuggcaaggcuugggaggagggggugugcggcaucagaagcgccacacgccucgaaaacauuauguggaaacagaucuccaacgagcugaaucauauucuucuggaaaacgacaugaaguucaccgucgugguuggagauguggucggcauccucgcucaggggaaaaagaugauccggccgcaacccauggagcacaaauacucuuggaaaagcuggggaaaggccaagauuaucggcgccgacgugcagaauacgacauuuauuaucgaugggccuaacacccccgaauguccugacgaucagagagcuuggaauauuugggagguggaggacuauggauucggcaucuuuaccacaaacaucuggcugaagaugcgcgauuccuacacccaggucugcgaccaccggcugaugagcgcggccauuaaagauucuaaggcuguucaugccgacaugggcuauuggaucgaauccgagaaaaaugaaacguggaaacuugccagagcuagcuucauugaggugaagacauguaucuggcccaaaucucacacccucugguccaacggggugcuggaaagcgagaugauuaucccgaagaucuacggaggcccuauuucucaacauaauuaucgccccggguacuucacacagaccgccggaccuuggcaccugggcaaacucgagcuggauuuugaccuuugcgaagggacaaccgucgugguugaugagcacugcggaaaccggggccccagccugagaacgaccacagugaccggcaagaucauucaugaaugguguugccgguccuguacacucccuccccugcgcuucaaaggggaggacggaugcugguacggcauggagaucagaccggucaaggaaaaggaggaaaaucuggugaaaagcaugguuucugcgggguccggagagguggacagcuuuucccuuggccuccuguguauuucuaucaugauugaagaggucaugcggagcagauggucccgcaagaugcugaugaccgggacgcucgcuguguuccugcuucugaucaugggacagcucacauggaacgaucugauccggcugugcauuaugguuggcgccaaugccucugacagaaugggcauggggaccacauaucuugcucugauggccaccuuuaaaaugcgcccuauguucgcggugggacuccuguuuagacggcucaccagccgcgagguccugcuucugacaaucggccucucccugguggcuucuguggaacugcccaacagccuugaggaacugggggauggacucgccaugggcauuaugauccugaagcuccugacggacuuccaaucccaccagcuuugggccacccugcucagccugacauuuauuaaaaccacacugucucuucauuacgcuuggaagaccauggccaugguccuguccaucguuagccucaucccccugugucucucuacgacaucccagaagaccaccuggcugccugugcuucuggggagccugggaugcaaaccgcucacaauguuccugauugcugagaauaagaucuggggcagaaaaucuuggccccuuaacgaaggcauuauggccgugggggucguguccauccugcucagcucccugcucaagaacgauguuccucuggcgggaccccuuauugccggcgggaugcugaucgcuuguuaugugaucagcggaucuagcgccgaccugucccucgagaaagcugccgaggucucuugggaagaggaagccgagcacagcggcgcuucccauaauauucugguggaaguucaggaugacgggaccaugaagaucaaagaugaggagcgggacgauacacuuacgauucugcucaaggcgacccugcucgccgugucuggagucuacccucugagcauccccgcuacacuuuuugugugguauuucuggcaaaagaaaaagcagcgcuccggcguccugugggacaccccuucucccccggaaguggagagagccguucuggaugacggcauuuaccggaucaugcagcgcgggcuccugggaagaagccaggugggcgucgggguguuucaagaaaacguuuuccacacaauguggcacgugacccggggagccguccuuauguaucagggcaaacgccuggagccuuccugggcuagcgugaagaaagaccucauuucuuacgggggaggcuggagacugcagggcuccuggaauacgggggaggaagugcagguuaucgccgucgagcccggaaagaacccuaagaaugugcaaaccgcgcccggcacauucaaaaccccggaaggggaggugggagcuaucgcccucgauuuuaagccuggcacaagcgggucucccauugucaaccgggaaggaaaaaucgugggccuguacggcaaugggguugugaccacauccggaacguaugucagcgccauugcucaggccaaggcgucccaggagggcccucuucccgagaucgaagacgagguguucagaaaacgcaaccugaccauuauggaucugcaucccgggucuggaaagacacggagauaccucccugcuaucguucgcgaagccaucaagcggaaacugagaacccuuauucuggccccgacccgcguggucgcuagcgagauggccgaagcucucaagggcaugcccauccgguaucaaacaacggccgugaaauccgagcacaccgggaaggagauuguugaccugaugugccaugcgacauuuaccaugagacugcucagcccugugcgcguccccaauuacaacaugaucauuauggaugaagcccacuucacagacccuucuuccaucgcugcccggggcuauaucagcaccagagugggaaugggcgaggcugccgccauuuuuaugacggcuacacccccugggucuguggaagcguucccgcagagcaaugccgucauccaggaugaggaacgggacauucccgagcgcuccuggaacucuggauacgaguggaucaccgauuuuccuggcaaaaccguuugguucgugcccagcauuaaguccgggaaugacaucgcuaacugucuuagaaagaauggaaaacgggugauucagcugucucgcaagacauuugauaccgaauaucagaagacaaagaacaacgacugggacuacgucgugaccacggauaucagcgagaugggcgccaauuucagagccgaccggguuaucgauccuagacgcugccugaaacccgugauucucaaggacgggccggaacgggucauccuggcuggcccuaugcccgugacaguugccuccgcggcucagagacgcggacggauuggcagaaaccauaauaaggagggggaucaguacaucuauaugggacagccccuuaacaaugacgaggaucacgcccacuggaccgaagccaaaaugcugcucgacaacauuaauacaccugagggcaucauccccgcucuguuugaaccugagcgcgaaaagagcgccgcgauugauggggaguaccggcugagaggagaggcccgcaaaaccuucguggaacucaugagacggggcgaccuuccggucuggcugucuuauaagguggcuuccgagggguuccaauacagcgaucgcagauggugcuuugacggcgaacggaacaaucagguccuggaggaaaacauggauguggagaucuggacgaaagagggagaacgcaagaaacucagaccccgguggcuggacgccagaaccuauuccgacccucuugcucugcgcgaguucaaggaauuugccgcuggccggagaucuguuagcggggaucucauucuggagaucggaaagcugccccagcaucucacacagcgcgcccaaaaugcgcuugacaaccuggugaugcugcacaauuccgaacagggcgggcgggccuacagacaugcuauggaggagcucccugauaccauugaaacacugaugcuucuggcccucaucgcugugcugaccggaggcgucacacuguucuuucucucuggccgggggcuuggaaaaaccagcaucggccugcuguguguuauggccuccagcgugcuccuguggauggccucuguggagccccacuggauugcugcguccaucauucuugaguucuuucugaugguccuccugaucccggagccugaccgccagagaacgccccaggauaaccaacuggccuaugugguuauugggcuccuuuucaugauccugacaguggcugccaaugagaugggacugcucgaaaccaccaagaaagaccugggcauugggcacgucgccguggagaaccaucaccaugcuacaaugcuugaugucgaccugcacccugccagcgcguggacccucuacgccguggcuacaacgaucaucacccccaugaugcggcauacaauugaaaacaccacagccaauaucucucugaccgcuauugccaaccaggcggccauccugaugggacucgauaagggcuggccuauuuccaaaauggacaucggcguuccccuucuggcucuggggugcuacagccaggugaauccgcucacgcugaccgccgcuguccuuaugcugguggcccacuaugcuaucauuggaccuggccuccaagccaaggcgacacgcgaggcccagaagagaaccgcugccgggaucaugaaaaaccccacaguugauggaauuguggcuaucgaccuggaucccgucguguacgacgccaaguuugaaaaacagcugggccagauuaugcuccuuauccuguguaccucucaaauccugcucaugcggacgacaugggcccugugcgagagcauuacccuugcgacagggccucugaccacccucugggagggauccccgggcaaguucuggaauacaacgaucgcugugucuauggccaacauuuuucgcggcagcuaucuggcuggggccggacuggccuucucccucaugaaaagccuuggcgggggaagacggggcaccggggcucagggagaaacacugggcgagaaguggaagcgccagcugaaucagcucuccaaaucugaauuuaacaucuacaagagaagcggcauuauggagguugaccgguccgaagccaaagaggggcugaagagaggagagaccacacgccacgcggucucucggggcaccgccaaacuuagaugguucguggaacgcaaucuggugaagcccgaggggaaggucaucgaucucggauguggcagagggggauggagcuauuacugcgcuggccugaaaaagguuacggaagugaaaggcuauacaaaagggggaccuggccaugaggaacccauuccuauggccaccuacggguggaaccuggugaaacuccacuccggaaaggacgucuucuuuacacccccugagaaaugugauacacuucugugcgacaucggcgagucuagcccgaaucccaccaucgaagaggggagaacacugcgcgugcucaagaugguugaaccuuggcugcggggaaaccaauucuguauuaagauccuuaaucccuacaugccuuccguggucgagacgcuggagcagaugcagagaaaacauggcggcaugcucgugcgcaacccccugagcagaaauucuacccacgaaauguauuggguuuccugcgggacaggaaacauugugagcgcugucaauaugaccucuagaaugcugcucaaccgcuuuacaauggcccaccggaagccgaccuacgagaaagauguggaccugggcgcggggacgagacauguggccgucgaaccugagguugcuaaccuugauaucauuggacagcgcaucgaaaauaucaagcacgagcauaaauccaccuggcacuaugacgaggauaaccccuacaagacaugggccuaucauggcagcuacgaagugaagcccucuggguccgcuagcuccauggugaauggagucgugaaacugcucaccaagccuugggacguuauucccauggugacacaaaucgccaugaccgauacaaccccuuucggccagcagagagucuuuaaagagaagguggacacgcggacaccgaaagcuaagcgcggcaccguucaaauuauggaagugaccgccagauggcuguggggguuccuuagccggaacaagaaacccagaaucuguacacgggaggaauuuacgcgcaaggucagaucuaaugcggccauuggagcuguguucguugacgagaaccaguggaauagcgccaaagaggcuguggaagaugagcgguuuugggaccuggucaagaaagaacgcgagcuccacaagcagggcaagugcgcgaccugcguguauaacaugauggggaaaagagaaaagaaacugggagaguucggcaaggccaaagggucccgggcgaucugguacauguggcugggcgcucgcuuucucgaguucgaagcccugggauuuaugaaugaggaucacugguucucuagagaaaacagccuuuccggcgucgagggggagggacugcauaagcucggcuacauccugcgggacauuucuaaaaucccugggggaaauauguaugccgaugacacagcuggcugggauacccgcauuacagaagacgaucuucagaacgaggccaagaucaccgacauuauggaacccgagcacgcucugcucgccacaagcaucuucaagcugaccuaccaaaauaaagugguuagagugcagcggccugcgaagaacgggacggucauggaugugaucucccgcagagaccagcggggcucuggacaggugggcaccuaugggcugaauacauuuaccaacauggaagcccaacucauucgccagauggagagcgagggaaucuuccugcccuccgaacuugagacaccgaaccuggcugaaagaguucucgauuggcuggagaaauacggcguggaacggcuuaagagaauggccauuagcggggacgacugugucgugaaaccuaucgaugaccgcuuugcuaccgcccugacggcgcucaaugauaugggaaagguucggaaggacauuccccagugggagccuucuaaaggcuggaacgauuggcagcaagugcccuucugcucccaucacuuucaccagcugaucaugaaggacgggagagagauugucgugccuugucgcaaucaggaugaacuggucggccgggccagagugagccagggagcuggcuggucucuccgcgagacagccugccuggggaaauccuaugcucaaauguggcagcuuauguacuuccaucggagagaccugcgccucgccgcuaacgccaucuguagcgcgguucccguggauugggucccgaccucccggacaaccuggucuauccacgcccaucaccaguggaugacgaccgaagacaugcugagcguguggaauagaguuuggauugaggaaaacccuuggauggaggauaagacacauguguccagcuggggagacguccccuaucuuggcaaacgcgaggaccaauggugcgggucucugaucggacucaccgcucgggccacaugggccuccaauauucagguggcuaucaaccaggugagacggcugauuggcaaugaaaacuaccuggauuacaugaccagcaugaagagauuuaagaaugagggggaccccgaaggcgcccucugguga

SEQ ID NO: 19160 - RNA, 9879 nt, Artificial Sequence
  derived and/or modified CDS sequence (opt5) from DENV-1__GU131720__SS-prME
agcgugaccaugcugcucaugcugaugcccaccgcccuugcuuuccaccugacgacccggggcggggaaccucauaugaucgugaccaagcaggaacggggaaaaucccuccuguuuaagaccucugccggcguuaacaugugcacccuuauugccauggaccugggggagcucugugaagauaccaugacguacaaaugcccccgcaucaccgaggcugaacccgacgauguggacuguuggugcaaugccacggauaccugggugaccuauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacguccagaauaccaccuuuaucaucgaugggccuaacacacccgaauguccugacgaucagagagcuuggaauauuugggagguugaggacuauggauucggcaucuuugcgaccaacauuuggcugaagcugcgcgauuccuacacacaggugugcgaccaccggcuuaugagcgccgcuaucaaagauucuaaggccgugcaugccgacaugggcuauuggauugaauccgagaaaaaugaaacauggaagcucgcuagagccagcuucaucgaggucaagaccuguaucuggcccaaaucucacacacugugguccaacggggugcuggaaagcgagaugauuaucccgaagauuuacggaggcccuaucucucaacauaauuaucgccccggguacuucacccagacagcgggaccuuggcaccucggcaaacuggagcuugauuuugaccugugcgaagggaccacgguuguggucgaugagcacugcggaaaccggggccccagccucagaaccacaaccgugacaggcaagauuauccaugaaugguguugccgguccuguacccugccuccccugcgcuucaaaggggaggacggaugcugguacggcauggagaucagaccgguuaaggaaaaggaggaaaaucuugugaaaagcauggucucugcuggguccggagagguggacagcuuuucccucggccugcuguguauuucuaucaugauugaagagguuaugcggagcagauggucccgcaagaugcucaugacggggacacuggccguguuccuucugcucaucaugggacagcugaccuggaacgaucugauucggcuuugcaucauggucggcgccaaugcuucugacagaaugggcauggggacaaccuaucuggcccucauggcgaccuuuaaaaugcgcccuauguucgcugugggacugcucuuuagacggcugacaagccgcgaggugcuucugcucacgauuggccugucccuggucgccucuguugaacuucccaacagccuggaggaacucggggauggacuggccaugggcaucaugauccucaagcugcuuaccgacuuccaaucccaccagcugugggcuacacuccugagccugaccuuuauuaaaacaacccuuucucugcauuacgccuggaagacgauggcuauggugcucuccaucgugagccuguucccccucugucugucuacaaccucccagaagaccacauggcuuccuguccugcuggggagcuuuggaugcaaaccgcucaccauguuccugauuacagagaauaagaucuggggcagaaaaucuuggccccuuaacgaaggcauuauggccguggggguuguguccauccugcucagcucccugcucaagaacgaugucccucuggcgggaccccuuaucgccggcgggaugcugauugcuuguuaugugaucagcggaucuagcgccgaccugucccucgagaaagcugccgagguuucuugggaagaggaagccgagcacagcggcgcuucccauaauauucugguggaaguccaggaugacgggacgaugaagaucaaagaugaggagcgggacgauacccuuacaauucugcucaaggcgacccugcucgccgugucuggagucuacccucugagcauccccgcuacacuuuuugugugguauuucuggcaaaagaaaaagcagcgcuccggcguucugugggacaccccuucucccccggaaguggagagagccguccuggaugacggcaucuaccggauuaugcagcgcgggcuccugggaagaagccaggugggcguugggguguuccaagaaaacgucuuucacacgauguggcacgugacccggggagccgugcuuauguaucagggcaaacgccuggagccuuccugggcuagcguuaagaaagaccucaucucuuacgggggaggcuggagacugcagggcuccuggaauacaggggaggaaguccaggugauugccguggagcccggaaagaacccuaagaauguccaaaccgcgcccggcacauucaaaaccccggaaggggaggugggagcuaucgcccucgauuuuaagccuggcacaagcgggucucccauuguuaaccgggaaggaaaaaucgugggccuguacggcaauggggucgugacgaccuccggaacauauguuagcgccauugcucaggccaaggcgucccaggagggcccucuucccgagaucgaagacgagguguucagaaaacgcaaccugaccaucauggaucugcaucccgggucuggaaagacccggagauaccucccugcuauuguccgcgaagccaucaagcggaaacugagaacacuuauucuggccccgacgcgcgugguugcuagcgagauggccgaagcucucaagggcaugcccauccgguaucaaaccacagccgugaaauccgagcacaccgggaaggagauugucgaccugaugugccaugcgacauuuaccaugagacugcucagcccugugcgcgugcccaauuacaacaugaucaucauggaugaagcccacuucacggacccuucuuccauugcugcccggggcuauaucagcacaagagucggaaugggcgaggcugccgccauuuuuaugaccgcuacacccccugggucuguugaagcguucccgcagagcaaugccgugauccaggaugaggaacgggacauucccgagcgcuccuggaacucuggauacgaguggaucacagauuuuccuggcaaaaccgugugguucguccccagcaucaaguccgggaaugacauugcuaacugucuuagaaagaauggaaaacgggugauccagcugucucgcaagacauuugauaccgaauaucagaagacgaagaacaacgacugggacuacguugugacaaccgauauuagcgagaugggcgccaauuucagagccgaccgggucaucgauccuagacgcugccugaaacccgugauucucaaggacgggccggaacggguuauccuggcuggcccuaugcccgugacagucgccuccgcggcucagagacgcggacggauuggcagaaaccauaauaaggagggggaucaguacaucuauaugggacagccccuuaacaaugacgaggaucacgcccacuggaccgaagccaaaaugcugcucgacaacaucaauacgccugagggcauuauccccgcucuguucgaaccugagcgcgaaaagagcgccgcgauugauggggaguaccggcugagaggagaggcccgcaaaaccuuuguggaacucaugagacggggcgaccuuccggucuggcugucuuauaagguggcuuccgagggguuccaauacagcgaucgcagauggugcuuugacggcgaacggaacaaucagguucuggaggaaaacauggauguggagaucuggacaaaagagggagaacgcaagaaacucagaccccgguggcuggacgccagaaccuauuccgacccucuugcucugcgcgaguucaaggaauuugccgcuggccggagaucugugagcggggaucucauucuggagaucggaaagcugccccagcaucucacacagcgcgcccaaaaugcgcuugacaaccuggucaugcugcacaauuccgaacagggcgggcgggccuacagacaugcuauggaggagcucccugauaccaucgaaacacugaugcuucuggcccucauugcuguucugaccggaggcgugacgcuguucuuucucucuggccgggggcuuggaaaaacaagcaucggccugcugugugugauggccuccagcguccuccuguggauggccucuguggagccccacuggauugcugcguccaucauucuugaguucuuucugaugguucuccugaucccggagccugaccgccagagaacaccccaggauaaccaacuggccuauguggucaucgggcuccuuuucaugauucugaccguggcugccaaugagaugggacugcucgaaacaaccaagaaagaccugggcaucgggcacgucgccguggagaaccaucaccaugcuacaaugcuugauguugaccugcacccugccagcgcguggacgcucuacgccguggcuaccacaauuaucacccccaugaugcggcauacaauugaaaacaccacggccaauaucucucugaccgcuauugccaaccaggcggccauccugaugggacucgauaagggcuggccuaucuccaaaauggacauuggcgucccccuucuggcucuggggugcuacagccaggugaauccgcucacacugaccgccgcuguucuuaugcugguggcccacuaugcuaucauuggaccuggccuccaagccaaggcgacacgcgaggcccagaagagaaccgcugccgggaucaugaaaaaccccacggucgauggaauuguggcuaucgaccuggaucccgugguuuacgacgccaaguuugaaaaacagcugggccagaucaugcuccuuauucuguguacaucucaaauccugcucaugcggaccacaugggcccugugcgagagcauuacccuugcgaccgggccucugacaacgcucugggagggauccccgggcaaguucuggaauaccacaaucgcugucucuauggccaacauuuuucgcggcagcuaucuggcuggggccggacuggccuucucccucaugaaaagccuuggcgggggaagacggggcaccggggcucagggagaaacacugggcgagaaguggaagcgccagcugaaucagcucuccaaaucugaguucaacaucuacaagagaagcggcaucauggagguggaccgguccgaagccaaagaggggcugaagagaggagagaccacgcgccacgcggugucucggggcacagccaaacuuagaugguuugucgaacgcaaucugguuaagcccgaggggaaggugauugaucucggauguggcagagggggauggagcuauuacugcgcuggccugaaaaaggugaccgaagucaaaggcuauaccaaagggggaccuggccaugaggaacccaucccuauggccacauacggguggaaccuggugaaacuccacuccggaaaggacguuuucuuuacacccccugagaaaugugauacacuucugugcgacauuggcgagucuagcccgaaucccacgaucgaagaggggagaacccugcgcgugcucaagauggucgaaccuuggcugcggggaaaccaauucuguauuaagauccuuaaucccuacaugccuuccgugguugagacacuggagcagaugcagagaaaacauggcggcaugcucgugcgcaacccccugagcagaaauucuacccacgaaauguauugggucuccugcgggacaggaaacauugugagcgcugugaauaugaccucuagaaugcugcucaaccgcuuuacgauggcccaccggaagccgaccuacgagagagaugucgaccugggcgcggggacacgccauguugccguggaaccugagguggcuaaccuugauaucaucggacagagaauugaaaauaucaaacacgagcauaaguccaccuggcacuaugacgaggauaaccccuacaaaacaugggccuaucauggcagcuacgaagucaagcccucuggguccgcuagcuccauggugaauggaguugugaagcugcucaccaaaccuugggacgucauucccauggugacacaaaucgccaugaccgauacgacaccuuucggccagcagcggguuuuuaaggagaaaguggacacccgcaccccgaaggcuaaaagaggcacagcccaaauuauggaagucacggcgcgguggcuguggggguuccuuagcagaaacaagaagccccggaucuguacccgcgaggaauuuacaagaaaagugcggucuaaugccgcuaucggagccguuuucguggacgagaaccaguggaauagcgcuaaggaggccgucgaagaugagcgcuuuugggaccuggugcagaaagaaagagagcuccacaagcagggcaaaugcgcgaccugcgucuauaacaugauggggaagcgggaaaagaaacugggagaguucggcaaggcgaaagggucccgcgcuauuugguacauguggcugggcgccagauuucucgaguucgaagcccugggauucaugaaugaggaucacugguuuucucgggaaaacagccuuuccggcguggagggggagggacugcauaagcucggcuacauccugcgcgacauuucuaaaaucccugggggaaauauguaugcugaugacacagccggcugggauaccagaauuacagaagacgaucuucaaaacgaggcuaagaucaccgacaucaugaaacccgaacacgcccugcucgcgacgagcauuuucaagcugaccuaccagaauaagguugugcggguccagcgcccugccaaaaacgggacagugauggaugugaucuccagacgggaccagcgcggcucuggacaaguuggcaccuaugggcugaauacauuuaccaacauggaggcucagcucauuagacagauggaaagcgagggaaucuuccugcccuccgagcuugaaacgccgaaccuggccgagcgggugcucgauuggcuggaaaaguacggcgucgagagacuuaaacgcauggcuauuagcggggacgacugugugguuaagccuaucgaugaccgguuugccacagcgcugaccgcccucaaugauaugggaaaagugagaaaggacaucccccagugggaaccuucuaagggcuggaacgauuggcaacagguccccuucugcucccaucacuuucaccagcugauuaugaaagacgggcgcgagaucguggucccuugucggaaucaggaugagcuggugggcagagcucgcguuagccaaggagccggcuggucucuccgggaaacagcuugccuggggaaguccuaugcccagauguggcagcuuauguacuuccauagacgcgaccugcggcucgcugccaacgcgauuuguagcgccgugcccaucgauugggucccgaccuccagaacgaccuggucuauucacgcucaucaccaauggaugacaaccgaggacaugcugagcguguggaaucgcguuuggaucgaagagaacccuuggauggaagauaaaacacauguguccagcuggggagacguccccuaucuuggcaagcgggaggaccaguggugcgggucucugauuggacucaccgccagagccacaugggcuuccaauauccagguggccaucaaccaggugcggagacugauuggcaaugagaacuaccuggauuacaugaccagcaugaaacgcuuuaagaaugaaggggaccccgagggcgcgcucugguga

SEQ ID NO: 19161 - RNA, 9879 nt, Artificial Sequence
  derived and/or modified CDS sequence (opt5) from DENV-1__HM181960__SS-prME
agcgugaccaugcugcucaugcugaugcccacagcccuugcuuuccaccugacgaccagaggaggggagccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaggaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuugggagccugggaugcaagccgcugacgauguuucucaucgcugagaauaaaauuuggggccggcgcucuuggccccugaacgaaggcaucauggccgucgggaucguguccauucuucugagcucccuccugaagaacgauguuccucucgcgggaccccugaucgccggcgggaugcuuauugcuuguuacgugaucagcggaucuagcgccgaccugucccuggagaaagcugccgaggucucuugggaagaggaagccgagcauagcggcgcuucccacaauauucucguggaaguucaggaugacgggaccaugaagaucaaagaugaggagagagacgauacacugaccauccuucugaaggcgacacuccuggccgugucuggagucuauccucucagcauucccgcuacccuguucgugugguacuucuggcagaaaaagaagcagcgguccggcguccuuugggacacgccuucucccccggaagugggccgcgccguucuggaugacgggaucuauagaauuaugcagcggggacugcucggccgcagccaggugggggucggaguguuucaagagaacguuuuccauaccauguggcacgugacaagaggcgccguccugauguaccaggggaaacggcuugaaccuuccugggcuagcgugaagaaagaccugaucucuuacggaggcggcuggagacuccagggguccuggaauaccggagaggaggugcagguuauugccgucgaacccggcaagaacccuaaaaaugugcaaacagcgcccgggaccuuuaagacaccggagggagaagugggcgcuaucgcccuggauuucaagccugggacgagcggaucucccauugucaaccgcgagggcaaaaucgugggccucuaugggaauggaguugugaccacauccggcaccuacgucagcgccaucgcucaggccaaggcgucccaggaagggccucugcccgagauugaggacgaaguguuucggaaaagaaaccuuaccaucauggaucugcaccccggaucuggcaagacacgccgguaucugccugcuauuguuagagaggccaucaaacgcaagcuccggacgcugauucuugccccgaccagaguggucgcuagcgaaauggccgaggcucugaaggggaugcccauccgcuaccaaacaaccgccgugaaauccgaacauacaggcaaggagaucguugaccucaugugccacgcgaccuucacgaugcggcugcugagcccugugagaguccccaauuauaacaugauuaucauggaugaggcccauuuuacagacccuucuuccauugcugcccggggauacaucagcacccgcgugggcaugggggaagcugccgccauuuucaugaccgcuacacccccuggaucuguggaggcguuuccgcagagcaaugccgucauccaggaugaagagagagacauccccgaacgguccuggaacucuggcuaugaguggauuaccgauuucccugggaaaacaguuugguuugugcccagcaucaaguccggaaaugacauugcuaacugucuccgcaaaaauggcaagagagugauccagcuuucucggaagaccuucgauacggaguaccagaaaaccaagaacaacgacugggacuacgucgugaccacagauauuagcgaaaugggggccaauuucagagccgaccgcguuaucgauccucggagaugccugaaacccgugauucugaaggacggcccggagcgcgucauccucgcuggaccuaugcccgugaccguugccuccgcggcucagcggagaggccgcaucgggcggaaccacaauaaagaaggagaucaguauauuuacaugggccagccccugaacaaugacgaggaucaugcccacuggacggaggccaagaugcuucuggacaacaucaauaccccugaagggauuauccccgcucucuuugagccugaaagagaaaagagcgccgcgauugauggagaauaucgccugagaggcgaggcccggaaaacauucguggagcugaugcgcagaggggaccucccggucuggcuuucuuacaagguggcuuccgaaggcuuucaauauagcgaucggcgcuggugcuucgacggagagagaaacaaucagguccuggaagagaacauggauguggaaaucuggaccaaagagggcgagcggaagaaacugagaccccgcuggcucgacgcccggacauacuccgacccucuggcucuuagagaauuuaaggaguucgccgcugggcgccggucuguuagcggagaucugauccucgaaauuggcaaacugccccagcaccugacccagagagcccaaaaugcgcucgacaaccuugugaugcugcauaauuccgagcaagggggacgggccuaucgccacgcuauggaggaacugccugauacaaucgagacccucaugcugcuugcccugauugcugugcucacgggcggcgucacacuguuuuuccugucugggagaggacucggcaagaccagcaucgggcuucuguguguuauggccuccagcgugcugcucuggauggccucuguggaaccccauuggauugcugcguccaucauccuggaguuuuuccuuaugguccugcucauuccggaaccugaccggcagcgcacaccccaggauaaccaacuggccuacgugguuaucggacugcucuuuaugauucuuacaguggcugccaaugagaugggccugcuggagaccacaaagaaagaccucgggaucggacacgucgccguggaaaaccaccaucacgcugccaugcuggaugucgaccuucauccugcgagcgccuggacgcuguacgcuguggccaccacaauuaucacccccaugaugagacacacaauugagaacaccacggcuaauaucucucucaccgccaucgcgaaccaggccgcuauucugaugggccuggauaagggcuggccuaucuccaaaauggacauugggguuccccuccuugcccugggaugcuauagccaggugaauccgcugacacucaccgcugccguccugaugcuuguggcucauuacgccaucauuggcccugggcugcaagcgaaggccacacgggaagcucagaaacgcaccgccgcuggaaucaugaagaaccccacgguugauggcaucguggccauugaccucgaucccgucguguaugacgccaaguucgagaaacagcuggggcagaucaugcugcucauucuuuguacaucucaaauccugcugaugagaaccacaugggcgcucugcgaaagcauuacccuggcuaccggaccucuuacaacgcugugggagggcuccccgggcaaguuuuggaauaccacaaucgccgugucuauggcuaacaucuuccgggggagcuaccucgccggagccggccuggcuuucucccugaugaaaagccucgggggaggccgcagagggaccggagcccagggcgagacacuuggcgaaaaguggaaacggcagcugaaucagcuguccaagucugaguuuaacaccuauaagagaagcgggauuauggaaguugaccgcuccgaggcgaaagaaggacucaagcggggcgagacgacaaaacacgccgucucuagagggaccgcuaagcugcgcugguucguggagcggaaucuugugaaacccgaaggaagagucaucgaucugggcugugggcgcggaggcuggagcuacuauugcgccggccucaagaagguuaccgaggugaaaggguacacaaagggaggcccugggcacgaggagcccauuccuauggcuaccuacggauggaaccuggugaaacugcauuccggcaaggacgucuuuuucauucccccugaaaaaugugauacacuccuuugcgacauuggggagucuagcccgaaucccacgaucgaggaaggacggacccugagagugcugaagaugguugagccuuggcuccgcggcaaccaauuuuguauuaaaauccugaaucccuauaugccuuccguggucgaaacacuugagcagaugcagcggaagcacggcgggaugcuggugagaaacccccucagccgcaauucuacccaugagauguacuggguuuccugcggaacaggcaacaucgugagcgccgucaauaugaccucucggaugcugcugaacagauucacgauggcgcaccgcaagccgaccuaugaaagagauguggaccucggggccggaacacggcacguggcugucgagccugaaguugccaaccuggauauuaucggccagcgcauugagaauaucaaacaugaacacaaguccaccuggcauuacgacgaggauaaccccuauaaaacaugggcuuaccacgggagcuaugaggugaagcccucuggauccgccagcuccauggugaauggcgucgugaaacuucugaccaagccuugggacguuauucccauggugacacaaaucgcuaugaccgauacgacaccuuuuggccagcagagagucuucaaggaaaaaguggacacccggaccccgaaggccaaaagagggacagcgcaaaucauggagguuacggccaaguggcucuggggauuucugagccggaacaaaaagccccgcauuuguaccagagaagaguucacacggaaggugcgcucuaaugcugccaucggcgcugucuuuguggacgaaaaccaguggaauagcgccaaagaggccguugaggaugaaagauucugggaccuugugcaucgggagcgcgaacugcacaagcaggggaaaugcgcgaccugcgucuacaacaugaugggaaagagagagaaaaagcucggcgaauuugggaaggcuaaaggcucccgggccauuugguacauguggcugggagcccgcuuccuggaguucgaggcucucggcuuuaugaaugaagaucacugguucucuagagagaacagccuguccgggguggaaggagagggccuucauaagcugggguauauccuccgggacauuucuaaaaucccuggaggcaauauguacgccgaugacacagcugggugggauacccgcaucacagaggacgaucugcagaacgaagccagaauuaccgacaucauggagcccgaacacgcgcuucuggccaagagcauuuuuaaacucacguaucaaaauaaggucgugcggguucagcgcccugcuaaaaacggcaccgugauggaugucaucuccagacgggaccagagaggaucuggccagguggggacauacggacugaauaccuucacaaacauggaggcccaacugauucgccagauggaaagcgagggcaucuuuucccccagcgagcucgaaaccccgaaccuggcugagcgggugcuugauuggcuggaaaaguaugggguugagagacucaagcgcauggccaucucuggagacgacuguguggucaaaccuauugaugaccgguucgcgacggcccugacagcucuuaaugauaugggcaaggugagaaaagacaucccccagugggaaccuuccaagggguggaacgauuggcagcaaguucccuuuugcagccaucacuuccaccagcugauuaugaaagacggccgcgagaucguggucccuugucggaaucaggaugagcucgugggcagagcccgcgucucucagggcgcuggguggucccugcgggaaaccgccugccugggaaagagcuacgcucaaauguggcagcucauguauuuucauagacgcgaccugcggcuugccgcgaacgccauuuguuccgcugugcccguugauuggaucccgacaucuagaaccacguggagcauucacgcccaucaccaguggaugaccacagaggacaugcuguccguguggaaucgggucuggaucgaagagaacccuuggauggaagauaagacccauaucagcucuuggggcgacgugcccuaccucgggaaaagagaggaccaauggugcggaucccugauuggccuuacagcccgcgcuaccugggccacaaauauccagguugcgauuaaccaggugcggagacugaucgggaaugagaacuaccucgauuauaugaccagcaugaagcgcuucaaaaaugaaucugaccccgagggcgcucugugguga

SEQ ID NO: 19162 - RNA, 9879 nt, Artificial Sequence
  derived and/or modified CDS sequence (opt5) from DENV-1__HM181963__SS-prME
agcgugaccaugcugcugaugcugaugcccacagcccuugcuuuccaccugacgacccggggaggggagccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaauuggcgagcacagacgggacaagcgcucugucgcccucgcuccucauguggggcugggacuggagaccagaacagaaaccuggaugagcuccgagggcgccuggaaacagauccagcggguugaaacgugggcucuccgccaccccggcuuuacagugauugcccuguuccuugcgcaugccaucgggaccucuaucacacagaagggaauuaucuuuauucugcucaugcuggucaccccuagcauggcuaugagaugcgugggcaucgggucccgggauuucguugagggacuuagcggcgccaccuggguggacgucgugcuggagcacgggucuugugugacaacgauggcuaaggauaaacccacccucgacauugaacugcugaagacagaggucaccaacccugccguucuccgcaaacugugcaucgaagcgaagauuuccaauacaaccacggauagcagauguccgacacaaggagaggccacccuuguggaggaacaggacgcuaacuuugugugccggcgcaccuucgucgauagaggcuggggcaauggguguggacuguuuggcaaagggucucucaucacaugcgccaaguucaagugcgugaccaaacuggagggaaagaucguucaguacgaaaaccuuaaauauuccgugauugucacagugcacacgggcgaccagcaucaaguugggaaugagagcaccgaacacggaacaaccgcuacaaucacaccccaggccccuucuacggagauucagcugaccgacuacggcgcccucacacuggauuguagcccccggaccggccuggacuuuaacgaaauggugcuccugacaaugaaggagaaaagcuggcuuguccauaagcagugguuccuggaucucccucugcccuggaccuccggggcuucuacgagccaagagacauggaaucgccaggaccuucuggugaccuuuaaaacagcgcacgccaagaagcaggaagucgugguucucggaucccaagagggcgcuaugcacaccgcccugaccggggccacagaaauccagacgagcggaaccacaaccauuuucgcuggccaucugaaaugcagacucaagauggauaaacugacacuuaaggggaugucuuaugugauguguaccggcuccuucaaacuggagaaggaagucgccgagacgcagcacggaacagugcucguucagaucaaguacgagggcaccgacgcgccgugcaaaaucccuuuuagcacccaagaugaaaagggggugacacagaacggacggcugauuaccgcuaaucccaucgucacagacaaagagaagccugugaacauugaagccgagccgcccuucggcgagucuuauaucgugauugggguuggagaaaaagcccugaaacuuagcugguuuaagaaaggcuccucuaucgggaagauguucgaggcuacggccagaggcgcucgccggauggccauccucggagauaccgcgugggacuuuggcagcauugggggagucuucacauccgugggcaaacuggugcaucagaucuuugggaccgccuacggaguccuguucagcggcgugucuuggacaaugaagauugggaucggcguucuccugaccuggcuuggacucaauuccagaagcacgucucucuccaugaccuguauugcugugggccuggucacacuguaccuuggggugaugguucaggccgauagcggaugcgugaucaacuggaaaggccgcgaacucaaguguggguccggaauuuuugucaccaaugaggugcacacauggaccgaacaauauaaguuccaggcugacucuccuaaacggcugagcgccgcgaucggcaaggccugggaggaggggguuugcggcaucagauccgcuacacgccuggaaaacauuauguggaaacagaucucuaacgagcucaaucauauucugcuugaaaacgacaugaagcugaccguggucgugggagauguggccggcauccucgcucaggggaaaaagaugauucggccgcaacccauggaguacaaauauagcuggaaguccuggggaaaggccaaaaucaucggcgccgacguccagaauacgacauuuauuaucgaugggccuaacacccccgaauguccugacgaucagagagcuuggaauauuugggagguugaggacuacggauucggcaucuuuaccacaaacauuuggcugaagcugcgcgauagcuauacccaggugugcgaccaccggcuuaugucugcggccaucaaagauuccaaggcugugcacgccgacaugggcuacuggaucgaaagcgagaaaaaugaaacguggaagcucgccagagcuucuuucauugaggucaagacauguaucuggcccaaaucccauacccuguggagcaacggggugcuggaaucugagaugauuaucccgaagauuuauggaggcccuaucagccaacacaauuaccgccccggguacuucacacagaccgccggaccuuggcaucucggcaaacuggagcuugauuuugaccugugcgaagggacaaccguuguggucgaugagcacugcggaaaccggggccccucccucagaacgaccacagugaccggcaagaucauucacgaaugguguugccggagcuguacacugccuccccugcgcuucaaaggggaggacggaugcugguauggcauggagaucagaccgguuaaggaaaaggaggaaaaucuugugaaaucuauggucuccgcggggagcggagagguggacuccuuuucucucggccugcuguguauuagcaucaugauugaagagguuaugcgguccagauggucucgcaagaugcucaugaccgggacgcuggcuguguucuuucuucugaucaugggacagcucacauggaacgaucugauucggcugugcaucauggucggcgccaaugccagcgacagaaugggcauggggaccacauaccuugcucugauggccaccuucaaaaugcgcccuauguuugcggugggacuccuguucagacggcucaccucccgcgaggugcugcuucugacaaucggccucucucuggucgcuagcguugaacugcccaacucccuugaggaacugggggauggacucgccaugggcauuaugauccugaagcuccugacggacuuucaaagccaucagcuuugggccacccugcucucuaugacauucauuagaaccacauuuucccugcacuaugcuuggaaaaccauggccauggugcugagcaucgugucucuuuucccccugugucucuccacgacaagccagaagaccaccuggcugccuguccuccuggggucucuuggaugcaagccgcugacaauguuucugauugcugagaauaaaaucuggggccggaaguccuggccccucaacgaaggcaucauggccguggggauuguuagcauccugcuuuccagccugcucaaaaacgaugugccucuggcgggaccccucauugccggcgggaugcugaucgcuuguuacgucauuucuggaagcuccgccgaccuuucucuggagaaggcugccgugguuagcugggaggaagaggccgaacauuccggcgcuucucacaauauccugguggagguccaggaugacgggaccaugaaaaucaaggaugaagaaagagacgauacacucacgauucugcuuaaagcgacccugcucgccgugagcggagucuauccucuguccauccccgcuacacucuucgugugguacuucuggcaaaagaagaaacagagaucuggcguucugugggacaccccuuccccucccgagguggaacgggccguccuugaugacggcauuuaucgcaucaugcagagagggcugcugggacggucccaggugggcguugggguguuucaagagaacgucuuccauacaauguggcacgugacccgcggagccgugcucauguaccagggcaagagacuggaacccagcugggcuucuguuaaaaaggaccuuauuuccuacgggggaggcuggcggcugcagggcagcuggaauacgggggaggagguccaggugaucgccguggaacccggcaagaauccuaagaauguccaaaccgcgcccggcacauuuaagaccucugagggggaagugggagcuauugcccucgauuucaaaccgggcacauccgggagcccuaucguuaacagagagggaaagguggucggccuguauggcaauggggugguuaccacauccggaacguacgugucugccaucgcucaggccaaagcgagccaggaaggcccccucccugagauugaggacgaagucuuucgcaagcggaaccugaccaucauggaucuucaccccggguccggaaaaacaagacgcuaucugcccgcuauugugcgggaggccaucaagagaaagcugcgcacccucauucuggccccuacccggguuguggcuagcgaaauggccgaggcucuuaaaggcaugccgaucagauaccaaacaacggccgucaagucugaacauaccgggaaagagaucguggaccugaugugccacgcgacauucaccaugcgccuccugucccccgugcgggucccuaauuauaacaugauuaucauggaugaggcccauuuuacagaccccagcucuauugcugccagaggcuacaucagcacccggguuggaaugggcgaagcugccgccauuuucaugacggcuacaccucccggguccguggaggcguuuccucagucuaaugccgugauccaggaugaggaacgcgacaucccggaaagaagcuggaacuccggauaugaguggauuaccgauuuccccggcaagaccgucugguuugugccuucuaucaaaagcgggaaugacauugcuaacugucugcggaagaauggaaagcgcguuauccagcucuccagaaaaacauucgauaccgaguaccaaaagaccaagaacaacgacugggacuacguggucaccacggauauuagcgaaaugggcgccaauuuccgggccgacagagugaucgauccccgccggugccuuaagccuguuauucugaaagacgggcccgagagagugauccuggcuggcccgaugccugucacaguggccucugcggcucagcgccggggaagaaucggccgcaaccacaauaaggaaggggaucaguauauuuacaugggacagccccucaacaaugacgaggaucaugcccacuggaccgaggccaagaugcugcuugacaacaucaauacacccgaaggcauuaucccugcucuguuugagcccgaacgggagaaauccgccgcgauugauggggaauauagacuccgcggagaggccagaaagaccuucgucgagcugaugcggcgcggcgaccugccuguguggcucagcuacaaaguugcuuccgaaggguuucaauauucugauagacgguggugcuucgacggcgagcgcaacaaucaggugcuugaagagaacauggauguggaaaucuggacgaaggagggagagcgcaagaagcugcggccgagauggcuggacgcccgcaccuacagcgacccccucgcucugcgggaauuuaaagaguucgccgcuggcagacgcuccgucucuggggaucuuauccuggaaauuggaaagcucccucagcaccugacacagcgggcccaaaaugcgcuggacaaccucguuaugcuucauaauagcgagcagggcgggagagccuaucggcacgcuauggaggaacugcccgauaccaucgagacacugaugcuccuggcccuuauugcugugcugaccggaggcgugacacucuuuuuccuguccggccgcgggcugggaaagaccagcaucggccuccuuugugucauggccucuuccgugcugcuguggauggccagcguugaaccucauuggauugcugcgucuaucauccucgaguuuuuccugauggugcuucugauucccgaaccggacagacagcggacgccucaggauaaccaacucgccuacgucgugaucgggcugcuguuuaugauucucacagucgcugccaaugagaugggacuucuggagaccaccaaaaaggaccugggcaucgggcacguggccguugaaaaccaccaucacgcugccaugcucgauguggaccugcaucccgcguccgccuggacacuuuacgcugucgccaccacaauuaucacgccuaugaugcgccacaccauugagaacacaaccgcuaauaucagccugacagccaucgcgaaccaggccgcuauucucaugggacuggauaaaggcuggcccaucucuaagauggacauuggcgugccucugcucgcccuugggugcuauagccagguuaauccccugacccugacggcugccgugcucaugcuggucgcucauuacgccaucauuggaccgggccuucaagcgaaagccaccagagaagcucagaagcggacagccgcugggaucaugaagaacccuaccguggauggaaucguggccauugaccuggaucccguugucuaugacgccaaauucgagaagcagcucggccagaucaugcugcugauucucuguacaucccaaauccuucugaugcgcaccacgugggcgcugugcgaaucuauuacacucgcuaccgggccccugacaacccuuugggagggaagcccuggcaaauuuuggaauaccacaaucgccguguccauggcuaacaucuucagaggcagcuaccuggccggggccggacucgcuuucucccugaugaagucucugggcgggggacggcgcggcacgggggcccagggagagacccucggcgaaaaauggaagagacagcuuaaucagcugagcaaguccgaguuuaacacauauaaacggucuggcauuauggaaguggacagaagcgaggcgaaggaagggcugaaacgcggagagaccacaaagcacgccgucucccggggcaccgcuaaacucagaugguucguugagcgcaaucuggugaagccggaagggaaggugaucgaucuuggauguggcagagggggauggucuuacuauugcgccggccugaaaaaggucacggaggugaaaggcuacacaaaagggggacccggccacgaggagccuauucccauggcuaccuacggguggaaccucguuaaacugcauagcggaaaggacguguuuuucaucccucccgaaaaaugugauacccugcucugcgacauuggcgaguccagcccuaauccgacaaucgaggaagggagaacccuucgcguccugaagaugguggagcccuggcugcggggaaaccaauuuuguauuaagauccucaauccuuauaugcccucuguuguggaaacacuggagcagaugcagagaaaacacggcggcaugcuuguccgcaacccucugucccggaauagcacgcaugagauguacugggugucuugcgggaccggaaacaucguguccgccgucaauaugacaagcagaaugcuccugaaccgcuucaccauggcgcaccggaagcccacauaugaaagagauguugaccugggcgccgggacccgccacguggcuguggagccggaagucgccaaccucgauauuaucggacagagaauugagaauaucaaacaugaacacaagucuacguggcauuacgacgaggauaacccuuauaaaaccugggcuuaccacggcuccuaugaggugaagcccagcggguccgccagcucuaugguuaauggaguggucaagcugcuuacaaaacccugggacgugauuccuaugguuacccaaaucgcuaugacagauaccacacccuuuggccagcagcggguguucaaggaaaaagucgacacccgcacgccuaaggccaaaagaggcacagcgcaaaucauggaggugaccgccaaguggcuguggggguuucucagccggaacaagaaaccgagaauuuguacccgggaagaguucacacgcaagguuagauccaaugcugccaucggagcuguguuugucgacgaaaaccaguggaacucugccaaagaggccguggaggaugaacgguucugggaccugguccaucgcgagagagaacuucacaagcagggcaaaugcgcgacgugcguguacaacaugauggggaagcgggagaagaaacugggagaauuuggcaaggcuaaagggagccgcgccauuugguacauguggcucggcgccagauuccuggaguucgaggcucugggauuuaugaaugaagaucacugguucucccgggagaacucucucagcggcguugaaggggagggacugcauaaacuuggcuauauccugcgcgacauuuccaaaauccccgggggaaauauguacgccgaugacaccgcuggcugggauacaagaaucaccgaggacgaucuccagaacgaagccaagauuacagacaucauggagccugaacacgcgcugcuugccaaaucuauuuuuaagcugaccuaucaaaauaaggugguccgggugcagcgccccgcuaaaaacgggacagugauggauguuaucagcagacgggaccagcgcggcuccggacaggugggcaccuacgggcucaauacguucaccaacauggaggcccaacugauuagacagauggaaagcgagggaaucuuuucuccuuccgagcuggaaacacccaaccucgcuggccgggcccuggauuggcuugagaagcauggggucgaaagacugaaacgcauggcgaucagcggagacgacugugugguuaagccgauugaugaccgguucgccaccgcucucacagcccugaaugauaugggcaaagugagaaaggacaucccucagugggagcccucuaagggguggaacgauuggcagcaagucccuuuuugcucccaccacuuccaucagcuuauuaugaaagacggccgcgaaaucgugguccccugucggaaucaggaugagcuggugggcagagcucgcguuagccagggagccggguggucccuccgggagaccgcuugccugggaaagucuuaugcccaaauguggcagcugauguacuuucacagacgcgaccuccggcuggcggccaacgcuauuuguagcgccgugccugucgauugggugcccacguccagaacaaccuggagcauccaugcccaccaucaguggaugacaaccgaagacaugcuuucuguuuggaaucgcguguggauugaggaaaacccguggauggaggauaaaacgcacaucuccagcuggggcgacgucccuuaucuggggaagcgggaagaccaauggugcggaucucucaucggccugaccgcuagagccacaugggcgaccaauauucagguggcuaucaaccaggugcggagacuucuggggaaugagaacuaccucgauuacaugacaagcaugaaacgcuucaagaaugaguccgaccccgaaggcgcccugugguga

SEQ ID NO: 19163 - RNA, 9879 nt, Artificial Sequence
  derived and/or modified CDS sequence (opt5) from DENV-1__HM181964__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagagcaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuaccccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugcgggggaugagcuaugugauguguaccggcucuuucaagcucgagaaagaagucgcugagacccagcacggaacagugcugguucagauuaaguacgagggcaccgacgccccgugcaagaucccuuucuccacacaagaugaaaaaggggugacgcagaacggaagacugaucaccgcgaaucccauugucacagacaaggagaaaccugugaacaucgaagcugagccccccuuuggcgagagcuauauugugaucggggccggagaaaaggcccuuaaacucucuugguucaagaagggcagcuccauugggaaaauguuugaggcuaccgcccgcggcgcucggagaauggccauccugggagauacagcgugggacuucggcucuaucgggggaguuuuuaccagcgucggcaagcuggugcaucagauuuucgggacggccuacggagugcucuuuuccggcgucagcuggaccaugaaaaucgggauuggcgugcugcuuacauggcugggacucaauucucgcuccaccagccugucuaugacauguaucgcuguuggccuggugacccuuuaccucggggucauggugcaggccgauuccggaugcguuauuaacuggaagggccgggaacugaaaugugggagcggaaucuucgugacaaaugagguccacaccuggacggaacaauauaaguuucaggcugacuccccuaagagacugucugccgcgauuggcaaagccugggaggagggggugugcggcauccgcagcgcuacacggcucgaaaacaucauguggaagcagauuuccaacgagcugaaucauauccuucuggaaaacgacaugaaauucaccguuguggucggagauguggccggcauucucgcucaggggaagaaaaugaucagaccgcaacccauggaguacaaguauucuuggaaaagcuggggaaaggccaagauuaucggcgccgacgugcagaauaccacauuuaucauugaugggccuaacacccccgaauguccugacgaucagcgcgcuuggaauaucugggaggucgaggacuacggauucggcauuuuuacgacaaacaucuggcugaaacugcgggauuccuauacccagguuugcgaccacagacuuaugagcgcggccauuaaggauucuaaagcugugcacgccgacaugggcuacuggaucgaauccgagaagaaugaaacauggaaacucgcccgcgcuagcuucaucgaggugaagaccuguauuuggcccaagucucauacacugugguccaacgggguccuggaaagcgagaugaucauuccgaaaaucuauggaggcccuauuucucaacacaauuaccggcccggguacuucacccagacggccggaccuuggcaucucggcaagcuggagcuugauuuugaccugugcgaagggaccacagugguuguggaugagcacugcggaaacagaggccccagccuccggaccacaaccgucacgggcaaaaucauccacgaaugguguugccgcuccuguacacugccuccccugagauuccggggggaggacggaugcugguauggcauggagauuagaccggugaaggaaaaagaggaaaaucuuguuaagagcauggugucugcgggguccggagaggucgacagcuuuucccucggccugcuguguaucucuauuaugaucgaagaggugaugcgcagccggugguccagaaagaugcucaugaccgggacacuggcuguuuucuuucuucugauuaugggacagcucaccuggaacgaucugauccgccugugcauuauggugggcgccaaugccucugacagaaugggcauggggaccacauaccuugcucugauggccacguucaaaaugcggccuauguuugcggucggacuccuguuccgcagacucaccagccgggaggugcugcuucugacaaucggccucucccugguggcuucugucgaacugcccaacagccuugaggaacugggggauggacucgccaugggcaucaugauucugaagcuccugaccgacuuucaaucccaucagcuuugggccacacugcucagccugaccuucaucaaaacgacauuuucucugcacugugcuuggaagaccauggccaugguucuuuccauugugagccuguucccccucugccugucuaccacaucccagaaaaccacauggcucccugugcugcuugggagccugggauguaagccgcugacgauguuucucaucgcugagaauaagauuuggggccgcagaucuuggccccugaacgaaggcaucauggccgucgggaucguguccauucuucugagcucccuccugaaaaacgauguuccucucgcgggaccccugaucgccggcgggaugcuuauugcuugcuaugugaucagcggaucuagcgccgaccugucccuggagaaggcugccgaggucucuugggaagaggaagccgagcauagcggcgcuucccacaauauucucguggaaguucaggaugacgggaccaugaaaaucaaggaugaggagcgggacgauacacugaccauccuucugaaagcgacacuccuggccgugucuggagucuacccucucagcauucccgcuacccuguucgugugguauuucuggcaaaagaaaaagcagcgcuccggcguccuuugggacacgccuucucccccggaaguggagagagccguucuggaugacggcaucuaccggauuaugcagcgcgggcugcucggaagaagccaggugggcgucgggguguuucaagaaaacguuuuccauaccauguggcacgugacacggggagccguccugauguaucagggcaagagacuugagccuuccugggcuagcgugaaaaaggaccugaucucuuacgggggaggcuggcgccuccagggcuccuggaauaccggggaggaagugcagguuauugccgucgagcccggaaaaaacccuaagaaugugcaaacagcgcccggcaccuuuaaaacaccggaaggggaggugggagcuaucgcccuggauuucaagccuggcacgagcgggucucccauugucaaccgggaaggaaagaucgugggccucuacggcaaugggguugugaccacauccggaaccuaugucagcgccaucgcucaggccaaagcgucccaggagggcccucugcccgagauugaagacgagguguuuagaaagcgcaaccuuaccaucauggaucugcaccccgggucuggaaaaacacggagauaccugccugcuauuguucgcgaagccaucaagcggaaacucagaacgcugauucuugccccgacccgcguggucgcuagcgagauggccgaagcucugaagggcaugcccauccgguaucaaacaaccgccgugaaguccgagcauacagggaaagagaucguugaccucaugugucacgcgaccuucacgaugagacugcugagcccugugcggguccccaauuacaacaugauuaucauggaugaagcccauuuuacagacccuucuuccauugcugcccgcggcuauaucagcaccagagugggaaugggcgaggcugccgccauuuucaugaccgcuacacccccugggucuguggaagcguuuccgcucagcaaugccgucauccaggaugaggaacgggacauccccgagcgcuccuggaacucuggauacgaguggauuaccgauuucccuggcaagacaguuugguuugugcccagcaucaaauccgggaaugacauugcuaacugccuuagaaagaauggaaaacgggugauccagcugucuagaaagaccuucgauacggaauaucagaagacaaaaaacaacgacugggacuacgucgugaccacagauauuagcgagaugggcgccaauuuccgcgccgaccggguuaucgauccuagacgcugccugaagcccgugauucucaaagacgggccggaacgggucauccuggcuggcccuaugcccgugaccguugccuccgcggcucaaagacgcggacggaucggcagaaaccacaauaaggagggggaucaguacauuuauaugggacagccccuuaacaaugacgaggaucaugcccacuggacggaagccaaaaugcugcucgacaacaucaauaccccugagggcauuauccccgcucuguuugaaccugagcgcgaaaagagcgccgcgauugauggggaguacagacugcggggagaggcccgcaagacauucguggaacucaugagacggggcgaccuuccggucuggcugucuuauaaaguggcuuccgagggguuucaguacagcgaucgcagaugguguuucgacggcgaacggaacaaucaaguccuggaggaaaacauggauguggagaucuggaccaaggagggagaaagaaaaaagcuccgcccccgguggcuggacgccagaacauauuccgacccucuugcucugcgcgaguuuaaagaauucgccgcuggccggagaucuguuagcggggaucucauccuggagauuggaaagcugccccagcaccucacccagcgggcccagaaugcgcuugacaaccuggugaugcugcauaauuccgaacaaggcgggcgcgccuacagacacgcuauggaggagcucccugauacaaucgaaacccugaugcuucuggcccucauugcugugcugacgggaggcgucacacuguuuuuccucucuggccgggggcuuggaaaaaccagcaucggccugcugugcguuauggccuccagcgugcuccuguggauggccucuguggagccccauuggauugcugcguccaucauccuugaauuuuuccugaugguccuccugauuccggagccugacaagcagcgcaccccccaggauaaccagcuggccuaugugguuaucgggcuccuuuuuaugauucugacaguggcugccaaugagaugggacugcucgaaaccacaaagaaagaccugggcaucgggcacgucgccguggagaaccaccaucacgcugccaugcuugaugucgaccugcauccugcgagcgccuggacgcucuacgcuguggccaccacaauuaucacccccaugaugagacacacaauugaaaacaccacggcuaauaucucucugaccgccaucgcgaaccaagccgcuauucugaugggacucgauaagggcuggccuaucuccaaaauggacauuggcguuccccuucuggcccugggguguuacagccaggugaauccgcucacacugaccgcugccguccuuaugcugguggcucauuaugccaucauuggaccuggccuccaggcgaaggccacacgggaggcucaaaaacgcaccgccgcugggaucaugaagaaccccacgguugauggaaucguggccauugaccuggaucccgucguguacgacgccaaguucgaaaaacagcugggccagaucaugcuccuuauucugugcacaucucagauccugcucaugagaaccacaugggcgcugugugagagcauuacccuugcuaccgggccucugacaacgcucugggagggauccccgggcaaguuuuggaauaccacaaucgccgugucuauggcuaacaucuuccggggcagcuaucuggccggggccggacuggcuuucucccucaugaaaagccuuggcgggggacgcagaggcaccggggcccaaggagaaacacugggcgagaaguggaaacggcagcugaaucagcucuccaagucugaauuuaacaccuacaagagaagcggcauuauggagguugaccgcuccgaagcgaaagaggggcugaagcggggagagacgacaaaacacgccgucucuagaggcaccgcuaagcuucgcugguucguggaacggaaucuggugaaacccgaggggaaggucaucgaucucggaugcggcagagggggauggagcuauuacugugccggccugaagaaaguuaccgaagugaagggcuauacaaaagggggaccuggccacgaggaacccauuccuauggcuaccuacggguggaaccuggugaagcuccauuccggaaaagacgucuuuuucauccccccugagaagugcgauacacuucugugugacauuggcgagucuagcccgaaucccacgaucgaagaggggcgcacccugcgggugcucaaaaugguugaaccuuggcugagaggaaaccaguuuugcauuaagauccuuaaucccuacaugccuuccguggucgagacacuggagcaaaugcagcgcaagcacggcggcaugcucgugcggaacccccugagcagaaauucuacccaugaaauguauuggguuuccugugggacaggaaacaucgugagcgccgucaauaugaccucucgcaugcugcucaaccgguucacgauggcgcacagaaaaccgaccuacgagcgcgauguggaccugggcgccgggacaagacacguggcugucgaaccugagguugccaaccuugauauuaucggacagcggauugaaaauaucaagcaugagcacaaauccaccuggcauuaugacgaggauaaccccuacaagacaugggcuuaucacggcagcuacgaagugaaacccucuggguccgccagcuccauggugaauggagucgugaagcugcucaccaagccuugggacguuauucccauggugacacagaucgcuaugaccgauacgacaccuuuuggccaacagcgcgucuucaaagagaagguggacaccagaaccccgaaagccaagcggggcacagcgcagaucauggaaguuacggccaaauggcuguggggguuucuuagcagaaacaagaagccccggauuugcacccgcgaggaauucacaagaaaagugcggucuaaugcugccaucggagcugucuuuguggacgagaaccaauggaauagcgccaaggaggccguugaagaugagcgcuucugggaccuggugcauagagaacgggagcuccacaaacagggcaagugcgcgaccugugucuauaacaugauggggaaacgcgaaaagaagcugggagaguuuggcaaagcuaagggguccagagccauuugguacauguggcugggcgcccgguuccucgaguucgaagcucugggauuuaugaaugaggaucacugguucucucgcgaaaacagccuuuccggcguggagggggagggacugcauaaacucggcuacauccugagagacauuucuaagaucccugggggaaauauguaugccgaugacacagcuggcugggauacccggaucacagaagacgaucuucagaacgaggcccgcauuaccgacaucauggaacccgagcacgcgcugcucgccaaaagcauuuuuaagcugacguaccagaauaaagucgugagaguucaacggccugcuaagaacgggaccgugauggaugucaucucccgcagagaccagcggggcucuggacaggugggcacauaugggcugaauaccuucacaaacauggaagcccagcucauuagacaaauggagagcgagggaaucuuuucccccagcgaacuggagaccccgaaccuugcugaacgcgugcuggauuggcucgagaaguacggcguugaacggcugaaaagaauggccaucucuggggacgacugcguggucaagccuauugaugaccgcuucgcgacggcccuuacagcucugaaugauaugggaaaagugcggaaggacaucccccagugggagccuuccaaaggcuggaacgauuggcagcagguucccuuuuguagccaucacuuccaccaacucauuaugaaggacgggagagagaucguggucccuugccgcaaucaggaugaacuggugggccgggccagagucucucagggagcuggcuggucccugcgcgagaccgccugucucgggaagagcuaugcucagauguggcaacugauguacuuucaucggagagaccuucgccuggccgcgaacgccauuugcuccgcugugcccguugauuggaucccgacaucucggaccacguggagcauucacgcccaucaccaguggaugaccacagaagacaugcucuccguguggaauagagucuggaucgaggaaaacccuuggauggaggauaaaacccauaucagcucuuggggagacgugcccuaucugggcaagcgggaggaccaguggugugggucccuuauuggacugacagccagagcuaccugggccacaaauauccaaguugcgauuaaccaggugcgccggcucaucggcaaugaaaacuaccuggauuacaugaccagcaugaaaagauucaagaaugagucugaccccgaaggggcucugugguga

SEQ ID NO: 19164 - RNA, 9879 nt, Artificial Sequence
  derived and/or modified CDS sequence (opt5) from DENV-1__HM181966__SS-prME
agcgugaccaugcugcucaugcugaugcccaccgcccuugcuuuccaccugacgacccggggcggggagccucauaugaucgugacaaagcaggaacggggaaagucccuccuguuuaagaccucuguuggcgugaauaugugcacacuuauugccauggaccugggggagcucugugaagauaccaugacauacaagugccccagaaucaccgaggccgaacccgacgauguggacuguuggugcaaugcuacggauaccugggucacauauggaaccuguagccaaacaggcgagcacagacgggacaagcgcuccguggcccuggccccucauguugggcugggacucgagaccagaacggaaacauggaugucuagcgagggcgcuuggaaacagauucagcggguggaaaccugggcccugcgccaccccggcuucacagucaucgcucuuuuucuggcccaugcgauugggaccuccaucacccagaagggaaucauuuucauccuccugaugcuugugacaccuucuauggccaugagaugcguuggcauugggagccgggauuuuguggagggacuguccggcgcuacgugggucgacguggugcucgagcacgggagcugugucaccacaauggccaaggauaaacccacccuggacaucgaacugcucaagacagagguuaccaacccugcugugcugcgcaaacuuugcauugaagccaagaucucuaauacgacaaccgauuccagauguccgacccaaggagaggcgacacugauggaagaacaagacgccaacuucgugugccggcgcaccuuugucgauagaggcuggggcaauggguguggacucuucggcaaagggagccugauuacaugcgcuaaguuuaagugcgugacgaaacuugagggaaagaucguucaguacgaaaaccugaaauauucugugaucgucaccgugcacacaggcgaccagcaucaaguugggaaugaguccaccgaacacggaacaaccgccacgauuacaccccaggcuccuacaagcgagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggccuccaccucucaagagacauggaaucgccaggaccugcucgugaccuucaaaaccgcucacgcgaagaagcaggaagucgugguucugggaagccaagagggcgccaugcacacagcucugacgggggccaccgaaauucagacauccggaaccacaaccaucuuugccggccaucucaaaugcagacugaagauggauaaacuuacgcugaaggggaugagcuaugugauguguacaggcucuuucaaacucgagaaggaagucgcugagacccagcacggaaccgugcugguucagauuaaguacgagggcacagacgccccgugcaaaaucccuuucuccacccuggaugaaaagggggugacacaaaacggacggcuuaucacggcgaaucccauugucaccgacaaagagaagccugugaacaucgaagcugagccgcccuuuggcgagagcuauauugugaucggggccggagaaaaagcccucaagcugucuugguucaagaaaggcagcuccauugggaagauguuugaggcuacagccagaggcgcucgccggauggccauccugggagauaccgcgugggacuucggcucuaucgggggaguuuuuacaagcgucggcaaacucgugcaucagauuuucgggaccgccuacggagugcuguuuuccggcgucagcuggacgaugaagaucgggauuggcgugcuucugaccuggcucggacucaauucuagauccacaagccugucuaugaccuguaucgcuguuggccuugugacacucuaccugggggucauggugcaggccgauuccggaugcguuauuaacuggaaaggccgcgaacugaagugugggagcggaaucuucgugaccaaugagguccacacauggaccgaacaguauaaguuucaagcugacuccccuaaacggcucucugccgcgauuggcaaggccugggaggagggggugugcggcaucagaagcgcuacgcgccuggaaaacaucauguggaaacagauuuccaacgagcuuaaucauauccugcucgaaaacgacaugaaguucacaguuguggucggagauguggugggcauucuggcccaggggaaaaagaugauccggccgcagcccauggagcacaaauacucuuggaaaagcuggggaaaggcuaagauuaucggcgccgacguccaaaauaccaccuuuaucauugaugggccuaacacacccgaauguccugacgaucagagagccuggaauaucugggagguugaggacuauggauucggcauuuuuaccacgaacaucuggcugaaacuucgcgauuccuacacacaggugugcgaccaccggcucaugagcgcugcgauuaaagauucuaaggccgugcaugcugacaugggcuauuggaucgaauccgagaaaaaugaaaccuggaagcuggccagagccagcuucaucgaggucaagacauguauuuggcccaaaucucacacccugugguccaacggggugcucgaaagcgagaugaucauuccgaagaucuacggaggcccuauuucucagcauaauuaucgccccggguacuucacacaaaccgcuggaccuuggcaccugggcaaacuugagcuggauuuugaccucugcgaagggacgaccguuguggucgaugagcacugcggaaaccggggccccagccugagaacaaccacagugaccggcaagaucauccaugaaugguguugccgguccuguacgcugccuccccuucgcuucaaaggggaggacggaugcugguacggcauggagauuagaccgguuaaggaaaaggaggaaaaucucgugaaaagcauggucucugccggguccggagagguggacagcuuuucccugggccugcucuguaucucuauuaugaucgaagagguuaugcggagcagauggucccgcaagaugcugaugacagggacccuugcgguguuccugcuccugauuaugggacagcugacauggaacgaucuuauccggcugugcauuauggucggcgcuaaugccucugacagaaugggcauggggaccaccuaucucgcccugaucgcuacauuuaaaaugcgcccuauguucgccgugggacuccuguuuagacggcuuacgagccgcgaggugcugcuccugaccaucggccugucccuugucgcgucuguugaacugcccaacagccucgaggaacugggggauggacucgcuaugggcauuaugauccugaaacuucugacagacuuccagucccaccaacucugggccacccugcugagcuuuacauucauuaaaaccacgcuuucucugcauuacgccuggaagacaauggcuauggugcucuccaucgugagccuguuuccccucugucugucuaccaccucccagaagacaaccuggcuuccuguccugcuggggagccucggaugcaaaccgcugacaauguuccuuauugccgagaauaagaucuggggcagaaaaucuuggccccugaacgaaggcaucauggcuguggggguuguguccauucuccugagcucccuccugaagaacgaugucccucuugccggaccccugaucgcgggcgggaugcugauugccuguuaugugaucagcggaucuagcgcugaccucucccuggagaaagccgcugagguuucuugggaagaggaagccgagcacagcggcgccucccauaauauucuuguggaaguccaggaugacgggacgaugaagaucaaagaugaggagcgggacgauacccugacaauccuccugaaggcuacccuccuggcggugucuggagucuacccucuuagcauucccgccacacuguuugugugguauuucuggcagaagaaaaagcaacgcuccggcguucugugggacaccccuucucccccgaaaguggaaagagcuguccucgaugacggcaucuaccggauuaugcagcgcgggcugcuuggaagaagccaggugggcguugggguguuccaggagaacgucuuucacacgauguggcacgugacccggggagccgugcugauguaucaaggcaagcgccucgaaccuuccugggccagcguuaaaaaggaccugaucucuuacgggggaggcuggagacuccagggcuccuggaauacaggggaggagguccaggugauugcuguggaacccggaaagaacccuaaaaauguccagaccgcccccggcacauucaagaccagcgagggggaagugggagcgaucgcucuggauuuuaaaccgggcacaucuggguccccuauuguuaaccgggagggaaagaucgugggccuuuacggcaauggggucgugacgaccagcggaacauauguuuccgccaucgcccaagcuaaagccucucaggaaggcccccugccugagauugaggacgaaguguucagaaagcgcaaccugaccaucauggaucuccaucccgggagcggaaagacccggagauaccugcccgcgauuguccgcgaggcuaucaaacggaaacuuagaacacugauucucgccccuacgcgcgugguugccuccgaaauggcugaggcccugaaaggcaugccgauccgguaucagaccacagcugucaagagcgaacacaccgggaaagagaucgucgaccugaugugccaugccacauuuaccaugagacuccuuucucccgugcgcgugccuaauuacaacaugauuaucauggaugaggcgcacuucacggaccccuccagcauugccgcucggggcuauaucucuacaagagucggaaugggcgaagccgcugccauuuuuaugaccgccaccccucccgggagcguugaggcuuucccucaauccaaugcggugauccaggaugaagaacgggacaucccggaacgcucuuggaacagcggauacgaguggauuacagauuuucccggcaagaccgugugguucgucccuuccaucaagucugggaaugacauugccaacugucugcgcaagaauggaaagcgggugauccagcugagccgcaaaacauuugauaccgaguaucagaagacgaaaaacaacgacugggacuacguugugacaaccgauauuuccgaaaugggcgcuaauuucagagccgaccgggucaucgaucccagacgcugccucaagccugugauucugaaggacgggcccgagcggguuauccuugccggcccgaugccugugacagucgcuagcgccgcgcaaagacgcggacggaucggcagaaaccauaauaaagaaggggaucaguacauuuauaugggacagccccugaacaaugacgaggaucacgcucacuggaccgaggccaagaugcuccuggacaacaucaauacgcccgaaggcauuaucccugcccuguucgagcccgaacgcgagaaaucugcugccauugauggggaauaccggcucagaggagaggcgcgcaagaccuuuguggagcuuaugagacggggcgaccugccugucuggcuguccuauaaaguggccagcgaaggguuccaguacuccgaucgcagauggugcuuugacggcgagcggaacaaucaaguucucgaagagaacauggauguggaaaucuggacaaaggagggagagcgcaaaaagcugagaccgcgguggcuugacgcuagaaccuauucugacccccuggcccuccgcgaguucaaggaguuugcugccggccggagaagcguguccggggaucugauccuggaaauuggaaaacucccucagcaucuuacacagcgcgcucagaaugcccuggacaaccuggucaugcuccacaauucugagcaaggcgggcgggcguacagacaugccauggaggaacugcccgauaccaucgagacacuuaugcugcucgcucugauugccguucugaccggaggcgugacgcuguucuuucuuagcggccgggggcugggaaagacauccaucggccugcucugugugauggcuagcucugcccugcuuuggauggccuccgucgaaccucacuggauugcugcgagcaucauccuggaguucuuucucauggugcugcugauucccgaaccggaccgccagagaaccccucaggauaaccagcucgccuauguugugaucgggcuucuguucaugauucugaccgucgcugccaaugagaugggacuccuggagacaaccaaaaaggaccuuggcaucgggcacguggccgucgaaaaccaucaccaugcuacaaugcuggauguggaccuccaccccgccucugcguggacgcuguacgccguugcuaccacaauuaucaccccuaugaugcggcauacaauugagaacaccacggccaauaucucccugaccgcuaucgccaaccaagcggccauucucaugggacuugauaaaggcuggcccaucagcaagauggacauuggcgugccucugcuggcucucgggugcuacucucaggucaauccccugacacuuaccgccgcugugcugaugcucguugcccacuaugcuaucauuggaccgggccugcaggccaaggcgacacgcgaagcccagaagcggaccgcugccgggaucaugaagaacccuacgguggauggaaucgucgcuauugaccuggaucccgugguguacgacgccaaauuugagaagcagcucggccagaucaugcuucugauucuguguacaagccagauccuccugaugcggaccacaugggcccuuugcgaauccauuacccuggcgaccgggccccucacaacgcugugggagggaucuccuggcaaauucuggaauaccacaaucgcuguuagcauggccaacaucuuucgcggcuccuaucuggcuggggccggacucgccuucagccuuaugaagucccugggcgggggaagacggggcaccggggcucaaggagagacacugggcgaaaaguggaaacgccagcucaaucagcugucuaagagcgaguucaacauuuacaaaagauccggcaucauggaagucgaccggucugaggccaaggaagggcuuaaaagaggagagaccacgcgccacgcggugagccggggcacagccaagcugagaugguuuguggagcgcaaucucgucaagccggaagggaaaguuauugaucugggauguggcagaggcgggugguccuauuacugcgcugggcugaagaaagugaccgaggugaagggcuauaccaaagggggacccggccaugaggaaccuauccccauggccacauacggguggaaccucgucaaacuucacucuggaaaagacguguucuuuaccccucccgaaaagugugauacacugcugugcgacauuggcgagagcuccccuaauccgacgaucgaggaagggagaacccuccgcguucugaagaugguggagcccuggcuucggggaaaccaguucuguauuaaaauccugaauccuuacaugcccagcgucguggaaacacucgagcaaaugcagagaaagcauggcggcaugcugguucgcaacccucugucuagaaauuccacccacgagauguauugggugagcugcgggacaggaaacaucgucucugcugugaauaugaccuccagaaugcuccugaaccgcuuuacgauggcccaccggaaacccaccuacgaaagagauguggaccuuggcgcggggacacgccaugucgccguugagccggaaguggcuaaccuggauauuaucggacagagaauugagaauaucaagcacgaacauaaaagcaccuggcacuaugacgaggauaacccuuacaagacaugggccuaucauggcucuuacgaggugaagcccuccgggagcgcuuccagcauggucaauggagugguuaaacuccugaccaagcccugggacgugauuccuauggucacacagaucgccaugaccgauacgacacccuucggccaacagcggguguuuaaagaaaagguugacacccgcaccccuaaagcuaagagaggcacagcccagaucauggaggugacggcgcgguggcuuuggggguuccugucuagaaacaagaaaccgcggauuuguacccgcgaagaguuuacaagaaagguccggagcaaugccgcuaucggagccguguucguugacgaaaaccaauggaacuccgcuaaagaggccguggaggaugaacgcuuuugggaccucguccagaaggagagagaacugcacaaacagggcaagugcgcgaccugcguguauaacaugauggggaagcgggagaaaaagcugggagaguucggcaaagcgaaggggucucgcgcuauuugguacauguggcucggcgccagauuucuggaguucgaggcccuuggauucaugaaugaagaucacugguuuagccgggagaacucccugucuggcgucgaaggggagggacuccauaaacugggcuacauccuucgcgacauuagcaagauccccgggggaaauauguaugcugaugacacagccggcugggauaccagaaucacagaggacgaucugcagaacgaagcuaaaauuaccgacaucauggagccugaacacgcccuccuggcgacguccauuuucaagcugaccuaccaaaauaaggugguucgggugcagcgccccgccaaaaacgggacagucauggaugugaucucuagacgggaccagcgcggcagcggacaggugggcaccuaugggcucaauacauuuaccaacauggaggcucaacugauuagacagauggaauccgagggaaucuuccuuccuagcgagcuggaaacgcccaaccucgccgagcggguucuggauuggcuugaaaaguacggcguggagagacugaaacgcauggcuaucucuggggacgacugugucgugaagccgauugaugaccgguuugccacagcgcucaccgcccugaaugauaugggaaaaguuagaaaggacaucccucagugggaacccuccaagggcuggaacgauuggcagcaagugccuuucugcagccaucacuuucaccagcuggucaugaaagacgggcgcgagauugugguccccugucggaaucaggaugagcucgugggcagagcucgcguuucucagggagccggcuggucccugcgggaaacagcuugccuuggaaagagcuaugcccaaauguggcagcugauguacuuccauagacgcgaccuccggcuggcugccaacgcgaucuguuccgccgugccugucgauugggugcccaccucuagaacgaccuggagcauucacgcucaucaccaguggaugacaaccgaggacaugcuuuccguuuggaaucgcguguggaucgaagagaacccguggauggaagauaaaacacaugucagcucuuggggagacgugccuuaucugggcaagcgggaggaccaauggugcgggucccucauuggacugaccgccagagccacaugggcuagcaauauccagguggccaucaaccagguucggagacugauuggcaaugagaacuaccucgauuacaugaccucuaugaaacgcuuuaagaaugaaggggaccccgagggcgcgcugugguga

SEQ ID NO: 19165 - RNA, 9879 nt, Artificial Sequence
  derived and/or modified CDS sequence (opt5) from DENV-1__GU131721__SS-prME
uccgugaccaugcugcucaugcugaugcccacagcccuugcuuuccaccugacgaccagaggcggggaaccucauaugaucguguccaagcaggaacggggaaaaucucuccuguuuaagacaagcgccggcguuaauaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuuccugacacaagaugaaaagggggugacgcagaacggacggcuuaucaccgcgaaucccauugucacagacaaagagaagccugugaacaucgaagcugagccgcccuuuggcgaguccuauauuaucauuggggccggagaaaaagcccucaagcugagcugguucaagaaaggcucuagcaucgggaagauguuugaggcuaccgccagaggcgcucgccggauggccauccugggagauacagcgugggacuucggcuccauugggggaguguuuaccucugccggcaaacucguucaucagaucuucgggacggcuuacggaguccuguuuagcggcguguccuggaccaugaagauugggaucggcgugcuucugacauggcucggacugaauagcagaucuaccucccugagcaugacauguauugccgucggccuugugacccucuaccuggggguuauggugcaggcugauucuggaugcgucaucaacuggaaaggccgcgaacugaaguguggguccggaauuuucgugacaaaugagguucacaccuggacggaacaauauaaguuucaggccgacagcccuaaacggcucuccgcggccaucggcaaggcuugggaggagggggugugcggcaucagaucugccacacgccuggaaaacauuauguggaaacagaucagcaacgagcuuaaucauauucugcucgaaaacgacaugaaguucaccgucgugguuggagauguggcuggcauccuggcccaggggaaaaagaugauucggccgcaacccauggaguacaaauauuccuggaagucuuggggaaaggccaaaaucaucggcgcugacguccagaauaccacauuuauuaucgaugggccuaacacccccgaauguccugacgaucagagagcguggaauauuugggagguggaggacuacggauucggcaucuuuacgacaaacauuuggcugaaacuucgcgauagcuauacccaggugugcgaccaccggcucauguccgccgcuaucaaagauagcaaggccguccacgccgacaugggcuacuggaucgaaucugagaaaaaugaaacauggaagcuggcuagagccuccuucauugagguuaagaccuguaucuggcccaaaagccauacacuguggucuaacggggugcucgaauccgagaugauugugccgaagaucuauggaggcccuauuagccaacacaauuaccgccccggguacuucacccagacggcgggaccuuggcaucugggcaaacuugagcuggauuuugaccucugcgaagggaccacagucgugguugaugagcacugcggaaaccggggccccucucugagaaccacaaccgugacgggcaagaucauccacgaaugguguugccggagcuguacacugccuccccuucgcuucagaggggaggacggaugcugguauggcauggagauucggccggucaaagaaaaggaggaaaaucucgugaaguccaugguuagcgcugggucuggagagguggacuccuuuagccugggccugcucuguaucuccauuaucauugaagaggucaugagaucucgcuggagccggaaaaugcugaugaccgggacacuugccguguucuuucugcucaucaugggacagcugaccuggaacgaucugauuagacuuugcaucaugguuggcgccaaugcuuccgaccgcaugggcauggggaccacauaccuggcccucauggcgacguucaagaugagaccuauguuugcugugggacuccuguuccggcgccugaccucuagagagguccuucugcucacaaucggccugagccugguggccuccguggaacuucccaacucucuggaggaacucggggauggacuggccaugggcauuaugauccucaaacugcuuaccgacuuucaaagccaucagcugugggcuacacuccugucccugaccuucauuaagacgacauuuagccuucacuaugccuggaaaaccauggcuaugguccugucuaucguuucccucuucccccugugucucagcaccacaucucagaagaccacauggcugccugugcuucuggggucccugggaugcaagccgcucacgauguuucugauugccgagaauaaaaucuggggccggcgcagcuggccccuuaacgaaggcaucauggcgguggggauugucucuauccugcucuccagccugcucaagaacgaugugccucuggccggaccccuuauugcuggcgggaugcugaucgccuguuacguuauuuccggaagcucugcugaccugagccucgagaaagccgccgagguguccugggaagaggaagcugagcauucuggcgcgagccacaauauccuggucgaagugcaggaugacgggaccaugaagaucaaagaugaggagagagacgauacacuuaccauucugcucaaggccacacugcucgcuguuuccggaguguauccucugucuauccccgccacccuuuucgucugguacuucuggcagaagaagaagcagcggagcggcgugcugugggacacgccuagcccucccgaagucgagcgcgccgugcuggaugacggcauuuauagaaucaugcagcgggggcuccugggacgcucucagguuggcgugggggucuuucaagaaaacguguuccauaccauguggcacguuacaagaggagcugugcuuauguaccagggcaaacggcuggagcccagcugggccuccgucaagaaagaccucauuagcuacgggggaggcuggagacugcagggcucuuggaauaccggggaggaaguccaggugaucgcgguugagcccggaaagaacccuaaaaauguccaaacagcucccggcaccuuuaagacaccggaaggggaggugggagccauugcccucgauuucaagccuggcacguccgggagccccaucgugaaccgcgaaggaaaaaucgucggccuguauggcaauggggugguuaccacaucuggaaccuacguguccgcuauugcccaggcgaaggcuagccaggagggcccucuucccgagaucgaagacgaggucuuucggaaaagaaaccugaccauuauggaucugcaccccggguccggaaagacacgccgguaucucccugccaucgugagagaagccauuaaacgcaagcugcggacgcuuauccuggcuccgaccagaguuguggccucugagauggcugaagcccucaagggcaugcccauccgcuaccaaacaaccgcggucaaaagcgagcauacagggaaggagauuguggaccugaugugccacgccaccuucacgaugcggcugcucuccccuguuagagugcccaauuauaacaugaucauuauggaugaagcucauuuuacagacccuagcucuaucgccgcucggggcuacauuuccacccgcgucggaaugggcgaggccgccgcuaucuucaugaccgcgacacccccugggagcguggaagccuuuccgcagucuaaugcugugauccaggaugaggaaagagacauucccgagcggagcuggaacuccggauaugaguggaucaccgauuucccuggcaaaacagucugguuuguucccucuauuaagagcgggaaugacaucgccaacugucuucgcaaaaauggaaagagagugauucagcugucccggaagaccuucgauacggaauaccagaagaccaagaacaacgacugggacuacguggucaccacagauaucucugagaugggcgccaauuucagagcugaccgcgugauugauccucggagaugccugaaacccguuauccucaaggacgggccggaacgcgugauccuggccggcccuaugcccgucaccguggcgagcgcugcccagcggagaggacgcauuggccggaaccacaauaaagagggggaucaguauaucuacaugggacagccccuuaacaaugacgaggaucaugcccacuggacggaagcuaagaugcugcucgacaacauuaauaccccugagggcaucauucccgcccuguuugaaccugagagagaaaaguccgcggccaucgauggggaguaucgccugagaggagaggcucggaaaacauucguugaacucaugcgcagaggcgaccuuccgguguggcugagcuacaaggucgccucugagggguuucaauauuccgaucggcgcuggugcuucgacggcgaaagaaacaaucaggugcuggaggaaaacauggaugucgagaucuggaccaaagagggagaacggaagaaacucagaccccgcuggcuggacgcucggacauacagcgacccucuugcccugagagaguuuaaggaguucgcugccggccgccgguccgugucuggggaucucauucuggagaucggaaaacugccccagcaccucacccagagagcgcaaaaugcccuugacaaccugguuaugcugcauaauagcgaacagggcgggcgggcuuaucgccacgccauggaggagcucccugauacaauugaaacccugaugcuucuggcucucaucgccgugcugacgggaggcgugacacuguuuuuccucuccggcagagggcuuggaaagaccucuauuggccugcugugugucauggccagcuccguucuccuguggauggcuagcguggagccccauuggaucgcggccucuaucauucuugaauuuuuccugauggugcuccugaucccggagccugaccggcagcgcacaccccaggauaaccaacuggcuuacgucgugauugggcuccuuuuuaugauccugacaguugccgccaaugagaugggacugcucgaaaccacaaagaaagaccugggcauugggcacguggcugucgagaaccaccaucacgccgcgaugcuugauguggaccugagaccugccuccgcuuggacgcucuacgccgucgcuaccacaaucauuacccccaugaugcggcauacaaucgaaaacaccacggccaauaucagccugaccgcgauugccaaccaggcugccauccugaugggacucgauaagggcuggccuauuucuaaaauggacaucggcgugccccuucuggcucuggggugcuauucccagguuaauccgcucacacugaccgccgcugugcuuaugcuggucgcccacuacgcgauuaucggaccuggccuccaagccaaggcuacacgcgaggcccagaaaagaaccgcugccgggaucaugaagaaccccacgguggauggaauuguugccaucgaccuggaucccguggucuaugacgcgaaguucgaaaaacagcugggccagauuaugcuccuuauccuguguacaagccaaauucugcucaugcggaccacaugggcucugugcgagucuaucacccuugccaccgggccucugacaacgcucugggagggaagcccgggcaaguuuuggaauaccacaaucgcuguguccauggccaacauuuuccgcggcucuuaccuggccggggcuggacuggccuucagccucaugaaaucccuuggcgggggaagacggggcaccggggcgcagggagaaacacugggcgagaaguggaaaagacagcugaaucagcucagcaaguccgaauuuaacaccuauaagcgcucuggcaucauggagguggaccggagcgaagccaaagaggggcugaagagaggagagacgacaaaacaugcuguuucccgcggcaccgccaaacuucggugguucgucgaaagaaaucuggugaaacccgaggggaaggugauugaucucggauguggccgcgggggauggucuuacuauugcgcuggccugaagaaagucaccgaaguuaagggcuacacaaaagggggaccuggccacgaggaacccaucccuauggccaccuacggguggaaccuggugaagcuccacagcggaaaagacguguuuuucauucccccugagaagugugauacacuucugugcgacaucggcgaguccucuccgaaucccacgauugaagaggggcggacccugagaguccucaaaaugguggaaccuuggcugcgcggaaaccaauuuuguaucaagauccuuaaucccuauaugccuagcguuguggagacacuggagcagaugcagcggaagcauggcggcaugcucgucagaaacccccugucccgcaauagcacccacgaaauguacugggugucuugcgggacaggaaacauuguuuccgcggugaauaugaccagccggaugcugcucaacagauucacgauggcccaucgcaaaccgaccuaugagagagaugucgaccugggcgcugggacacggcacguggccguggaaccugaggucgcuaaccuugauaucauuggacagcgcaucgaaaauauuaagcacgagcauaaaucuaccuggcacuacgacgaggauaaccccuauaagacaugggccuaccauggcuccuaugaaguuaaacccagcgggucugcuuccagcauggugaauggaguggucaagcugcucaccaagccuugggacgugauccccaugguuacacaaaucgccaugaccgauacgacaccuuuuggccagcagagaguguucaaagagaaggucgacacccggaccccgaaagcgaagagaggcacagcccaaauuauggaagugacggcuaaauggcuguggggguuucuuucccggaacaagaagccccgcaucuguaccagagaggaguucacacggaaaguucgcagcaaugccgcuauuggagccguguuugucgacgagaaccaguggaacucugccaaggaggcgguggaagaugagagauucugggaccugguucaccgggaacgcgagcuccauaaacagggcaagugcgcuaccugcguguacaacaugauggggaaaagagaaaagaagcugggagaguuuggcaaagccaaggggagccgggccaucugguacauguggcugggcgcucgcuuccucgaguucgaagcccugggauuuaugaaugaggaucacugguucuccagagaaaacucucuuagcggcgucgagggggagggacugcacaaacucggcuauauucugcgggacaucuccaagaucccugggggaaauauguacgcugaugacacagccggcugggauacccgcauuacagaagacgaucuucagaacgaggcgagaaucaccgacauuauggaacccgagcaugcccugcucgcuaaaucuaucuuuaagcugacguaucaaaauaaagugguccgggugcagcgcccugccaagaacgggaccguuauggaugugauuagcagacgggaccagagaggcuccggacaggucggcacauacgggcugaauaccuucacaaacauggaagcucaacucauccgccagauggagucugagggaaucuuuagccccuccgaacuggagaccccgaaccuugccgaacgggugcuggauuggcucgagaaguauggcguggaaagacugaaacgcauggcgauuagcggggacgacuguguugugaagccuaucgaugaccgguucgccacggcucuuacagcccugaaugauaugggaaaagucagaaaggacauuccccagugggagccuucuaaaggcuggaacgauuggcagcaagugcccuuuugcucccaccauuuccaccagcucaucaugaaggacgggcgcgagauuguugugccuugucggaaucaggaugaacuggucggcagagcucgcgugagccagggagccggcuggucucugcgggagaccgcuugccucgggaaguccuacgcccaaauguggcagcugauguauuuucacagacgcgaccuucggcuggcggccaacgcuaucuguagcgccguccccguggauuggauuccgacauccagaaccacguggucuauccaugcccaccaucaguggaugaccacagaagacaugcucagcguuuggaaucggguguggaucgaggaaaacccuuggauggaggauaaaacccacauuuccagcuggggagacguccccuaccugggcaagagagaggaccaauggugcgggucucuuaucggacugacagcucgcgccaccugggcgacaaauauucagguggcuaucaaccagguucggagacucauuggcaaugaaaacuaccuggauuauaugaccuccaugaaacgcuucaagaaugagggggaacccgagggcgcccugugguga

SEQ ID NO: 19166 - RNA, 9879 nt, Artificial Sequence
  derived and/or modified CDS sequence (opt5) from DENV-1__GU131723__SS-prME
agcgugaccaugcugcucaugcugaugcccacagcccuugcuuuccaccugacgaccagaggcggggaaccucauaugaucguguccaagcaggaacgggggaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggagcacaaauacucuuggaaaagcuggggaaaggccaagauuaucggcgccgacgugcagaauaccacauuuaucauugaugggccuaacacccccgaauguccugacgaucagagagcuuggaauaucugggagguggaggacuauggauucggcauuuuuacgacaaacaucuggcugaaacuucgcgauuccuacacccaggucugcgaccaccggcucaugagcgcggccauuaaagauucuaaggcuguucaugccgacaugggcuauuggaucgaauccgagaaaaaugaaacauggaagcuggccagagcuagcuucaucgaggugaagaccuguauuuggcccaaaucucacacacugugguccaacggggugcucgaaagcgagaugaucauuccgaagaucuacggaggcccuauuucucaacauaauuaucgccccggguacuucacccagacggccggaccuuggcaccugggcaaacuugagcuggauuuugaccucugcgaagggaccacagucgugguugaugagcacugcggaaaccggggccccagccugagaaccacaaccgugacgggcaagaucauccaugaaugguguugccgguccuguacacugccuccccuucgcuucagaggggaggacggaugcugguacggcauggagauucggccggucaaagaaaaggaggaaaaucucgucaagagcaugguuucugcgggguccggagagguggacagcuuuucccugggccugcucuguaucucuauuaugaucgaagaggucaugagaagccgcuggucccggaaaaugcugaugaccgggacacuugcuguguucuuucugcucauuguuggacagcugaccuggaacgaucugaucagacuuugcauuauggugggcgccaaugccucugaccgcaugggcauggggaccacauaucuggcucucauggccacguucaagaugagaccuauguuugcggucggacugcuguuccggcgccugaccagcagagaggugcuucugcucacaaucggccugucccugguggcuucugucgaacuucccaacagccuggaggaacucggggauggacuggccaugggcaucaugauucucaaacugcuuaccgacuuucaaucccaccagcugugggccacacuccugagccugaccuucaucaagacgacauuuucucuucauuacgcuuggaaaaccauggccaugguucuguccguggugagccucuucccccugugucucucuaccacaucccagaagaccacauggcugccuguccuucuggggagccugggaugcaagccgcucacgauguuucugauugcugagaauaaaaucuggggccggcgcucuuggccccuuaacgaaggcauuauggccguggggaucguuuccauccugcucagcucccugcucaagaacgaugugccucuggcgggaccccuuauugccggcgggaugcugaucgcuuguuaugucauuagcggaucuagcgccgaccugucccucgagaaagcugccgaggugucuugggaagaggaagccgagcacagcggcgcuucccauaauauccugguugaagugcaggaugacgggaccaugaagauuaaagaugaggagagagacgauacacuuaccauccugcucaaggcgacacugcucgccgucucuggaguguacccucugagcauccccgcuacccuuuucgucugguauuucuggcagaagaagaagcagcgguccggcgugcugugggacacgccuucucccccggaaguugagcgcgccgugcuggaugacggcauuuacagaaucaugcagcgggggcuccugggacgcagccaggucggcguggggguuuuucaagaaaacguguuccacaccauguggcacgucacaagaggagccgugcuuauguaucagggcaaacggcuggagccuuccugggcuagcgugaagaaagaccucauuucuuacgggggaggcuggagacugcagggcuccuggaauaccggggaggaaguucaggucaucgccguggagcccggaaagaacccuaaaaaugugcaaacagcgcccggcaccuuuaagacaccggaaggggaggucggagcuauugcccucgauuucaagccuggcacgagcgggucucccaucgugaaccgcgaaggaaaaauuguuggccuguacggcaaugggguggucaccacauccggaaccuaugugagcgccaucgcucaggccaaggcgucccaggagggcccucuucccgagaucgaagacgagguuuuucggaaaagaaaccugaccauuauggaucugcaucccgggucuggaaagacacgccgguaccucccugcuaucgugagagaagccauuaaacgcaagcugcggacgcuuauccuggccccgaccagagucguggcuagcgagauggccgaagcucucaagggcaugcccauucgcuaucaaacaaccgccguuaaauccgagcacacagggaaggagaucguggaccugaugugccaugcgaccuucacgaugcggcugcucagcccugucagagugcccaauuacaacaugaucauuauggaugaagcccacuuuacagacccuucuuccaucgcugcccggggcuauauuagcacccgcgugggaaugggcgaggcugccgccaucuucaugaccgcuacacccccugggucugucgaagcguuuccgcagagcaaugccguuauucaggaugaggaaagagacauccccgagcgguccuggaacucuggauacgaguggaucaccgauuucccuggcaaaacagugugguuugugcccagcauuaaguccgggaaugacaucgcuaacugucuucgcaaaaauggaaagagagucauucagcugucucggaagaccuucgauacggaauaucagaagaccaagaacaacgacugggacuacgugguuaccacagauaucagcgagaugggcgccaauuucagagccgaccgcgugauugauccucggagaugccugaaacccgucauccucaaggacgggccggaacgcgugauucuggcuggcccuaugcccguuaccguggccuccgcggcucagcggagaggacgcgucggccggaaccauaauaaagagggggaucaguacaucuauaugggacagccccuuaacaaugacgaggaucacgcccacuggacggaagccaagaugcugcucgacaacaucaauaccccugagggcauuauccccgcucuguuugaaccugagagagaaaagagcgccgcgauugauggggaguaccgccugagaggagaggcccggaaaacauucguggaacucaugcgcagaggcgaccuuccggucuggcugucuuauaagguggcuuccgagggguuucaauacagcgaucggcgcuggugcuucgacggcgaaagaaacaaucagguucuggaggaaaacauggauguggagaucuggaccaaagagggagaacggaagaaacucagaccccgcuggcuggacgcccggacauauuccgacccucuugcucugagagaguuuaaggaguucgccgcuggccgccggucugugagcggggaucucauucuggagaucggaaaacugccccagcaucucacccagagagcccaaaaugcgcuugacaaccuggucaugcugcacaauuccgaacagggcgggcgggccuaccgccaugcuauggaggagcucccugauacaaucgaaacccugaugcuucuggcccucauugcuguucugacgggaggcgugacacuguuuuuccucucuggcagagggcuuggaaagaccagcaucggccugcugugugugauggccuccagcguccuccuguggauggccucuguggagccccacuggauugcugcguccaucauucuugaauuuuuccugaugguucuccugaucccggagccugaccggcagcgcacaccccaggauaaccaacuggccuauguggucaucgggcuccuuuuuaugauucugacaguggcugccaaugagaugggacugcucgaaaccacaaagaaagaccugggcaucgggcacgucgccguggagaaccaucaccaugcugccaugcuugauguugaccugcacccugcgagcgccuggacgcucuacgcuguggccaccacaauuaucacccccaugaugagacauacaauugaaaacaccacggcuaauaucucucugaccgccauugcgaaccaggccgcuauccugaugggacucgauaagggcuggccuaucuccaaaauggacauuggcgucccccuucuggcccuggggugcuacagccaggugaauccgcucacacugaccgcugccguucuuaugcugguggcucacuaugccaucauuggaccuggccuccaagcgaaggccacacgggaggcucagaaacgcaccgccgcugggaucaugaagaaccccacggucgauggaauuguggccaucgaccuggaucccgugguuuacgacgccaaguucgaaaaacagcugggccagaucaugcuccuuauucuguguacaucucaaauccugcucaugagaaccacaugggcgcugugcgagagcauuacccuugcuaccgggccucugacaacgcucugggagggauccccgggcaaguuuuggaauaccacaaucgccgucucuauggcuaacauuuuccggggcagcuaucuggccggggccggacuggcuuucucccucaugaaaagccuuggcgggggacgcagaggcaccggggcccagggagaaacacugggcgagaaguggaaacggcagcugaaucagcucuccaagucugaauuuaacaccuacaagagaagcggcaucauggagguggaccgcuccgaagcgaaagaggggcugaagcggggagagacgacaaaacacgccgugucuagaggcaccgcuaaacuucgcugguucgucgaacggaaucugguuaaacccgaggggaaggugaucgaucucggauguggcagagggggauggagcuauuacugcgccggccugaagaaagugaccgaagucaagggcuauacaaaagggggaccuggccaugaggaacccauuccuauggcuaccuacggguggaaccuggugaagcuccacuccggaaaagacguguuuuucauucccccugagaagugugauacacuucugugcgacaucggcgagucuagcccgaaucccacgaucgaagaggggcgcacccugcggguucucaaaauggucgaaccuuggcugagaggaaaccaauuuuguauuaagauccuuaaucccuacaugccuuccgugguugagacacuggagcagaugcagcgcaagcauggcggcaugcucgugcggaacccccugagcagaaauucuacccacgaaauguauugggucuccugcgggacaggaaacauugugagcgccgugaauaugaccucucgcaugcugcucaaccgguucacgauggcgcacagaaaaccgaccuacgagcgcgaugucgaccugggcgccgggacaagacauguugcuguggaaccugagguggccaaccuugauaucaucggacagcggauugaaaauaucaagcacgagcauaaauccaccuggcacuaugacgaggauaaccccuacaagacaugggcuuaucauggcagcuacgaagucaaacccucuggguccgccagcuccauggugaauggaguugugaagcugcucaccaagccuugggacgucauucccauggugacacaaaucgcuaugaccgauacgacaccuuuuggccagcagcgcguuuucaaagagaagguggacaccagaaccccgaaagccaagcggggcacagcgcaaauuauggaagucacggccaaauggcuguggggguuucuuagcagaaacaagaagccccggaucuguacccgcgaggaguucacaagaaaagugcggucuaaugcugccaucggagcuguuuuuguggacgagaaccaguggaauagcgccaaggaggccgucgaagaugagcgcuucugggaccuggugcacagagaacgggagcuccacaaacagggcaagugcgcgaccugcgucuauaacaugauggggaaacgcgaaaagaagcugggagaguuuggcaaagcuaagggguccagagccauuugguacauguggcugggcgcccgguuccucgaguucgaagcucugggauuuaugaaugaggaucauugguucucucgcgaaaacagccuuuccggcguggagggggagggacugcacaaacucggcuacauccugagagacauuucuaagaucccugggggaaauauguaugccgaugacacagcuggcugggauacccggauuacagaagacgaucuucagaacgaggcccgcaucaccgacaucauggaacccgagcaugcgcugcucgccaaaagcauuuuuaagcugacguaccaaaauaaaguugugagaguccagcggccugcuaagaacgggaccgugauggaugugaucucccgcagagaccagcggggcucuggacagguuggcacauaugggcugaauaccuucacaaacauggaagcccaacucauuagacagauggagagcgagggaaucuuuucccccagcgaacuggagaccccgaaccuugcugaacgcgugcuggauuggcucgagaaguacggcgucgaacggcugaaaagaauggccauuucuggggacgacugugugguuaagccuaucgaugaccgcuucgcgacggcccuuacagcucugaaugauaugggaaaagugcggaaggacaucccccagugggagccuuccaaaggcuggaacgauuggcagcaaguccccuuuugcagccaccacuuccaucagcucauuaugaaggacgggagagagaucguggucccuugucgcaaucaggaugaacuggugggccgggccagaguuucucagggagcuggcuggucccugcgcgagaccgccugccucggaaagagcuaugcucaaauguggcagcugauguacuuucaccggagagaccuucgccuggccgcgaacgccauuuguuccgcugugcccgucgauuggaucccgacaucucggaccacguggagcauucaugcccaccaucaguggaugaccacagaagacaugcucuccguguggaauagaguuuggaucgaggaaaacccuuggauggaggauaaaacccacauuagcucuuggggagacgugcccuaucugggcaagcgggaggaccaauggugcgggucccuuaucggacugacagccagagcuaccugggccacaaauauccaggucgcgauuaaccaggugcgccggcucaucggcaaugaaaacuaccuggauuacaugaccagcaugaaaagauucaagaaugagucugaccccgaaggggcucugugguga

SEQ ID NO: 19167 - RNA, 9879 nt, Artificial Sequence
  derived and/or modified CDS sequence (opt5) from DENV-1__GU131725__SS-prME
agcgugaccaugcugcucaugcugaugcccaccgcccuugcuuuccaccugacgacccggggaggggaaccucauaugaucguguccaagcaggaacgggggaaaucucuccuguuuaagaccagcgccggcguuaauaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucuccgaaauggugcugcuuacgaugaaggagaaaagcuggcugguccauaagcagugguuucucgaucugccucuucccuggacauccggggcuucuaccagccaagagacauggaaccgccaggaccugcucgugaccuucaaaaccgcgcacgccaagaagcaggaagucgugguucugggaucccaagagggcgcuaugcacacagcccugacgggggccaccgaaauucagacaagcggaaccacaaccaucuuugcuggccaucucaaaugcagacugaagauggauaaacuuacgcugaaggggaugucuuaugugauguguacaggcuccuucaaacucgagaaggaagucgccgagacccagcacggaaccgugcugguucagauuaaguacgagggcacagacgcgccgugcaaaaucccuuucagcacccaagaugaaaagggggugacacagaauggacggcugaucacggcuaaccccauugucaccgacaaagagaagccugugaauaucgaagccgagccgcccuuuggcgagucuuauauugugaucggggccggagaaaaagcucuuaagcucagcugguucaagaaaggcuccucuauugggaagauguuugaggccacagcuagaggcgcccgccggauggcgauccugggagauaccgccugggacuucggcagcaucgggggaguuuuuacauccgucggcaaacuggugcaucagauuuucgggaccgcuuacggagugcucuuuagcggcgucucuuggacgaugaagaucgggauuggcgugcugcuuaccuggcugggacucaacuccagaagcacaucucuguccaugaccuguaucgccguuggccuggugacacuuuaccucggggucauggugcaggcugauagcggaugcguuauuaauuggaaaggccgcgaacugaaguguggguccggaaucuucgugaccaacgagguccacacauggaccgaacaauauaaguuucaggccgacucuccuaaacggcugagcgcggccauuggcaaggcuugggaggagggggugugcggcaucagauccgccacgcgccucgaaaauaucauguggaaacagauuucuaacgagcugaaccauauccuucuggaaaaugacaugaagcucacaguuguggucggagauguggcuggcauucuggggcagggcaagaaaaugauccggccgcaacccauggaguacaaauauagcuggaaguccuggggcaaggccaaaauuaucggggccgacgcucagaacaccaccuucaucauugauggaccuaauacacccgaauguccugacgaucagagagcguggaacaucugggagguggaggacuacggcuuuggcauuuucaccacgaauaucuggcugaaacuucgcgauagcuauacacaggucugcgaccaccggcucaugucugccgcuauuaaagauuccaaggccguucacgccgacaugggguacuggaucgaaagcgagaaaaacgaaaccuggaagcuggcuagagccucuuuuaucgaggugaagacauguauuuggcccaaaucccauacccuguggagcaauggagugcucgaaucugagaugaucauuccgaagaucuauggcgggccuauuagccaacacaacuaccgccccggauacuucacacagaccgcgggcccuuggcaucuggggaaacuugagcuggauuucgaccucugcgaaggaacgaccgucgugguugaugagcacugcggcaaucggggccccucccugagaacaaccacagugaccgggaagaucauccacgaaugguguugccggagcuguacgcugccuccccuucgcuuuagaggagaggacggcugcugguaugggauggagauucggccggucaaagaaaaggaggaaaaccucgugaagucuaugguuuccgcuggaagcggcgagguggacuccuucucucuggggcugcucuguaucagcauuaugaucgaagaggucaugagaucccgcuggucucggaaaaugcugaugacaggaacccuugccguguuuuuccugcucauuaugggccagcugacauggaaugaucugaucagacuuugcauuaugguuggcgccaacgcuagcgaccgcauggggaugggaaccaccuaccuggcccucauggcgacauuuaagaugagaccuauguucgcugugggccugcucuuucggcgccugacguccagagagguccuucugcucaccaucgggcugucucugguggccagcguggaacuucccaauucccuggaggaacucggagauggccuggccauggggaucaugauucucaaacugcuuacagacuuccaaagcuaucagcugugggcuacccuccugucucugacauuuaucaagaccacguucucccuucauuacgccuggaaaacaauggcuaugguccugagcauuguuucucucuuuccccugugucucuccaccaccagccagaagacaaccuggcugccugugcuucugggaucucugggcugcaagccgcucacaauguuccugaucgccgagaacaaaauuuggggccggaaguccuggccccuuaaugaagggaucauggcggugggaaucgucagcauucugcucuccagccugcucaaaaacgaugugccucuggccggcccccuuaucgcugggggaaugcugauugccuguuauguuaucucuggcagcuccgcugaccugucucucgagaaggccgccgaggugagcugggaagaggaagcugagcacuccggggcgucucauaacauucuggucgaagugcaggaugacggaacgaugaaaaucaaggaugaggagcgcgacgauacccuuacaauccugcucaaagccacccugcucgcuguuagcggcguguacccucuguccauucccgccacacuuuuugucugguauuucuggcaaaagaagaaacagagaucuggcgugcugugggacaccccuagcccucccgaagucgagcgggccgugcuggaugacgggaucuaccgcauuaugcagagaggacuccugggccggucccagguuggggugggagucuuccaagaaaauguguuucacacgauguggcauguuacccgcggcgcugugcuuauguaccaggggaagagacuggagcccagcugggccucugucaaaaaggaccucaucuccuauggaggcggcuggcggcugagagggagcuggaacacaggagaggaaguccaggugauugcgguugagcccggcaaaaauccuaagaacguccagaccgcucccgggacauucaagaccccggaaggagaggugggcgccaucgcccucgauuuuaaaccugggacaucuggaucccccauugugaaucgcgaaggcaagaucgucggccuguacgggaacggagugguuacgaccagcggcacauauguguccgcuaucgcccaagcgaaggcuucucaggaggggccucuucccgagauugaagacgaggucuuccggaagagaaaucugaccaucauggaucugcaccccggaagcggcaaaacccgccgguaccucccugccauugugagagaagccaucaagcgcaagcugcggacacuuauucuggcuccgacgagaguuguggccuccgagauggcugaagcccucaaagggaugcccauccgcuaucagaccacagcggucaagggcgagcacaccggaaaagagaucguggaccugaugugccaugccacauuuaccaugcggcugcucagcccuguuagagugcccaacuacaauaugauuaucauggaugaagcucacuucacggacccuucuuccauugccgcucggggcuauaucagcacacgcgucgggaugggagaggccgccgcuauuuuuaugaccgcgacacccccuggcucuguggaagccuucccgcaaagcaacgcugugauccaggaugaggaaagagacauccccgagcgguccuggaacucuggguacgaguggauuacagauuuuccuggaaagaccgucugguucguucccagcaucaaauccggcaacgacauugccaauugucuucgcaagaacgggaagagagugauccagcugucucggaaaacauuugauaccgaauaccagaagacgaaaaauaacgacugggacuauguggucacaaccgauauuagcgagaugggcgccaacuucagagcugaccgcgugaucgauccucggagaugccugaagcccguuauucucaaagacggaccggaacgcgugauccuggccggcccuaugcccgucacaguggcguccgcugcccaacggagagggcgcaucggacggaaucauaacaaggagggcgaucaguacauuuauauggggcagccccuuaauaacgacgaggaucacgcccauuggaccgaagcuaagaugcugcucgacaauaucaacacgccugagggaauuauccccgcccuguucgaaccugagagagaaaagagcgcggccguugauggcgaguaccgccugagaggggaggcucggaagaccuuuguggagcucaugcgcagaggcgaccuuccggucuggcugucuuauaaaguggccuccgagggauuccaguacagcgaucggcgcuggugcuuugacggcgaaagaaauaaccaaguccuggaggaaaauauggauguggagauuuggacaaaggagggggaacggaaaaagcucagaccccgcuggcuggacgcucggaccuauuccgacccucuugcccugagagaguucaaagaauuugcugccggacgccggucuguuagcggcgaucucauccuggagaucgggaagcugccccagcaccucacacagagagcgcagaacgcccuugacaaucuggugaugcugcacaacuccgaacaaggaggccgggcuuaccgccaugccauggaggagcucccugauaccauugaaacacugaugcuucuggcucucaucgccgugcugaccggcggggucacgcuguucuuucucucuggaagaggccuugggaagacaagcauuggacugcuguguguuauggccuccagcgugcuccuguggauggcuucuguggagccccacuggaucgcggccuccauuauccuugaguucuuucugaugguccuccugaucccggagccugaccggcagcgcacaccccaggauaaucagcuggcuuacgugguuauuggccuccuuuucaugauccugaccguggccgccaacgagauggggcugcucgaaacaaccaaaaaggaccugggaauuggccaugucgcuguggagaaucaccaccaugccgcgaugcuugaugucgaccugcacccugccagcgcuuggacacucuaugccguggcuacgaccaucauuacacccaugaugagacauaccaucgaaaacacaaccgccaacauuucucugacggcgaucgccaaucaagcugccauccugaugggccucgauaaaggguggccuauuuccaagauggacaucggaguuccccuucuggcucugggcugcuacagccaggugaacccgcucacccugacagccgcuguccuuaugcugguggcccacuaugcgauuaucgggccuggacuccaggccaaagcuacccgggaggcccaaaagcgcacagcugccggcauuaugaagaaucccaccguugaugggaucguggccaucgaccuggaucccgucguguacgacgcgaaauuugaaaagcagcugggacagauuaugcuccuuauccuguguacgucucagauucugcucaugagaacaaccugggcucugugcgagagcaucacacuugccaccggcccucugaccacacucugggagggcuccccggggaaauucuggaacacgaccauugcugugucuauggccaauaucuuucggggaagcuaucuggccggcgcugggcuggccuucucccucaugaaaagccuuggaggcgggcgcagaggaacaggcgcgcaaggcgaaacccugggggagaaauggaagcggcagcugaaccagcucuccaagucugaguucaauacauacaaaagaagcggaaucauggagguugaccgcuccgaagccaaggagggccugaaaagaggggaaaccacgaagcaugcugucucuagaggaacagccaaacuucgcugguuuguggaacggaaccuggugaagcccgagggcaaggucauugaucucggguguggaagaggcggcuggagcuauuacugcgcugggcugaaaaagguuaccgaagugaaaggauacaccaagggcgggccuggacacgaggaacccaucccuauggccacauauggcuggaaucuggugaaacuccacuccgggaaggacgucuucuuuauucccccugagaaaugugauacccuucugugcgacaucggagagucuagcccgaaccccacaauugaagagggccgcacgcugcgggugcucaagaugguugaaccuuggcugagaggcaaucaguucuguaucaagauucuuaaccccuacaugccuuccguggucgagacccuggagcaaaugcagcgcaaacaugggggaaugcucgugcggaauccccugagcagaaacucuacacacgaaauguauuggguuuccugcggcaccgggaauaucgugagcgcggucaacaugacaucucgcaugcugcucaaucgguuuaccauggcccauagaaagccgacguacgagcgcgauguggaccugggaaccggcacaagacacguggcugucgaaccugagguugccaaccuugauaucauugggcagcggaucgaaaacauuaaacacgagcauaaguccaccuggcacuaugacgaggauaaucccuacaaaacaugggcuuaucauggaagcuacgaagugaagcccucuggcuccgccagcuccauggugaacggcgucgugaagcugcucaccaaaccuugggacguuauccccauggugacacagauugcuaugaccgauacgacaccuuucgggcaacagcgcgucuuuaaggagaaaguggacaccagaaccccgaaggccaaacggggaacagcgcagaucauggaaguuacggccagauggcuguggggcuuccuuagccggaauaagaagccccgcaucuguaccagagaggaauuuacacggaaagugcgcucuaacgcugccauuggggcugucuucguggacgagaaucaauggaacagcgccaaggaggccguugaagaugagagauuuugggaccuggugcaccgggaacgcgagcuccauaaacagggaaagugcgcgaccugcgucuacaauaugaugggcaaaagagaaaagaagcugggggaguucggcaaagcuaagggaucccgggccaucugguauauguggcugggcgcccgcuuucucgaguucgaagcucugggguucaugaacgaggaucacugguuuucuagagaaaauagccuuuccggaguggagggcgaggggcugcacaaacucggauacauucugcgggacaucucuaagauuccuggcgggaacauguaugccgaugacacagcuggcugggauacccgcaucacagaagacgaucuucagaaugaggccaaaaucaccgacauuauggaacccgagcaugcgcugcucgccaaggcuaucuucaaacugacguaccagaacaaggucgugagaguucaacggccugccaagaauggaaccgugauggaugucauuagccgcagagaccagcggggcuccggacaggugggaacauauggccugaacaccuuuacaaauauggaagcucagcucaucagacaaauggagucugaggggauuuucagccccuccgaacuggagaccccgaaccuugccgaacgcgcgcuggauuggcucgagaaauacggaguggaacggcugaagagaauggccaucagcggcgacgacuguguugugaaaccuaucgaugaccgcuuugcuacggcccuuacagcucugaacgauauggggaagguccggaaagacauuccccagugggagccuucuagaggcuggaaugauuggcaacaggugcccuucugcucccaccauuuucaccaacucaucaugaaggacggacgcgagauuguugugccuugucggaaccaggaugaacuggucggcagagcccgcgugagccagggggcuggauggucucugcgggagaccgccugccucggcaaguccuaugcgcagauguggcaacugauguacuuccacagacgcgaccuucggcuggccgcuaaugccaucuguagcgccguccccguggauuggguuccgacauccagaaccacguggucuauucaugcucaccaucaguggaugaccacagaagacaugcucagcguguggaaccgggucuggaucgaggaaaauccuuggauggaggauaaaacccacauuuccagcugggaggacgugcccuaccuggggaagagagaagaccaguggugcggaucucuuaucggccugacagcccgcgcgaccugggcuacaaacauccaaguugccauuaaucaggugcggagacucaucgggaacgagaauuaucuggauuacaugaccuccaugaaacgcuuuaagaacgaaagcgaccccgagggcgcccugugguga

SEQ ID NO: 19168 - RNA, 9879 nt, Artificial Sequence
  derived and/or modified CDS sequence (opt5) from DENV-1__GU131726__SS-prME
agcgugaccaugcugcucaugcugaugcccaccgcccuugcuuuccaccugacgacccggggcggggaaccucauaugaucgugacaaagcaggaacggggaaagucccuccuguuuaagaccucugccggcguuaacaugugcacacuuauugccauggaccugggggaacucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaagggggcuacacagaacggacggcugaucacggccaaucccauuguuaccgacaaagagaagccugugaacaucgaagccgagccgcccuuuggcgagagcuauauugucaucggggcuggagaaaaagcccuuaagcucucuugguucaagaaaggcagcuccauugggaagauguuugaggcuacagccagaggcgcgcgccggauggccauccugggagauaccgcuugggacuucggcucugucgggggaguguuuacaagcguuggcaaacugguccaucagaucuucgggaccgccuacggagugcucuuuuccggcgugagcuggacgaugaagauugggaucggcguccugcuuaccuggcugggacucaauucuagauccacaagccugucuaugaccuguauugcugugggccugguuacacuuuaccucggggugaugguccaggccgauuccggaugcgugaucaacuggaaaggccgcgaacugaagugugggagcggaauuuucguuaccaaugaggugcacacauggaccgaacaauauaaguuucaggcggacuccccuaaacggcugucugccgcuaucggcaaggccugggaggagggggucugcggcauuagaagcgcuacgcgccucgaaaacaucauguggaaacagaucuccaacgagcugaaucauauucuucuggaaaacgacaugaaguucacagugguugugggagaugucgugggcauccucgcccaggggaaaaagaugauucggccgcaacccauggagcacaaauacucuuggaaaagcuggggaaaggccaagaucauuggcgcugacgugcagaauaccaccuuuaucaucgaugggccuaacacacccgaauguccugacgaucagagagcguggaauauuugggaggucgaggacuauggauucggcaucuuugccaccaacauuuggcugaagcugcgcgauuccuacacgcagguuugcgaccaccggcuuaugagcgcugccaucaaagauucuaaggccgugcaugcugacaugggcuauuggauugaauccgagaaaaaugaaacauggaagcucgccagagcgagcuucaucgaggugaagaccuguaucuggcccaaaucucacacacugugguccaacgggguccuggaaagcgagaugauuaucccgaagauuuacggaggcccuaucucucaacauaauuaucgccccggguacuucacccagacagcuggaccuuggcaccucggcaaacuggagcuugauuuugaccugugcgaagggaccacggugguuguggaugagcacugcggaaaccggggccccagccucagaaccacaaccgucacaggcaagauuauccaugaaugguguugccgguccuguacccugccuccccugcgcuucaaaggggaggacggaugcugguacggcauggagaucagaccggugaaggaaaaggaggaaaaucuuguuaaaagcauggugucugccggguccggagaggucgacagcuuuucccucggccugcuguguauuucuaucaugauugaagaggugaugcggagcagauggucccgcaagaugcucaugacggggacacuggccguuuuccuucugcucaucaugggacagcugaccuggaacgaucugauucggcuuugcaucauggugggcgcuaaugccucugacagaaugggcauggggacaaccuaucuggcgcucauggcuaccuuuaaaaugcgcccuauguucgccgucggacugcuccugagacggcuuacaagccgcgaggugcugcuccugacgauuggccugucccuuguggccucugucgaacugcccaacagccucgaggaacugggggauggacucgcuaugggcaucaugauccugaaacuucugaccgacuuucaaucccaccagcucugggccacacugcugagccuuaccuucauuaaaacaacccugucucuccauuacgcuuggaagacgauggccaugguucuguccaucgugagccucuuuccccugugucuuucuacaaccucccagaagaccacauggcugccugugcugcucgggagcuucggaugcaaaccgcugaccauguuucuuauuacagagaauaagaucuggggcagaaaaucuuggccccugaacgaaggcauuauggcggucggggugguuuccauccuccugagcucccuccugaagaacgaugugccucuugccggaccccugaucgcuggcgggaugcugauugccuguuaugucaucagcggaucuagcccugaccucucccuggagaaagcugccgaggugucuugggaagaggaagccgagcacagcggcgcuucccauaauauucuuguugaagugcaggaugacgggacgaugaagaucaaagaugaggagcgggacgauacccugacaauucuccugaaggcgacccuccuggccgucucuggaguguacccccuuagcaucccugcuacacuguucgucugguauuuuuggcaaaagaaaaagcagcgcuccggcgugcugugggacacccccucuccgccugaaguugagagagccgugcucgaugacggcaucuaccggauuaugcagcgcgggcugcuuggaagaagccaggucggcguggggguuuuccaagaaaacguguuccacacgauguggcacgucacccggggagccgugcugauguaucagggcaaacgccucgagcccuccugggcuagcgugaagaaagaccugaucucuuacgggggaggcuggagacuccagggcuccuggaauacaggggaggaaguucaggucauugccguggagccuggaaagaaccccaagaaugugcaaaccgcgccgggcacauuuaaaaccccugaaggggaggucggagcuaucgcccuggauuucaagcccggcacaagcgggucuccuauugugaaccgggaaggaaaaaucguuggccuuuacggcaaugggguggucacgaccuccggaacauaugugagcgccauugcucaggccaaggcgucccaggagggcccccugcccgagaucgaagacgagguuuuuagaaaacgcaaccugaccaucauggaucuccauccugggucuggaaagacccggagauaccugccggcuauugugcgcgaagccaucaagcggaaacuuagaacacugauucucgcccccacgcgcgucguggcuagcgagauggccgaagcucugaagggcaugccuauccgguaucaaaccacagccguuaaauccgagcacaccgggaaggagauuguggaccugaugugccaugcgacauucaccaugagacuccuuagccccguccgcgugccuaauuacaacaugaucaucauggaugaagcccacuuuacggaccccucuuccauugcugcccggggcuauaucagcacaagagugggaaugggcgaggcugccgccauuuucaugaccgcuaccccuccggggucugucgaagcguuuccccagagcaaugccguuauccaggaugaggaacgggacauuccugagcgcuccuggaacucuggauacgaguggaucacagauuuccccggcaaaaccgugugguuugugccuagcaucaaguccgggaaugacauugcuaacugucugagaaagaauggaaaacgggucauccagcugucucgcaagacauucgauaccgaauaucagaagacgaagaacaacgacugggacuacgugguuacaaccgauauuagcgagaugggcgccaauuuuagagccgaccgggugaucgaucccagacgcugccucaaaccggucauucugaaggacgggccugaacgggugauccuugcuggccccaugcccguuacaguggccuccgcggcucagagacgcggacggauuggcagaaaccauaauaaggagggggaucaguacaucuauaugggacagccucugaacaaugacgaggaucacgcccacuggaccgaagccaaaaugcuccuggacaacaucaauacgcccgagggcauuaucccugcucuguucgaaccggagcgcgaaaagagcgccgcgauugauggggaguaccggcucagaggagaggcccgcaaaaccuucgucgaacuuaugagacggggcgaccugcccguguggcugucuuauaaggucgcuuccgagggguuucaauacagcgaucgcagauggugcuucgacggcgaacggaacaaucaggugcucgaggaaaacauggauguugagaucuggacaaaagagggagaacgcaagaaacugagaccucgguggcuugacgccagaaccuauuccgacccccuggcucuccgcgaguuuaaggaguucgccgcuggccggagaucugugagcggggaucugauucuggagaucggaaagcucccucagcaucuuacacagcgcgcccaaaaugcgcuggacaaccuggugaugcuccacaauuccgaacagggcgggcgggccuacagacaugcuauggaggagcugcccgauaccaucgaaacacuuaugcugcucgcccugauugcuguccugaccggaggcguuacgcucuuuuuccuuucuggccgggggcugggaaaaacaagcaucggccugcucugugugauggccuccagcgugcugcuuuggauggccucugucgagccgcacuggauugcugcguccaucauucuggaauuuuuccucauggugcugcugaucccugagcccgaccgccagagaaccccucaggauaaccaacucgccuauguugugaucgggcuucuguuuaugauucugaccgucgcugccaaugagaugggacuccuggaaacaaccaagaaagaccuuggcaucgggcacguggccgucgagaaccaucaccaugcuacaaugcuggauguggaccuccaccccgccagcgcguggacgcuguacgccguugcuaccacaauuaucaccccuaugaugcggcauacaauugaaaacaccacggccaauaucucucugaccgcuauugccaaccaggcggccauccucaugggacuugauaagggcuggcccaucuccaaaauggacauuggcgugccgcugcuggcucucgggugcuacagccaggucaauccucugacacuuaccgccgcugugcugaugcucguugcccacuaugcuaucauuggacccggccugcaagccaaggcgacacgcgaggcccagaagagaaccgcugccgggaucaugaaaaaccccacgguggauggaauugucgcuaucgaccuggauccugugguguacgacgccaaguucgaaaaacagcucggccagaucaugcuucugauucuguguacaucucaaauccuccugaugcggaccacaugggcccuuugcgagagcauuacccuggcgaccgggccgcucacaacgcugugggagggaucccccggcaaguuuuggaauaccacaaucgcuguuucuauggccaacauuuuccgcggcagcuaucuggcuggggccggacucgccuuuucccuuaugaaaagccugggcgggggaagacggggcaccggggcucagggagaaacacugggcgagaaguggaagcgccagcucaaucagcuguccaaaucugaguucaacaucuacaagagaagcggcaucauggaggucgaccgguccgaagccaaagaggggcuuaagagaggagagaccacgcgccacgcggugucucggggcacagccaaacugagaugguucguggaacgcaaucucgucaagccugaggggaagguuauugaucugggauguggcagagggggauggagcuauuacugcgcuggccugaaaaaggugaccgaagugaaaggcuauaccaaagggggacccggccaugaggaaccuauccccauggccacauacggguggaaccucgucaaacuucacuccggaaaggacguguuuuucaccccuccggagaaaugugauacacugcugugcgacauuggcgagucuagccccaauccuacgaucgaagaggggagaacccuccgcguucugaagaugguggaacccuggcuucggggaaaccaauuuuguauuaagauccugaauccuuacaugcccuccgucguggagacacucgagcagaugcagagaaaacauggcggcaugcugguucgcaacccgcugagcagaaauucuacccacgaaauguauuggguguccugcgggacaggaaacauugucagcgcugugaauaugaccucuagaaugcuccugaaccgcuucacgauggcccaccggaagccuaccuacgagagagauguggaccuuggcgcggggacacgccaugucgccguugaacccgagguggcuaaccuggauaucaucggacagagaauugaaaauaucaaacacgagcauaaguccaccuggcacuaugacgaggauaaccccuacaaaacaugggccuaucauggcagcuacgaagugaagccuucuggguccgcuagcuccauggucaauggagugguuaagcuccugaccaaacccugggacgugauuccuauggucacacaaaucgccaugaccgauacgacaccguuuggccagcagcggguguucaaggagaaaguugacacccgcacccccaaggcuaaaagaggcacagcccaaauuauggaagugacggcgcgguggcuuuggggguuucugagcagaaacaagaagccucggaucuguacccgcgaggaguucacaagaaaaguccggucuaaugccgcuaucggagccguguuuguugacgagaaccaguggaauagcgcuaaggaggccguggaagaugagcgcuucugggaccucguccagaaagaaagagagcugcacaagcagggcaaaugcgcgaccugcguguauaacaugauggggaagcgggaaaagaaacugggagaguuuggcaaggcgaaagggucccgcgcuauuugguacauguggcucggcgccagauuccuggaguuugaagcccuuggauucaugaaugaggaucacugguucucucgggaaaacagccuguccggcgucgagggggagggacuccauaagcugggcuacauccuucgcgacauuucuaaaauccccgggggaaauauguaugcugaugacacagccggcugggauaccagaauuacagaagacgaucugcaaaacgaggcuaagaucaccgacaucauggaaccugagcacgcccuccuggcgacgagcauuuuuaaacugaccuaccagaauaaggugguucgggugcagcgccccgccaagaacgggacagucauggaugugaucuccagacgggaccagcgcggcucuggacaagugggcaccuaugggcucaauacauucaccaacauggaagcucagcugauuagacagauggagagcgagggaaucuuucuuccguccgaacuggagacgccuaaccucgccgaacggguucuggauuggcuugagaaauacggcguggaaagacugaagcgcauggcuauuagcggggacgacugugucgugaaacccaucgaugaccgguucgccacagcgcucaccgcccugaaugauaugggaaagguuagaaaagacaucccucagugggagcccucuaagggcuggaacgauuggcaacaggugccuuuuugcucccaucacuuccaccagcugauuaugaaggacgggcgcgagaucgucgugcccugucggaaucaggaugaacucgucggcagagcucgcgugagccaaggagccggcuggucucugcgggagacagcuugccuugggaaauccuaugcccagauguggcagcugauguacuuucauagacgcgaccuccggcuggcugccaacgcgauuuguagcgccguuccgaucgauugggugccuaccuccagaacgaccuggucuauucacgcucaucaccaauggaugacaaccgaagacaugcuuagcgucuggaaucgcguguggaucgaggaaaaccccuggauggaggauaagacacauguuuccagcuggggagacgugcccuaucugggcaaacgggaggaccaguggugcgggucucucauuggacugaccgccagagccacaugggcuuccaauauccaggucgccaucaaccaggugcggagacugauuggcaaugaaaacuaccucgauuacaugaccagcaugaagcgcuucaaaaaugagggggacccugaaggcgcgcugugguga

SEQ ID NO: 19169 - RNA, 9879 nt, Artificial Sequence
  derived and/or modified CDS sequence (opt5) from DENV-1__GU131727__SS-prME
agcgugaccaugcugcucaugcugaugcccaccgcccuugcuuuccaccugacgacccggggcggggaaccucauaugaucgugacaaagcaggaacggggaaaaucccuccuguuuaagaccucugccggcguuaacaugugcacacuuauugcgauggaccugggggagcucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacguccagaauaccaccuuuaucaucgaugggccuaacacacccgaauguccugacgaucagagagcuuggaauauuugggagguugaggacuauggauucggcaucuuuaccacgaacauuuggcugaagcugcgcgauuccuacacacaggugugcgaccaccggcuuaugagcgcggccaucaaagauucuaaggcugugcaugccgacaugggcuauuggauugaauccgagaaaaaugaaaccuggaagcucgccagagcuagcuucaucgaggucaagacauguaucuggcccaaaucucacacccugugguccaacggggugcuggaaagcgagaugauuaucccgaagauuuacggaggcccuaucucucaacauaauuaucgccccggguacuucacacagaccgccggaccuuggcaccucggcaaacuggagcuugauuuugaccugugcgaagggacgaccguuguggucgaugagcacugcggaaaccggggccccagccucagaacaaccacagugaccggcaagauuauccaugaaugguguugccgguccuguacgcugccuccccugcgcuucaaaggggaggacggaugcugguacggcauggagaucagaccgguuaaggaaaaggaggaaaaucuugugaaaagcauggucucugcgggguccggagagguggacagcuuuucccucggccugcuguguauuucuaucaugauugaagagguuaugcggagcagauggucccgcaagaugcucaugacagggacccuggcuguguuccuucugcucaucaugggacagcugacauggaacgaucugauucggcuuugcaucauggucggcgccaaugccucugacagaaugggcauggggaccaccuaucuggcucucauggccacauuuaaaaugcgcccuauguucgcggugggacugcucuuuagacggcugacgagccgcgaggugcuucugcucaccauuggccugucccuggucgcuucuguugaacuucccaacagccuggaggaacucggggauggacuggccaugggcaucaugauccucaagcugcuuacagacuuccaaucccaccagcugugggccacccuccugagccugacauuuauuaaaaccacgcuuucucugcauuacgcuuggaagacaauggccauggugcucuccaucgugagccuguucccccucugucugucuaccaccucccagaagacaaccuggcuuccuguccugcuggggagccucggaugcaaaccgcugacaauguaucuuauuacggagaauaagaucuggggcagaaaaucuuggccccugaacgaaggcauuauggcuguggggguuguguccauccuccugagcucccuccugaagaacgaugucccucuugccggaccccugaucgcgggcgggaugcugauugccuguuacgugaucagcggaucuagcgcugaccucucccuggagaaagccgcugagguuucuugggaagaggaagccgagcacagcggcgccucccauaauauucuuguggaaguccaggaugacgggaccaugaagaucaaagaugaggagcgggacgauacacugaccauucuccugaaggcuacacuccuggcggugucuggagucuauccucuuagcauccccgccacccuguuugugugguacuucuggcaaaagaaaaagcagcgcuccggcguucugugggacacgccuucucccccggaaguggagagagcuguccucgaugacggcaucuaucggauuaugcagcgcgggcugcuuggaagaagccaggugggcguugggguguuucaagaaaacgucuuccacaccauguggcacgugacacggggagccgugcugauguaccagggcaaacgccucgagccuuccugggccagcguuaagaaagaccugaucucuuacgggggaggcuggagacuccagggcuccuggaauaccggggaggaaguccaggugauugcuguggagcccggaaagaacccuaagaauguccaaacagcccccggcaccuucaaaacaccggaaggggaggugggagcgaucgcucuggauuuuaagccuggcacgagcgggucucccauuguuaaccgggaaggaaaaaucgugggccuuuauggcaauggggucgugaccacauccggaaccuacguuagcgccauugcccaggcuaaggccucccaggagggcccucugcccgagaucgaagacgagguguucagaaaacgcaaccugaccaucauggaucuccaucccgggucuggaaagacacggagauaucugccugcgauuguccgcgaagcuaucaagcggaaacuuagaacgcugauucucgccccgacccgcgugguugccagcgagauggcugaagcccugaagggcaugcccauccgguaccaaacaaccgcugugaaauccgagcacacagggaaggagauugucgaccugaugugccaugccaccuuuacgaugagacuccuuagcccugugcgcgugcccaauuauaacaugaucaucauggaugaagcgcacuucacagacccuucuuccauugccgcucggggcuacaucagcaccagagucggaaugggcgaggccgcugccauuuuuaugaccgccacacccccugggucuguugaggcuuucccgcagagcaaugcggugauccaggaugaggaacgggacauucccgagcgcuccuggaacucuggauaugaguggaucaccgauuuuccuggcaaaacagugugguucguccccagcaucaaguccgggaaugacauugccaacugucugagaaagaauggaaaacgggugauccagcugucucgcaagaccuuugauacggaauaccagaagaccaagaacaacgacugggacuacguugugaccacagauauuagcgagaugggcgcuaauuucagagccgaccgggucaucgauccuagacgcugccucaaacccgugauucugaaggacgggccggaacggguuauccuugccggcccuaugcccgugaccgucgcuuccgccgcgcagagacgcggacggauuggcagaaaccauaauaaggagggggaucaguauaucuacaugggacagccccugaacaaugacgaggaucacgcucacuggacggaagccaaaaugcuccuggacaacaucaauaccccugagggcauuauccccgcccuguuugaaccugagcgcgaaaagagcgcugccauugauggggaguaucggcucagaggagaggcgcgcaaaacauucguggaacuuaugagacggggcgaccugccggucuggcugucuuacaagguggccuccgagggguuccaauauagcgaucgcagauggugcuuugacggcgaacggaacaaucagguucucgaggaaaacauggauguggagaucuggaccaaagagggagaacgcaagaaacugagaccccgguggcuugacgcuagaacauacuccgacccucuggcccuccgcgaguucaaggaauuugcugccggccggagaucugugagcggggaucugauucuggagaucggaaagcucccccagcaucuuacccagcgcgcucaaaaugcccuggacaaccuggucaugcuccacaauuccgaacagggcgggcgggcguauagacaugccauggaggagcugccugauacaaucgaaacccuuaugcugcucgcucugauugccguucugacgggaggcgugacacucuucuuucuuucuggccgggggcugggaaaaaccagcaucggccugcucugugugauggcuuccagcguccugcuuuggauggccucuguggagccccacuggauugccgcuuccaucauucuggaguucuuucucaugguucugcugaucccggagccugaccgccagagaacaccccaggauaaccaacucgcguacguggucaucgggcuucuguucaugauucugacaguggccgcuaaugagaugggacuccuggaaaccacaaagaaagaccuuggcaucgggcacgucgccguggagaaccaucaccaugccacgaugcuggauguugaccuccacccugcuagcgccuggacccuguacgcgguggccacaaccauuaucacacccaugaugcggcauaccauugaaaacacgaccgcuaauaucucucugacagccauugcuaaccaggccgcgauccucaugggacuugauaagggcuggccuaucuccaaaauggacauuggcgucccccugcuggcccucgggugcuauagccaggugaauccgcugacccuuacagcugccguucugaugcucguggcucacuacgccaucauuggaccuggccugcaagcuaaggccacccgcgaggcgcagaagagaacggccgcugggaucaugaaaaaccccacagucgauggaauuguggccaucgaccuggaucccgugguuuaugacgcuaaguuugaaaaacagcucggccagaucaugcuucugauucuguguaccucucaaauccuccugaugcggacaaccugggcccuuugcgagagcauuacccuggccacagggccucucacgacccugugggagggauccccgggcaaguucuggaauacaaccaucgcggucucuauggcuaacauuuuucgcggcagcuaccuggccggggcuggacucgccuucucccuuaugaaaagccugggcgggggaagacggggcacaggggcccagggagaaacccugggcgagaaguggaagcgccagcucaaucagcuguccaaaucugaauuuaacaucuauaagagaagcggcaucauggagguggaccgguccgaagcuaaagaggggcuuaagagaggagagacgacacgccacgccgugucucggggcaccgcgaaacugagaugguucgucgaacgcaaucucguuaagcccgaggggaaggugauugaucugggauguggcagagggggauggagcuacuauugcgccggccugaaaaaggugaccgaagucaaaggcuacacaaaagggggaccuggccaugaggaacccaucccuauggcuaccuacggguggaaccucgugaaacuucacuccggaaaggacguuuucuuuacacccccugagaaaugugauacgcugcugugcgacauuggcgagucuagcccgaaucccaccaucgaagaggggagaacacuccgcgugcugaagauggucgaaccuuggcuucggggaaaccaauucuguauuaagauccugaaucccuauaugccuuccgugguugagacccucgagcagaugcagagaaaacauggcggcaugcuggugcgcaacccccugagcagaaauucuacacacgaaauguacugggucuccugcgggaccggaaacauugugagcgccgugaauaugacgucuagaaugcuccugaaccgcuuuaccauggcucaccggaagccgacauaugagagagaugucgaccuuggcgccgggacccgccauguugcgguggaaccugagguggccaaccuggauaucaucggacagagaauugaaaauaucaaacacgagcauaaguccacauggcacuacgacgaggauaaccccuauaaaaccugggcuuaccauggcagcuaugaagucaagcccucuggguccgccagcuccauggugaauggaguugugaagcuccugacaaaaccuugggacgucauucccauggugacccaaaucgcuaugacggauacaaccccuuucggccagcagcggguuuuuaaggagaaaguggacacccgcacaccgaaggccaaaagaggcacggcucaaauuauggaagucaccgcccgguggcuuuggggguuccugagcagaaacaagaagccccggaucuguacacgcgaggaauuuaccagaaaagugcggucuaaugcggccaucggagcuguuuucguggacgagaaccaguggaauagcgccaaggaggcugucgaagaugagcgcuuuugggaccucgugcagaaagaaagagagcugcacaagcagggcaaaugcgccacaugcgucuacaacaugauggggaagcgggaaaagaaacugggagaguucggcaaggccaaagggucccgcgcgauuugguacauguggcucggcgcuagauuucuggaguucgaagcccuuggauuuaugaaugaggaucacugguucucucgggaaaacagccuguccggcguggagggggagggacuccauaagcugggcuauauccuucgcgacauuucuaaaaucccugggggaaauauguacgccgaugacaccgcuggcugggauacaagaauuaccgaagacgaucugcaaaacgaggccaagaucacggacaucauggaacccgagcacgcucuccuggccaccagcauuuucaaacugacauaucagaauaagguugugcggguccagcgcccugcgaagaacgggaccgugauggaugugaucuccagacgggaccagcgcggcucuggacaaguuggcacauacgggcucaauaccuuuacgaacauggaagcccagcugauuagacagauggagagcgagggaaucuuccuucccuccgaacuggagacaccgaaccucgcugaacgggugcuggauuggcuugagaaauauggcgucgaaagacugaagcgcauggccauuagcggggacgacugugugguuaaaccuaucgaugaccgguuugcuaccgcccucacagcgcugaaugauaugggaaaggugagaaaagacaucccccagugggagccuucuaagggcuggaacgauuggcaacagguccccuucugcucccaucacuuucaccagcugauuaugaaggacgggcgcgagaucguggucccuugucggaaucaggaugaacucgugggcagagcccgcguuagccaaggagcuggcuggucucugcgggagaccgccugccuugggaaauccuacgcucagauguggcagcugauguauuuccauagacgcgaccuccggcuggccgcuaacgccauuuguagcgcggugcccgucgauugggugccgacguccagaaccacauggucuauccacgcccaucaccaauggaugaccacagaagacaugcuuagcguuuggaaucgcguguggauugaggaaaacccuuggauggaggauaagacccaugucuccagcuggggagacgugcccuaccugggcaaacgggaggaccaguggugcgggucucucaucggacugacagcuagagccaccugggccuccaauauucagguggcuaucaaccagguucggagacugaucggcaaugaaaacuaccucgauuauaugacgagcaugaagcgcuuuaaaaaugagggggaccccgaaggcgcccugugguga

SEQ ID NO: 19170 - RNA, 9879 nt, Artificial Sequence
  derived and/or modified CDS sequence (opt5) from DENV-1__HM631850__SS-prME
uccgugaccaugcugcucaugcugaugcccaccgcccuugcuuuccaccugacgaccagaggcggggaaccucauaugaucgucuccaagcaggaacggggaaaaucucuccuguuuaagaccagcgccggcguuaauaugugcacccuuauugcgauggaccugggggaguucugugaagauaccaugaccuacaaaugccccagaaucacagaagcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucucucacauuuauuaagaccacguucucccugcacuaugccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuacgugauuucuggaagcuccccugaccuuucucuggagaaggcugccgaggucagcugggaagaggaagccgagcauuccggcgcuucucacaauauccugguggaaguucaggaugacgggacgaugaaaauuaaggaugaggagcgggacgauacccucacaauccugcuuaaggcgacccugcucgccgugagcggagucuauccccuguccaucccugcuacacucuucgugugguacuuuuggcagaaaaagaaacaacgcucuggcguccugugggacacccccagcccgccugaaguggagagagccguucuugaugacggcauuuaucggaucaugcagcgcgggcugcugggaagaucccaggugggcgucgggguguuccaggaaaacguuuuucauacgauguggcacgugacccggggagccguccucauguaccaaggcaagcgccuggagcccagcugggcuucugugaaaaaggaccuuauuuccuacgggggaggcuggagacugcagggcagcuggaauacaggggaggaagugcagguuaucgccgucgagccuggaaagaaccccaaaaaugugcagaccgcgccgggcacauucaagaccucugaaggggaggugggagcuauugcccucgauuuuaaaccuggcacauccgggagccccaucgucaaccgggaaggaaagauugugggccuguauggcaaugggguugugacgaccuccggaacauacgucucugccaucgcucaagccaaagcgagccaggagggcccucuccccgagaucgaagacgagguguucagaaagcgcaaccugaccauuauggaucuucaccccggguccggaaagacccggagauaucugccugcuaucguucgcgaagccauuaaacggaagcugagaacacucauccuggccccgacgcgcguggucgcuagcgagauggccgaagcucuuaaaggcaugcccauucgguaccagaccacagccgugaagucugagcauaccgggaaagagaucguugaccugaugugccacgcgacauuuaccaugagacuccuguccccugugcgcguccccaauuauaacaugaucauuauggaugaagcccauuucacggacccuagcucuaucgcugcccggggcuacauuagcacaagagugggaaugggcgaggcugccgccaucuuuaugaccgcuacacccccuggguccguggaagcguucccgcaaucuaaugccgucauucaggaugaggaacgggacauccccgagcgcagcuggaacuccggauaugaguggaucacagauuuuccuggcaagaccguuugguucgugcccucuauuaagagcgggaaugacaucgcuaacugucugcgcaagaauggaaagcgggugauucagcucucccgcaaaacauucgauaccgaauaccagaagacgaaaaacaacgacugggacuacgucgugacaaccgauaucagcgagaugggcgccaauuuuagagccgaccggguuauugauccuagacgcugccuuaagcccgugauccugaaggacgggccggaacgggucauucuggcuggcccuaugcccgugacaguugccucugcggcucaaagacgcggacggaucggcagaaaccacaauaaagagggggaucaguauaucuacaugggacagccccucaacaaugacgaggaucaugcccacuggaccgaagccaagaugcugcuugacaacauuaauacgccugagggcaucauucccgcucuguucgaaccugagcgcgaaaaauccgccgcgaucgauggggaguaucggcucagaggagaggcccgcaagaccuuuguggaacugaugagacggggcgaccugccggucuggcucagcuacaaaguggcuuccgagggguuccaguauucugaucgcagauggugcuuugacggcgaacggaacaaucaaguccuugaggaaaacauggauguggagauuuggacaaaggagggagaacgcaaaaagcugagaccccgguggcuggacgccagaaccuacagcgacccucucgcucugcgcgaguucaaggaauuugccgcuggccggagauccguuucuggggaucuuauccuggagaucggaaaacucccccagcaccugacacagaaggcccagaaugcgcuggacaaccucgugaugcuucauaauagcgaacaaggcgggcgcgccuaucggcacgcuauggaggagcugccugauaccauugaaacacugaugcuccuggcccuuaucgcugugcugaccggaggcgucacgcuguucuuucuguccggcagagggcugggaaaaacaagcauuggccuccuuuguguuauggccucuuccgugcugcuguggauggccagcguggagccccauuggaucgcugcgucuauuauccucgaguucuuucugaugguccuucugaucccggagccugaccggcagcgcacaccccaggauaaccagcucgccuacgugguuauugggcugcuguucaugauccucaccguggcugccaaugagaugggacuucuggaaacaaccaagaaagaccugggcauugggcacgucgccguggagaaccaccaucacgcugccaugcucgaugucgaccugcauccugcguccgccuggacacuuuacgcuguggccacgaccaucauuacacccaugaugagacacaccaucgaaaacacaaccgcuaauauuagccugacggccaucgcgaaccaagccgcuauccucaugggacuggauaagggcuggccuauuucuaagauggacaucggcguuccccugcucgcccuugggugcuauagccaggugaauccgcugacccugacagcugccguccucaugcugguggcucauuacgccauuaucggaccuggccuucaggcgaaagccacccgggaggcucaaaagcgcacagccgcugggauuaugaaaaaccccaccguugauggaaucguggccaucgaccuggaucccgucguguaugacgccaaguuugaaaaacagcucggccagauuaugcugcugauccucuguacgucccagauucuucugaugagaacaaccugggcgcugugcgagucuaucacacucgcuaccgggccucugaccacacuuugggagggaagcccgggcaaguucuggaauacgaccauugccguguccauggcuaacaucuuccggggcagcuaccuggccggggccggacucgcuuuuucccugaugaagucucugggcgggggacgcagaggcacaggggcccaaggagaaacccucggcgagaaauggaagcggcagcuuaaucagcugagcaaauccgaguucaacacauauaagcgcucuggcaucauggagguugacagaagcgaagcgaaagaggggcugaagcggggagagaccacgaagcacgccgucuccagaggcacagcuaaacuccgcugguuuguggaacggaaucuggugaagcccgaggggaaagucauugaucuuggauguggcagagggggauggucuuacuauugcgccggccugaagaaaguuaccgaagugaagggcuacaccaaagggggaccuggccacgaggaacccaucccuauggcuacauacggguggaaccucgugaagcugcauagcggaaaggacgucuucuuuauucccccugagaaaugugauacccugcucugcgacaucggcgaguccagcccgaaucccacaauugaagaggggcgcacgcuucgggugcugaagaugguugaaccuuggcugagaggaaaccaguucuguaucaaaauucucaaucccuauaugccuucuguggucgagacccuggagcaaaugcagcgcaagcacggcggcaugcuugugcggaacccccuguccagaaauagcacacaugaaauguacuggguuucuugcgggaccggaaacaucguguccgccgucaauaugacaagccgcaugcuccugaaccgguuuaccauggcgcacagaaaaccgacguaugagcgcgauguggaccugggcgccgggacccggcacguggcugucgaaccugagguugccaaccucgauaucauuggacagagaaucgaaaauauuaagcaugagcacaagucuacauggcauuacgacgaggauaaccccuauaaaaccugggcuuaccacggcuccuaugaagugaagcccagcggguccgccagcucuauggugaauggagucgugaaacugcuuacaaagccuugggacguuauccccauggugacccagauugcuaugacagauaccacgccuuucggccaacagcgcgucuuuaaagagaagguggacacaagaaccccgaaggccaaacggggcaccgcgcagaucauggaaguuacagccaaguggcuguggggguuccucagccgcaacaaaaagcccagaaucuguacgcgggaggaauuuaccagaaaagugcgguccaaugcugccauuggagcugucuucguggacgagaaccaauggaacucugccaaggaggccguugaagaugagcgcuuuugggaccuggugcauagagaacgggagcuucacaagcagggcaaaugcgcgacaugcgucuacaacaugauggggaagcgcgagaaaaagcugggagaguucggcaaagcuaaggggagcagagccaucugguacauguggcucggcgcccgguuccuggaguuugaagcucugggauucaugaaugaggaucacugguuuucccgcgaaaacucucucagcggcguggagggggagggacugcauaaacuuggcuauauucugagagacaucuccaagauuccugggggaaauauguacgccgaugacaccgcuggcugggauacacggaucaccgaagacgaucuccagaacgaggccaagaucacagacauuauggaacccgagcacgcgcugcuugccaaaucuaucuucaagcugaccuaucagaauaaagucgugcgcguucaaagaccugcuaagaacgggacggugauggaugucauuagccggcgcgaccagagaggcuccggacaggugggcaccuacgggcucaauacauuuaccaacauggaagcccagcugauccggcaaauggagagcgagggaauuuucucucccuccgaacuggagacaccgaaccucgcuggccgcgugcuggauuggcuugaaaaacaugggguugagagacugaagcggauggccaucagcggagacgacuguguggucaagccuaucgaugacagauuugcgaccgcccucacggcucugaaugauaugggcaaagugcgcaaggacauuccccagugggaaccuucuaaaggguggaacgauuggcagcagguucccuucugcucccaccacuuucaucaacuuaucaugaaggacggccgggagauuguggucccuuguagaaaucaggaugagcuggugggacgcgcccgggucagccagggcgcuggguggucccucagagaaacagccugccugggaaaaucuuaugcucagauguggcaacugauguacuuccaccgccgggaccucagacuggccgcgaacgccaucuguagcgcugugcccguugauugggugccgaccucccgcacaaccuggagcauucaugcccaccaucaguggaugacgaccgaggacaugcuuucugucuggaaucggguguggaucgaagagaacccuuggauggaagauaagacacacauuuccaauuggggcgacguucccuaucuggggaagagagaggaccaguggugcggaagccucaucggccugaccgcccgcgcuacaugggccaccaacauccaaguggcgauuaaucagguccggagacuuaucgggaacgagaauuaccuggauuacaugacaucuaugaaacgguuuaagaacgaaagcgaccccgagggcgcucucugguga

SEQ ID NO: 19171 - RNA, 9879 nt, Artificial Sequence
  derived and/or modified CDS sequence (opt5) from DENV-1__KF955446__SS-prME
agcgugaccauguuccugaugcucaugcccacagcccuggcuuuccaccuuacgaccagaggcggggaaccucauaugaucguguccaagcaggaacggggaaaaucucugcuguucaagacaagcgccggcguuaacaugugcacccugauugcgauggaccuuggggaacugugugaagauacaaugaccuacaaaugcccccgcaucacagaaaccgaacccgacgauguggacuguuggugcaaugcuacggauaccugggugacauauggaaccuguucccaaacaggcgaacacagacgggacaagcgcucugucgcccucgccccucauguggggcugggacuggagaccagaacggaaacauggaugagcuccgagggcgcuuggaaacagauucagcggguugaaaccugggcccuccgccaccccggcuuuacagugaucgcucuguuccuugcccaugcgauugggaccucuaucacccagaagggaaucauuuuuauccugcucaugcuggugacaccuagcauggccaugagaugcgugggcauugggucccgggauuucguugagggacuuagcggcgcuacguggguggacguggugcuggagcacgggucuugugugaccacaauggccaaggauaaacccacccucgacaucgaacugcugaagacagaggucaccaacccugcuguucuccgcaaacugugcauugaagccaagaucuccaauacgacaaccgauagcagauguccgacccaaggagaggcgacacuuguggaagaacaggacgccaacuuugugugccggcgcaccuucgucgauagaggcuggggcaauggguguggacuguuuggcaaagggucucucauuacaugcgcuaaguucaagugcgugacgaaacuggagggaaagaucguucaguacgaaaaccuuaaauauuccgugaucgucaccgugcacacaggcgaccagcaucaaguugggaaugagagcaccgaacacggaacaaccgccacgauuacaccccaagcuccuacaaccgagauccagcugacagacuacggcgcccucacccuggauuguucuccccggacgggccuggacuuuaacgaaauggugcuccugacaaugaaggagaaauccuggcuuguccauaagcagugguuccuggaucucccucugcccuggaccagcggggccuccacaucucaagagaccuggaaucgccaggaccuucuggugaccuuuaaaacagcucacgcgaagaagcaggaagucgugguucucggaagccaagagggcgccaugcacacggcucugaccggggccacagaaauucagaccuccggaacaaccacgaucuucgccggccaucugaaaugcagacucaagauggauaaacugacacuuaaggggaugagcuaugugauguguaccggcucuuucaaacuggagaaggaacucgcugagacccagcacggaacaguccuggugcagauuaaguacgagggcaccgacgccccgugcaaaaucccuuuuuccacacaagaugaaaaggggguuacgcagaacggacggcugaucaccgcgaaucccauugugacagacaaagagaagccugucaacaucgaagcugagccgcccuucggcgagagcuauauugugaucggggccggagaaaaagcccuuaagcucucuugguuuaagaaaggcagcuccauugggaagauguucgaggcuaccgccagaggcgcucgccggauggccauccugggagauacagcgugggacuuuggcucuaucgggggaguguucaccagcguuggcaaacugguccaucagauuuuugggacggccuacggaguccucuucuccggcgugagcuggaccaugaagaucgggauuggcguccugcuuacauggcugggacucaauucuagauccaccagccugucuaugacauguaucgcugugggccugguuacccuuuaccucggggugaugguccaggccgauuccggaugcgugauuaacuggaaaggccgcgaacugaagugugggagcggaaucuuuguuacaaaugaggugcacaccuggacggaacaauauaaguuccaggcugacuccccuaaacggcugucugccgcgauuggcaaggccugggaggagggggucugcggcaucagaagcgcuacacgccucgaaaacaucauguggaaacagauuuccaacgagcugaaucauauccuucuggaaaacgacaugaaguuuaccgugguugugggagaugucgccggcauucucgcucaggggaaaaagaugauccggccgcaacccauggaguacaaauauucuuggaaaagcuggggaaaggccaagauuaucggcgccgacgugcagaauaccacauucaucauugaugggccuaacacccccgaauguccugacgaucagagagcuuggaauaucugggagguggaggacuacggauuuggcauuuucacgacaaacaucuggcugaagcugcgcgauuccuauacccaggucugcgaccaccggcuuaugagcgcggccauuaaagauucuaaggcuguucacgccgacaugggcuacuggaucgaauccgagaaaaaugaaacauggaagcucgccagagcuagcuucaucgaggugaagaccuguauuuggcccaaaucucauacacugugguccaacggggugcuggaaagcgagaugaucauuccgaagaucuauggaggcccuauuucucaacacaauuaccgccccggguacuuuacccagacggccggaccuuggcaucucggcaaacuggagcuugauuucgaccugugcgaagggaccacagucgugguugaugagcacugcggaaaccggggccccagccucagaaccacaaccgugacgggcaagaucauccacgaaugguguugccgguccuguacacugccuccccugcgcuuuagaggggaggacggaugcugguauggcauggagauucggccggucaaagaaaaggaggaaaaucuugucaagagcaugguuucugcgggguccggagagguggacagcuucucccucggccugcuguguaucucuauuaugaucgaagaggucaugagaagccgcuggucccggaaaaugcucaugaccgggacacuggcuguguuuuuccuucugauuaugggacagcucaccuggaacgaucugaucagacugugcauuaugguuggcgccaaugccucugaccgcaugggcauggggaccacauaccuugcucugauggccacguuuaagaugagaccuauguucgcggugggacuccuguuucggcgccucaccagcagagagguccugcuucugacaaucggccucucccugguggcuucuguggaacugcccaacagccuugaggaacugggggauggacucgccaugggcaucaugauucugaaacuccugaccgacuuccaaucccaucagcuuugggccacacugcucagccugaccuuuaucaagacgacauucucucugcacuaugcuuggaaaaccauggccaugguccuuuccauuguuagccuguuuccccucugucugucuaccacaucccagaagaccacauggcucccugugcugcuugggagccugggaugcaagccgcugacgauguuccucaucgcugagaauaaaauuuggggccggcgcucuuggccccugaacgaaggcaucauggccguggggaucgucuccauucuucugagcucccuccugaagaacgaugugccucucgcgggaccccugaucgccggcgggaugcuuauugcuuguuacguuaucagcggaucuagcgccgaccugucccuggagaaagcugccgaggugucuugggaagaggaagccgagcauagcggcgcuucccacaauauucucgucgaagugcaggaugacgggaccaugaagaucaaagaugaggagagagacgauacacugaccauccuucugaaggcgacacuccuggccguuucuggaguguauccucucagcauucccgcuacccuguucgucugguacuuuuggcagaaaaagaagcagcgguccggcgugcuuugggacacgccuucucccccggaagucgagcgcgccgugcuggaugacggcaucuauagaauuaugcagcgggggcugcucggacgcagccagguuggcgugggggucuuccaagaaaacguguuucauaccauguggcacguuacaagaggagccgugcugauguaccagggcaaacggcuugagccuuccugggcuagcgucaagaaagaccugaucucuuacgggggaggcuggagacuccagggcuccuggaauaccggggaggaaguccaggugauugccguugagcccggaaagaacccuaaaaauguccaaacagcgcccggcaccuucaagacaccggaaggggaggugggagcuaucgcccuggauuuuaagccuggcacgagcgggucucccauugugaaccgcgaaggaaaaaucgucggccucuauggcaauggggugguuaccacauccggaaccuacgugagcgccaucgcucaggcccgggcgucccaggagggcccucugcccgagauugaagcugaggucuucagaaagcgcaaccuuaccaucauggaccugcaccccgggucuggaaaaacacggagauaucugccugccauugugcgcgaagccaucaagcggaaacucagaacgcugauucuugcuccgacccgcguuggcgccagcgagauggcugaagcccugaaggggaugcccauccgguaccaaacaaccgcggugaaguccgagcauacaggcaaagagaucgucgaucucaugggacacgccaccuuuacgaugggccugcuggcuccugggagagugcccaauuauaacaugguuauuauggacgaagcccauuucacagauccuagccggaucgcugcccgcggauacauuucuaccagagugggcaugggggaggccgcugcgaucuuuaugaccgccacacccccuggauccgucgaggcuuucccgcagagcaaugccgugauucaggacgaggaacgggauauccccgagcgcucuuggaacagcggcuaugaguggaucaccgacuuuccugggaagacagugugguucguccccuccauuaaaucuggcaaugauaucgccaacugccucagaaagaauggaaaacggguuauucagcuuagcagaaagaccuucgacacggaauaccaaaagaccaaaaacaacgauugggacuacguggugaccacagacaucuccgagaugggcgcuaauuuucgcgccgaucgggucauugacccuagacgcugucugaaccccgugauccugaaggaugggccggaacggguuauucucgcgggaccuaugcccgugaccgucgcuucugccgcccagagacgcggccggaucgggagaaaucacaacaaagagggagaccaguauaucuacaugggccagccccugaauaacgaugaggaccaugcuccuuggacggaagccaagaugcuucuggauaauauuaacacccccgaggggaucauuccugcgcucuuugaaccggagcgcgagaaaagcgccgcuaucgacggcgaguccagacugcggggagaggcccgcaagacauuuguggaacugaugagacggggcgaucuccccguuuggcuuagcuauaagguggcuucugagggguuccaauacuccgaccgcagauggugcuuugauggagaacggaccaaucagguccuggaggaaaacauggccguggagauuuggccuaaagagggcgaaagaaagaaacugcgcccccggugccucgacgcuagaacauauagcgauccucuggcccuucgcgaguucaaggaauuucccccggggcggagauccgucucuggagaccugauccucgagaucggcaaacugccucacccccugacccagcggccucagaaugcgcucgccacacuugugaugagccacaccuccgaacaaggcgggcgcgcuuacagacaugccauggaggagcugcccgcuacgauugaaacacugaugcuccuggcccuuaucgccguucugaccggaggcgugacccucuucuuucugucugggcggggacugggcaagacaagcauugggcuccuuugugugauggcuuccagcguccugcuguggauggcgucuguugagccucacuggaucgccgcuuccauuauccucgaguucuuucugauggugcuucugauccccgagccggacagcaacgccacccgccaggauaaucagcucgccuauguggucauuggacugcuguucaugauccucacaguggcugccaacgagaugggccuucuggaaacgaccaaaaaggaccugggcauugggcauguugcgguggagaaucaccaccaugccgcuaugcucgaugucgaccugcacccugccucugcuuggacacuuuacgccguggcgaccacaaucauuacccccaugaugagacauacgaucgaaaacaccacagccaacauuucccugaccgcuaucgccaaucaggcugccauccucaugggacuggcuaagggcuggcccauuagcaaaauggauaucggggucccucugcucgcccuuggaugcuacucucaagugaacccgcugacacugaccgcgcccguucucaugcuggugccucacuaucccauuaucggcccugggcuucaggccaaggcuacgcgggaggcccagaaacgcacagcugccggaauuaugaagaaucccaccgucgacggcaucguggccaucgaucuggacccuguuguguacgaugcgaaauuugaaaagcaacucggccagauuaugcugcugauccucuguacaagccagauucuucugaugagaaccaccugggcucugugcgaguccaucacacucgccacggggccgcugaccacacuuugggagggaucucccggcaaguucuggaacaccacaauugcugucagcauggccaauaucuuccggggguccuaucuggccggagcuggccucgccuuuagccugaugaaaucccucgggggaggccgcagaggcaccggggcgcagggagaaacgcucggcgagaaguggaaacggcaacuuaaccagcugacaaagucugaguucaauaccuacaaaagaagcgggaucauggagguggaccgcuccgaagccaaggagggacugaagcggggcgagaccacaaaacauccugugucuagagggaccgcuaagcuccgcugguuuguugaacggacacuggucaaacccgagggaaaggugauugaucuuggcuguggcagagggggauggagcuauuacugcgccggccugaaaaaggugacggaagucaagggguauaccaaaggaggcccugggcacgaggaccccaucccgaugggaacauacggcuggaaccucguuaagcugcgcuccggcaaagauguguucuuuauuccucccgaaaagugugacacccugcucugcgacaucggggagucuagccccaauccuacaauugaggaaggacggacccuuagagugcugaaaauggucgagcccuggcugcgcggcaaccaguucuguaucaagauucucaauccuuacauggcuuccgugguugaaacgcuggagcagaugcaacggaaacacgggggaaugcuugugagaaacccgcugagccgcaauucuacccaugagauguauugggucuccuggggcacagggaacaucgugagcgccguuaauaugaccucucggaugcuccugaacagauuuacaauggcgcaccgcaagcccaccuacgaaagagauguggaccugggagccggcacacggcaugucgcuguggagccugaaguggccaaucucgauaucauuggccagcgcaucgagaacauuaagcacgaacacaaauccaccuggcauuaugacgaggauaaccccuacaagacgugggcuuaucacgggagcuacgagggaaaaccuucuggcuccgccagcuccauggucaaugggggaguuaagcugcuuacaaaacccugggacggcaucccgauggugacccagauugcuaugaccgauacaacgccuuucgggcagcaaagaguguuuaaggaaaaggucgacacccggacacccaaagccaagagaggcaccgcgcagaucauggaggugacagccaaauggcuguggggauuccucagccggaacaagaaaccucgcaucugcaccagagaagaguuuacacggaagguucgcucuaaugcugccauuggcgcuguguucgucgaugaaaaccaguggaauagcgccaaggaggccguggaggacgaaagauuuugggaucugguucaucgggagcgcgaacuucacaaacaagggaagugugcgaccugcguguauaacaugaugggaaaaagagagaagaaacugggcgaguucgggaaggcuaagggaucccgggccaucugguacauguggcucggcgcccgcuuccuggaguuugaggcucugggguucaugaaugaagaccauugguuuucuagagagaacagccucuccggcgucgaaggagagggccugcacaaacuuggguacauucugcgggacaucucuaagauucccggaggcaauauguaugccgaugacacggcugggugggauacccgcaucacagaggacgaucuccagaacgaagccagaaucaccgacauuauggagccugaacacgcgcugcuugccaaaagcaucuucaagcugacauaccagaauaaagugguucgggugcagcgccccgcuaagaacggaaccgucauggaugugauuuccagacgggaccaaagaggcucugggcaggucggcacguauggacucaauacauuuaccaacauggaggcccagcugauccgccagauggaaagcggcgggauuuucuccccgcgggagcuggagacaccuaaucucgcugaaagagugcuggauuggguugagaaauacggaguggaacgccuugagcggauggccaucagcggcgacgauugccugggggaacccaucuaugacagauuugcgaccgcccucacggcucugaacgauaugggaaagguccgcaaggacauuccccaaugggagccuucuaaaggcuggaacgacuggcagcaggggccguucuguucccaucacuuucaucagcuuaucaugaaggauggccgggagauuguggugcccugcagaaaucaagacgaacugguuggacgcgcccgggugagccagggcgcuggguggucucucagagagaccgccugucugggaaaauccuacgcucagauguggcagcugauggauuuccaccgccgggaccucagacuggccgcgaacgccaucuggagcgcuggcccuggggauuggauucccacacggagaaccacaugguccauccacgcccaucaccaauggaugaccacagaagacaugcuuucugucuggaaucgcguguggauugaggaaaacccuuggauggaggauaagacccauaucagcuccuggggagacguucccuaucugggcaaacgggaggaucaguggugcggcagccucaucgggcugacggccagagcuacaugggccaccaauauucagguggcgaucaaccaaguccgcagacuuauuggaaaugaaaacuaccuggacuacauggcuucuaugaagcgguuuaagaaugaguccgauccugaaggcgcccucugguga

SEQ ID NO: 19172 - RNA, 9879 nt, Artificial Sequence
  derived and/or modified CDS sequence (opt5) from DENV-1__KF921942__SS-prME
agcgugaccaugcugcucaugcugaugcccacagcccuugcuuuccaccugacgaccagaggcggggaaccucauaugaucgucuccaagcaggaacgggggaaaucucuccuguuuaagaccagcgccggcguuaacaugugcacccuuauugcgauggaccugggggaacucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucgcuaacccugccguucugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaacuggccgagacccagcacggaaccguccuggugcagauuaaguacgagggcacagacgcgccgugcaaaaucccuuucuccacccaagaugaaaaggggguuacacagaacggacggcuuaucacggcuaaucccauugugaccgacaaagagaagccugucaacaucgaagccgagccgcccuuuggcgagagcuauauugugaucggggccggagaaaaagcucucaagcugucuugguucaagaaaggcagcuccauugggaagauguuugaggccacagcuagaggcgcccgccggauggcgauccugggagauaccgccugggacuucggcucuaucgggggaguguuuacaagcgcuggcaaacucguucaucagauuuucgggaccgccuacggaguccuguuuuccggcgugagcuggacgaugaagaucgggauuggcgugcuucugaccuggcucggacucaauucuagauccacaagccugucuaugaccuguaucgcugucggccuugugacacucuaccuggggguuauggugcaggccgauuccggaugcgucauuaacuggaaaggccgcgaacugaagugugggagcggaaucuucgugaccaaugagguucacacauggaccgaacaauauaaguuucaggcggacuccccuaaacggcucucugccgcuauuggcaaggccugggaggagggggugugcggcaucagaagcgcuacgcgccuggaaaacaucauguggaaacagauuuccaacgagcuuaaucauauccugcucgaaaacgacaugaaguucacagucgugguuggagauguggccggcauucuggcccaggggaaaaagaugauccggccgcaacccauggaguacaaauauucuuggaaaagcuggggaaaggcuaagauuaucggcgcggacguccagaauaccaccuuuaucauugaugggccuaacacacccgaauguccugacgaucagagagccuggaauaucugggagguggaggacuacggauucggcauuuuuaccacgaacaucuggcugaaacuucgcgauuccuauacacaggugugcgaccaccggcucaugagcgcugccauuaaagauucuaaggccguccacgcugacaugggcuacuggaucgaauccgagaaaaaugaaaccuggaagcuggccagagcgagcuucaucgagguuaagacauguauuuggcccaaaucucauacccugugguccaacggggugcucgaaagcgagaugaucauuccgaagaucuauggaggcccuauuucucaacacaauuaccgccccggguacuucacacagaccgcuggaccuuggcaucugggcaaacuugagcuggauuuugaccucugcgaagggacgaccguggucguggaugagcacugcggaaaccggggccccagccugagaacaaccacaguuaccggcaagaucauccacgaaugguguugccgguccuguacgcugccuccccuucgcuucagaggggaggacggaugcugguauggcauggagauucggccggugaaagaaaaggaggaaaaucucgucaagagcauggugucugccggguccggagagguugacagcuuuucccugggccugcucuguaucucuauuaugaucgaagaggugaugagaagccgcuggucccggaaaaugcugaugacagggacccuugccgucuucuuucugcucauuaugggacagcugacauggaacgaucugaucagacuuugcauuauggugggcgcuaaugccucugaccgcaugggcauggggaccaccuaccuggcgcucauggcuacauucaagaugagaccuauguuugccguuggacugcuguuccggcgccugacgagcagagaggugcuucugcucaccaucggccugucccuggucgccucuguggaacuucccaacagccuggaggaacucggggauggacuggcuaugggcaucaugauucucaaacugcuuacagacuuucaaucccaucagcugugggccacccuccugagccugacauucaucaagaccacguuuucucuucacuaugcuuggaaaacaauggccauggugcuguccauugucagccucuucccccugugucucucuaccaccucccagaagacaaccuggcugccuguucuucuggggagccugggaugcaagccgcucacaauguuucugaucgcggagaauaaaauuuggggccggcgcucuuggccccuuaacgaaggcaucauggccguggggaucguguccauucugcucagcucccugcucaagaacgaugucccucuggcuggaccccuuaucgccggcgggaugcugauugcuuguuacgugaucagcggaucuagcgccgaccugucccucgagaaagccgcugagguuucuugggaagaggaagcggagcauagcggcgccucccacaauauucugguggaaguccaggaugacgggacgaugaagaucaaagaugaggagagagacgauacccuuacaauccugcucaaggcuacccugcucgccgugucuggaguuuauccucugagcauucccgccacacuuuucgugugguacuucuggcagaagaagaagcagcgguccggcguccugugggacaccccuucucccccggaaguggagcgcgcuguccuggaugacggcaucuauagaauuaugcagcgggggcuccugggacgcagccaggugggcguugggguguuucaagaaaacgucuuccauacgauguggcacgugaccagaggagccguucuuauguaccagggcaaacggcuggagccuuccugggcgagcgugaagaaagaccucaucucuuacgggggaggcuggagacugcagggcuccuggaauacaggggaggaaguccaggugauugcuguggagcccggaaagaacccuaaaaauguucaaaccgcccccggcacauuuaagaccccggaaggggaggucggagccaucgcucucgauuucaagccuggcacaagcgggucucccauugugaaccgcgaaggaaaaaucgugggccuguauggcaauggggucgugacgaccuccggaacauacguuagcgccaucgcgcaggcuaaggccucccaggagggcccucuucccgagauugaagacgagguguuucggaaaagaaaccugaccaucauggaucugcaccccgggucuggaaagacccgccgguaucucccugccauugucagagaagcuaucaaacgcaagcugcggacacuuauucuggccccgacgagagugguugcuagcgagauggccgaagcgcucaagggcaugcccauccgcuaccaaaccacagccgugaaauccgagcauaccgggaaggagaucgucgaccugaugugccacgcuacauucaccaugcggcugcucagcccugugagaguucccaauuauaacaugauuaucauggaugaagcccauuuuacggacccuucuuccauugcugcccggggcuacaucagcacacgcgugggaaugggcgaggccgcugcgauuuucaugaccgccacacccccugggucugucgaggcuuuuccgcagagcaaugccgugauccaggaugaggaaagagacauccccgagcgguccuggaacucuggauaugaguggauuacagauuucccuggcaaaaccgugugguuuguccccagcaucaaguccgggaaugacauugccaacugucuucgcaaaaauggaaagagaguuauccagcugucucggaagacauucgauaccgaauaccagaagacgaagaacaacgacugggacuacguggugacaaccgauauuagcgagaugggcgcuaauuucagagccgaccgcgucaucgauccucggagaugccugaaacccgugauucucaaggacgggccggaacgcguuauccuggcgggcccuaugcccgugacagucgcuuccgccgcccagcggagaggacgcaucggccggaaccacaauaaagagggggaucaguauauuuacaugggacagccccuuaacaaugacgaggaucaugcucacuggaccgaagccaagaugcugcucgacaacaucaauacgccugagggcauuauccccgcgcuguuugaaccugagagagaaaagagcgccgcuauugauggggaguaucgccugagaggagaggcccggaaaaccuucguggaacucaugcgcagaggcgaccuuccgguuuggcugucuuacaagguggcuuccgagggguuucaauauagcgaucggcgcuggugcuucgacggcgaaagaaacaaucagguccuggaggaaaacauggauguggagaucuggacaaaagagggagaacggaagaaacucagaccccgcuggcuggacgcccggaccuacuccgacccucuugcucugagagaguuuaaggaguucgccgcgggccgccggucugucagcggggaucucauccuggagauuggaaaacugccccagcaccucacacagagagcccaaaaugcucuugacaaccuggugaugcugcauaauuccgaacagggcgggcgggccuaucgccacgcuauggaggagcucccugauaccaucgaaacacugaugcuucuggcccucauugccguucugaccggaggcgugacgcuguuuuuccucucuggcagagggcuuggaaagacaagcaucggccugcugugugugauggcuuccagcguccuccuguggauggcgucuguugagccccauuggauugccgcuuccaucauccuugaauuuuuccugauggugcuccugauuccggagccugaccggcagcgcacaccccaagauaaccaacuggccuacguggucaucgggcuccuuuuuaugauucugaccguggccgcuaaugagaugggacugcucgaaaccaccaagaaagaccugggcaucgggcacguugccguggagaaccaccaucacgcggccaugcuugaugucgaccugcauccugcuagcgccuggacacucuacgcuguggccacgaccauuaucacacccaugaugagacacaccauugaaaacacaaccgcgaauaucucucugacggccaucgcuaaccaggccgcuauucugaugggacucgauaagggcuggccuaucuccaaaauggacauuggcgucccccuucuggcccuggggugcuauagccaggugaauccgcucacccugacagcugccguucuuaugcugguggcgcauuacgccaucauuggaccuggccuccaagcuaaggccacccgggaggcucagaaacgcacagccgccgggaucaugaagaaccccaccgucgauggaaucguggcgauugaccuggaucccguuguguaugacgcuaaguucgaaaaacagcugggccagaucaugcuccuuauucuguguacgucucaaauccugcucaugagaacaaccugggcccugugcgagagcauuacacuugcuaccgggccucugaccacacucugggagggauccccgggcaaguuuuggaauacgaccaucgccgucucuauggccaacaucuuccggggcagcuaccuggcuggggccggacuggcguucucccucaugaaaagccuuggcgggggacgcagaggcacaggggcccagggagaaacccugggcgagaaguggaaacggcagcugaaucagcucuccaagucugaauuuaacacauauaagagaagcggcauuauggagguggaccgcuccgaagcuaaagaggggcugaagcggggagagaccacgaaacacgccgugucuagaggcacagcuaaacuucgcugguucguugaacggaaucuggucaaacccgaggggaaggugaucgaucucggauguggcagagggggauggagcuacuauugcgccggccugaagaaagugaccgaagucaagggcuacaccaaagggggaccuggccacgaggaacccauuccuauggcgacauacggguggaaccugguuaagcuccauuccggaaaagacguguuuuucauucccccugagaagugugauacccuucugugcgacaucggcgagucuagcccgaaucccacaaucgaagaggggcgcacgcugcgggugcucaaaauggucgaaccuuggcugagaggaaaccaauuuuguauuaagauccuuaaucccuauaugccuuccgugguugagacccuggagcagaugcagcgcaagcacggcggcaugcucgugcggaacccccugagcagaaauucuacacaugaaauguacugggucuccugcgggaccggaaacaucgugagcgccguuaauaugacaucucgcaugcugcucaaccgguucaccauggcucacagaaaaccgacguaugagcgcgauguggaccugggcgccgggaccagacacgucgcuguggaaccugagguggccaaccuugauauuaucggacagcggauugaaaauaucaagcaugagcacaaauccacauggcauuacgacgaggauaaccccuauaagaccugggcuuaccacggcagcuaugaagucaaacccucuggguccgccagcuccaugguuaauggaguggugaagcugcucacaaagccuugggacgucauucccauggugacccaaaucgcgaugacagauaccacgccuuuuggccagcagcgcguuuucaaagagaagguggacacaagaaccccgaaagccaagcggggcaccgcucaaaucauggaagucacagccaaauggcuguggggguuucuuagcagaaacaagaagccccggauuuguacgcgcgaggaguucaccagaaaagugcggucuaaugcugccaucggagccguuuuuguggacgagaaccaguggaauagcgcgaaggaggcugucgaagaugagcgcuucugggaccuggugcauagagaacgggagcuccacaaacagggcaagugcgccacaugcguuuacaacaugauggggaaacgcgaaaagaagcugggagaguuuggcaaagccaagggguccagagcuauuugguacauguggcugggcgcccgguuccucgaguucgaagcucugggauuuaugaaugaggaucacugguucucucgcgaaaacagccuuuccggcguggagggggagggacugcauaaacucggcuauauccugagagacauuucuaagaucccugggggaaauauguacgccgaugacaccgcgggcugggauacacggaucaccgaagacgaucuucagaacgaggcccgcauuacagacaucauggaacccgagcacgcucugcucgccaaaagcauuuuuaagcugaccuaucaaaauaaagucgugagaguccagcggccugcuaagaacgggacggugauggauguuaucucccgcagagaccagcggggcucuggacaggugggcaccuacgggcugaauacauucaccaacauggaagcccaacucauuagacagauggagagcgagggaaucuuuucccccagcgaacuggagacaccgaaccuugcggaacgcguccuggauuggcucgagaaguauggcguggaacggcugaaaagaauggccaucucuggggacgacugugugguuaagccuauugaugaccgcuucgcuaccgcccuuacggcucugaaugauaugggaaaagugcggaaggacaucccccagugggagccuuccaaaggcuggaacgauuggcagcaaguccccuuuugcagccaucacuuccaccagcucauuaugaaggacgggagagagaucgugguuccuugucgcaaucaggaugaacuggugggccgggccagagucucucagggagcuggcuggucccugcgcgagacagccugccucggaaagagcuacgcgcaaauguggcagcugauguauuuucaucggagagaccuucgccuggccgcuaacgccauuuguuccgccgugcccgucgauuggaucccgaccucucggacaaccuggagcauucacgcucaucaccaguggaugacgaccgaagacaugcucuccguguggaauagaguuuggaucgaggaaaacccuuggauggaggauaaaacacauaucagcucuuggggagacgugcccuaccugggcaagcgggaggaccaauggugcgggucccuuauuggacugaccgccagagcgacaugggcuaccaauauccaggucgccauuaaccaggugcgccggcucaucggcaaugaaaacuaccuggauuauaugacaagcaugaaaagauucaagaaugagucugaccccgaaggggcccugugguga

SEQ ID NO: 19173 - RNA, 9879 nt, Artificial Sequence
  derived and/or modified CDS sequence (opt5) from DENV-1__JF937602__SS-prME
agcgugacaaugcugcucaugcugaugcccacagcccuugcuuuccaccugacgacccggggaggggagccucauaugaucguguccaagcaggaacggggaaaaucucuccuguuuaagacaagcgccggcguuaacaugugcacccuuauugcgauggaccugggggaguucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaggaacaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuucugacacaagaugaaaagggggugacccagaacggacggcugaucacagcuaaucccauugucacggacaaagagaagccugugaacaucgaagccgagccgcccuucggcgagagcuauauugugaucggggccggagaaaaagcucuuaagcucucuugguuuaagaaaggcagcuccauugggaagauguucgaggccaccgcuagaggcgcccgccggauggcgauccugggagauacagccugggacuuuggcucuaucgggggaguuuucaccagcgucggcaaacuggugcaucagauuuuugggacagcuuacggaguccuguucuccggcgucagcuggaccaugaagaucgggauuggcgugcugcuuacguggcugggacucaauucuagauccaccagccugucuaugacauguaucgccguuggccuggugacccuuuaccucggggucauggugcaggcugauuccggaugcguuauuaacuggaaaggccgcgaacugaagugugggagcggaaucuuugugacaaaugagguccacaccuggacagaacaauauaaguuccaggccgacuccccuaaacggcugucugcggccauuggcaaggcuugggaggagggggugugcggcaucagaagcgccacccgccucgaaaacaucauguggaaacagauuuccaacgagcugaauuacauccuucuggaaaacgacaugaagcucacgguuguggucggagauguggcuggcauucuggcccaggggaaaaagaugauccggccgcaacccauggaguauaaauacucuuggaaaagcuggggaaaggccaagauuaucggcgcugacgugcagaauacaaccuuuaucauugaugggccuaacacccccgaauguccugacgaucagagagcguggaauaucugggaggucgaggacuauggauucggcauuuuuacaaccaacaucuggcugaaacuucgcgauuccuacacgcagguuugcgaccaucggcucaugagcgccgcuauuaaagauucuaaggccgugcacgccgacaugggcuauuggaucgaauccgagaaaaaugaaacauggaagcuggcuagagccagcuucaucgaggugaagaccuguauuuggcccaaaucucacacacugugguccaacgggguccucgaaagcgagaugaucauuccgaagaucuacggaggcccuauuucucaacauaauuaccgccccggguauuucacccagacagcgggaccuuggcaccugggcaaacuugagcuggauuuugaccucugcgaagggaccacggugguuguggaugagcauugcggaaaccggggccccagccugagaaccacaaccgucacaggcaagaucauccacgaaugguguugccgguccuguacccugccuccccuucgcuucaaaggggaggacggaugcugguacggcauggagauuagaccggugaaggaaaaggaggaaaaucucguuaaaagcauggugucugcuggguccggagaggucgacagcuuuucccugggccugcucuguaucucuauuaugaucgaagaggugaugcggagcagauggucccgcaagaugcugaugacggggacacuugccguuuucuuucugcucauuaugggacagcugaccuggaacgaucugauccggcuuugcauuauggugggcgccaaugcuucugacagaaugggcauggggacaaccuaucuggcccucauggcgaccuucaaaaugcgcccuauguuugcugucggacuccucuucagacggcugacaagccgcgaggugcuucugcucacgaucggccugucccugguggccucugucgaacuucccaacagccuggaggaacucggggauggacuggccaugggcaucaugauucucaagcugcuuaccgacuuucaaucccaccagcugugggcuacacuccugagccugaccuucguuagaacaaccuuuucucuucauuacgccuggaaaacgauggcuauggugcuguccaucgugagccucuucccccugugucucucuacaaccucccagaagaccacauggcugccuguccuucuggggagccugggaugcaagccgcucaccauguuucugauugccgagaauaaaaucuggggccggaagucuuggccccuuaacgaaggcauuauggcgguggggaucguuuccauccugcucagcucccugcucaaaaacgaugugccucuggccggaccccuuauugcuggcgggaugcugaucgccuguuaugucauuagcggaucuagcgcugaccugucccucgagaaggccgccgugguuucuugggaggaagaggcugaacacagcggcgcgucccauaauauccugguggagguccaggaugacgggacaaugaaaauuaaggaugaagaaagagacgauacgcuuaccauccugcucaaagccacacugcucgcugugucuggagucuacccucugagcauccccgccacccuuuucgugugguauuucuggcaaaagaagaaacagagauccggcguucugugggacacaccuucucccccggagguggaacgggccguccuggaugacggcauuuaccgcaucaugcagagagggcuccugggacggagccaggugggcguugggguguuucaagagaacgucuuccacaccauguggcaugugacgcgcggagcugugcuuauguaccagggcaagagacuggaaccuuccugggccagcguuaaaaaggaccucauuucuuaugggggaggcuggcggcugcagggcuccuggaauaccggggaggagguccaggugaucgcgguggaacccggcaagaauccuaagaauguccaaacagcucccggcaccuuuaagacaagcgagggggaagugggagccauugcccucgauuucaaaccgggcaccucuggguccccuaucguuaacagagagggaaagauugugggccuguacggcaauggggucgugacaacgagcggaaccuauguuuccgcuaucgcccaggcgaaggcuucucaggaaggcccccuuccugagaucgaggacgaaguguuucgcaagcggaaccugacaauuauggaucugcaccccgggagcggaaaaaccagacgcuaccuccccgccaucguccgggaggccauuaagagaaagcugcgcacccuuauccuggcuccuacacgggugguugccuccgaaauggcugaggcccucaaaggcaugccgauuagauaucaaacgaccgcggugaaguccgaacacacagggaaagagaucgucgaccugaugugccaugccaccuucacaaugcgccugcucucucccgugcgggugccuaauuacaacaugaucauuauggaugaggcucacuuuaccgaccccuccagcaucgccgcuagaggcuauauuucuacgcgggucggaaugggcgaagccgccgcuaucuucaugacagcgaccccucccgggagcguugaggccuuuccucaguccaaugcugugauucaggaugaggaacgcgacaucccggaaagaucuuggaacagcggauacgaguggaucaccgauuuccccggcaagacagugugguuugucccuuccauuaaaucugggaaugacaucgccaacugucuucggaagaauggaaagcgcgugauucagcugagcagaaaaaccuucgauacagaguaccaaaagaccaaaaacaacgacugggacuauguugugacgacagauaucuccgaaaugggcgccaauuuccgggcugacagagucauugauccccgccggugccugaagccugugauccucaaagacgggcccgagagaguuauucuggccggcccgaugccugugaccgucgcgagcgcugcccagcgccggggaagaaucggccgcaaccauaauaaggaaggggaucaguacaucuauaugggacagccccuuaacaaugacgaggaucacgcccauuggacagaggcuaagaugcugcucgacaacauuaauacccccgaaggcaucauuccugcccuguuugagcccgaacgggagaaaucugcggccaucgauggggaauacagacugcgcggagaggcuagaaagacguucguggagcucaugcggcgcggcgaccuuccugucuggcuguccuauaaaguggccagcgaaggguuucaauacuccgauagacgguggugcuucgacggcgagcgcaacaaucagguucuggaagagaacauggauguggaaauuuggaccaaggagggagagcgcaaaaagcuccggccgagauggcuggacgcucgcacauauucugacccccuugcccugcgggaauuuaaagaguucgcugccggcagacgcagcguguccggggaucucauccuggaaaucggaaagcugccucagcaccucacccagcgggcgcaaaaugcccuugacaaccuggucaugcugcacaauucugagcagggcgggagagcuuaccggcaugccauggaggaacuccccgauacaauugagacccugaugcuucuggcucucaucgccguucugacaggaggcgugacccuguuuuuccucagcggccgcgggcuuggaaagacguccauuggccugcugugugugauggccagcucuguccuccuguggauggcuuccguggaaccucacuggaucgcggccagcauuauccuugaguuuuuccugaugguucuccugauccccgaaccggacagacagcggacaccucaggauaaccaacuggcuuacguggucauugggcuccuuuuuaugauccugaccguggccgccaaugagaugggacugcucgagaccaccaaaaaggaccugggcauugggcaugucgcuguggaaaaccaccaccaugccgcgaugcuugauguugaccugcaccccgccucugcuuggacccucuaugccguggcuacaacgaucauuaccccuaugaugcgccauacaaucgagaacaccacagccaauauuucccugaccgcgaucgccaaccaggcugccauccugaugggacucgauaaaggcuggcccauuagcaagauggacaucggcgucccucuucuggcucuggggugcuacucucaggugaauccccucacgcugaccgccgcuguucuuaugcugguggcccacuaugcgauuaucggaccgggccuccaagccaaagcuacaagagaagcccagaagcggaccgcugccgggauuaugaagaacccuacagucgauggaaucguggccaucgaccuggaucccgugguuuacgacgcgaaauucgagaagcagcugggccagauuaugcuccuuauccuguguaccagccaaauucugcucaugcgcacgacaugggcucugugcgaauccaucacccuugccacagggccccugaccacccucugggagggaucuccuggcaaauuuuggaauacaacgauugcugucagcauggccaacaucuucagaggcuccuaucuggccggggcuggacuggccuucagccucaugaagucccuuggcgggggacggcgcggcaccggggcgcagggagagacacugggcgaaaaauggaagagacagcugaaucagcucucuaagagcgaguuuaacaccuacaaacgguccggcaucauggaaguggacagaucugaggccaaggaagggcugaaacgcggagagacaaccaagcaugcugugagccggggcacggccaaacuuagaugguucgucgagcgcaaucugguuaagccggaagggaaggugauugaucucggauguggcagagggggaugguccuauuacugcgcuggccugaaaaaggugacagaggucaaaggcuacaccaaagggggacccggccacgaggagccuauccccauggccaccuauggguggaaccuggugaaacuccacucuggaaaggacguguuuuucauuccucccgaaaaaugugauacacuucugugcgacaucggcgagagcuccccuaauccgaccauugaggaagggagaacacugcgcguucucaagauggucgagcccuggcugcggggaaaccaauuuuguaucaagauucuuaauccuuacaugcccagcgugguugaaacgcuggagcagaugcagagaaaacauggcggcaugcucgugcgcaacccucugucuagaaauuccacccacgagauguauugggucagcugcgggacaggaaacaucgugucugcggugaauaugaccuccagaaugcugcucaaccgcuucacaauggcccaucggaagcccaccuacgaaagagaugucgaccugggcgcugggacgcgccacguugccguggagccggaaguggcuaaccuugauaucauuggacagagaaucgagaauauuaaacacgaacauaagagcaccuggcacuaugacgaggauaacccuuacaaaacaugggccuaucauggcucuuacgaggucaagcccuccgggagcgcuuccagcauggugaauggaguugugaagcugcucaccaaacccugggacgucaucccuauggugacacaaauugccaugaccgauacaacccccuuuggccagcagcggguuuucaaggaaaaaguggacacgcgcacaccuaaggcgaaaagaggcaccgcccaaaucauggaggucaccgcuaaguggcuguggggguuucuuucucggaacaagaaaccgagaaucuguacacgggaagaguucacgcgcaaggugagaagcaaugccgcuauuggagccguuuuuguggacgaaaaccaguggaacuccgccaaagaggcggucgaggaugaacgguucugggaccuggugcaccgcgagagagaacuccauaagcagggcaaaugcgcuaccugcgucuacaacaugauggggaagcgggagaagaaacugggagaauuuggcaaggccaaagggucucgcgccaucugguauauguggcugggcgcuagauuccucgaguucgaggcccugggauuuaugaaugaagaucacugguucagccgggagaacucccuuucuggcguggaaggggagggacugcacaagcucggcuacauucugcgcgacaucagcaaaauucccgggggaaauauguaugcugaugacacagccggcugggauaccagaaucacagaggacgaucuucagaacgaagcgaagaucaccgacauuauggagccugaacaugcccugcucgcuaaauccaucuuuaagcugacauaccaaaauaagguugugcggguccagcgccccgccaaaaacgggaccgugauggaugugauuucuagacgggaccagcgcggcagcggacagguuggcacguaugggcugaauaccuucacaaacauggaggcucaacucaucagacagauggaauccgagggaauuuuuagcccuucugagcuggaaacccccaaccuugccggccgggugcuggauuggcucgagaagcacggggucgaaagacugaaacgcauggcgaucuccggagacgacugugugguuaagccgaucgaugaccgguucgccacagcucuuaccgcccugaaugauaugggcaaagugagaaaggacauuccucagugggagcccagcaagggguggaacgauuggcagcaagucccuuuuugcucucaucacuuccaccagcucaucaugaaagacggccgcgaaauugugguccccugucggaaucaggaugagcuggugggacgggcucgcguuucccagggcgccggguggagccugcgggagacggcuugccucggaaaguccuacgcccaaauguggcagcugauguauuuucauagacgcgaccuucggcuggcggccaacgcuaucuguucugccgugccugucgauugggugcccacaagcagaaccacaugguccauucacgcccaucaccaguggaugaccacggaagacaugcucagcguuuggaaucgcguguggaucgaggaaaacccguggauggaggauaaaacccauauuucuuccuggggcgacgucccuuaccuggggaagcgggaagaccaauggugcggaagccuuaucggccugacagcuagagccaccugggcgacaaauauccagguggcuauuaaccaggugcggagacuccuggggaaugagaacuaccuggauuauaugaccucuaugaaacgcuucaagaaugagagcgaccccgaaggcgcccucugguga

SEQ ID NO: 19174 - RNA, 9879 nt, Artificial Sequence
  derived and/or modified CDS sequence (opt5) from DENV-1__GU131729__SS-prME
agcgugaccaugcugcucaugcugaugcccacagcccuugcuuuccaccugacgaccagaggaggggaaccucauaugaucguguccaagcaggaacgggggaaaucucuccuguuuaagacaagcgccggaguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugggaaaacuuugcauugaagccaagaucuccaauacgacaaccgauagccgcuguccgacccaaggcgaggcgacacugguggaagaacaagacgccaacuucgugugcagacggaccuuugucgaucgcggcugggggaauggauguggccucuucgggaaaggaucucugauuacaugcgcuaaguuuaagugcgugacgaaacuugagggcaagaucguucaguacgaaaaccugaaauauuccgugaucgucaccgugcacacaggggaccagcaucaaguuggaaaugagagcaccgaacacggcacaaccgccacgauuacaccccaagcuccuaccaccgagauccagcucacagacuacggcgcccugacccuggauuguucucccagaacggggcucgacuucaacgaaauggugcugcuuacaaugaaggagaaauccuggcugguccauaagcagugguuucucgaucugccucuucccuggaccagcggagccuccacaucucaagagaccuggaaucggcaggaccugcucgugaccuucaaaacagcucacgcgaagaagcaggaagucgugguucugggcagccaagagggggccaugcacacggcucugaccggagccacagaaauucagaccuccggcacaaccacgaucuuugccgggcaucucaaaugccgccugaagauggauaaacuuacacugaagggcaugagcuaugugauguguaccggaucuuucaaacucgagaaggaacuggcugagacccagcacggcacaguccuggugcagauuaaguacgaggggaccgacgccccgugcaaaaucccuuucuccacacaagaugaaaagggaguuacgcagaacggcagacuuaucaccgcgaaucccauugugacagacaaagagaagccugucaacaucgaagcugagccgcccuuuggggagagcuauauugugaucggagccggcgaaaaagcccucaagcugucuugguucaagaaagggagcuccauuggcaagauguuugaggcuaccgcccggggagcuagacgcauggccauccugggcgauacagcgugggacuucgggucuaucggaggcguguuuaccagcguugggaaacucguccaucagauuuucggaacggccuacggcgugcuguuuuccggggugagcuggaccaugaagaucggcauuggaguccuucugacauggcucggccucaauucucgguccaccagccugucuaugacauguaucgcuguggggcuuguuacccucuaccugggagugaugguccaggccgauuccggcugcgugauuaacuggaaagggagagaacugaaguguggaagcggcaucuucguuacaaaugaggugcacaccuggacggaacaauauaaguuucaggcugacuccccuaaacgccucucugccgcgauugggaaggccugggaggagggcgucugcggaauccggagcgcuacaagacuggaaaacaucauguggaaacagauuuccaacgagcuuaaucauauccugcucgaaaacgacaugaaguucaccgugguugugggcgaugucgccgggauucuggcucagggcaagaagaugauccgcccgcaacccauggaguacaaauauucuuggaaaagcuggggcaaggccaagauuaucggggccgacgugcagaauaccacauuuaucauugauggaccuaacacccccgaauguccugacgaucagcgggcuuggaauaucugggagguggaggacuacggcuucggcauuuuuacgacaaacaucuggcugaaacuuagagauuccuauacccaggucugcgaccaccgccucaugagcgcggccauuaaagauucuaaggcuguucacgccgacaugggguacuggaucgaauccgagaaaaaugaaacauggaagcuggcccgggcuagcuucaucgaggugaagaccuguauuuggcccaaaucucauacacugugguccaacggagugcucgaaagcgagaugaucauuccgaagaucuauggcgggccuauuucucaacacaauuacagacccggauacuucacccagacggccggcccuuggcaucuggggaaacuugagcuggauuuugaccucugcgaaggaaccacagucgugguugaugagcacugcggcaaccgcggccccagccugcggaccacaaccgugacggggaagaucauccacgaaugguguugcagauccuguacacugccuccccuucgguuccgcggagaggacggcugcugguaugggauggagauuagaccggucaaagaaaaggaggaaaaucucgucaagagcaugguuucugcgggauccggcgagguggacagcuuuucccuggggcugcucuguaucucuauuaugaucgaagaggucaugcggagcagauggucccgcaaaaugcugaugaccggaacacuugcuguguucuuucugcucauuaugggccagcugaccuggaacgaucugauccggcuuugcauuaugguuggcgccaaugccucugacagaauggggaugggaaccacauaccuggcucucauggccacguucaagaugcgcccuauguuugcggugggccugcuguucagacggcugaccagccgcgagguccuucugcucacaaucgggcugucccugguggcuucuguggaacuucccaacagccuggaggaacucggagauggccuggccauggggaucaugauucucaaacugcuuaccgacuuucaaucccaucagcugugggccacacuccugagccugaccuucaucaagacgacauuuucucuucacuaugcuuggaaaaccauggccaugauucuguccaucgucagccucuucccccugugucucucuaccacaucccagaagaccacauggcugccuguucuucugggaagccugggcugcaagccgcucacgauguuucugauugcugagaauaaaaucuggggcagacggucuuggccccuuaacgaagggaucauggccgugggaauuguguccauccugcucagcucccugcucaagaacgaugucccucuggcgggcccccuuauugccgggggaaugcugaucgcuuguuacgugauuagcggcucuagcgccgaccugucccucgagaaagcugccgagguuucuugggaagaggaagccgagcauagcggggcuucccacaauauccugguggaaguccaggaugacggaccuaugaagaucaaagaugaggagcgcgacgauacccuuacaauucugcucaaggcgacccugcucgccgugucuggcguuuauccccugagcaucccugcuacacuuuucgugugguacuucuggcagaagaagaagcagagauccggcguccugugggacacccccucuccgccugaaguggagcgggccguccuggaugacgggauuuaucgcaucaugcagagaggacuccugggccggagccagguggggguuggaguguuucaagaaaacgucuuccauacgauguggcacgugacccgcggcgccguucuuauguaccaggggaaaagacuggagcccuccugggcuagcgugaagaaagaccucauuucuuacggaggcggcuggcggcugcagggguccuggaauacaggagaggaaguccaggugaucgccguggagccuggcaagaaccccaaaaauguucaaaccgcgccggggacauuuaagaccccugaaggagaggucggcgcuauugcccucgauuucaagcccgggacaagcggaucuccuaucgugaacagagaaggcaaaaucgugggccuguaugggaauggagucgugacgaccuccggcacauacguuagcgccauugcucaggccaaggcgucccaggaggggccccuucccgagaucgaagacgagguguuucgcaaacggaaccugaccauuauggaucugcacccuggaucuggcaagaccagacgcuaucucccggcuaucguccgggaagccauuaaaagaaagcugcgcacacuuauccuggcccccacgcgggugguugcuagcgagauggccgaagcucucaaggggaugccuaucagauaccaaaccacagccgugaaauccgagcauaccggcaaggagauugucgaccugaugugccacgcgacauucaccaugcgccugcucagccccgugcggguuccuaauuauaacaugaucauuauggaugaagcccauuuuacggaccccucuuccaucgcugccagaggauacauuagcacacgggugggcaugggggaggcugccgccaucuucaugaccgcuaccccuccgggaucugucgaagcguuuccccagagcaaugccgugauccaggaugaggaacgcgacauuccugagagauccuggaacucuggcuaugaguggaucacagauuuccccgggaaaaccgugugguuugucccuagcauuaaguccggaaaugacaucgcuaacugucuucggaaaaauggcaagcgcguuauucagcugucuagaaagacauucgauaccgaauaccagaaaacgaagaacaacgacugggacuacguggugacaaccgauaucagcgagaugggggccaauuuccgggccgcuagagucauugacccccgccggugccugaaaccggugauccucaaggauggcccugaaagaguuauccuggccggacccaugcccgugacagucgcguccgcugcccagcgccggggcagaauugggcgcaaccacaauaaagagggagaccaguauaucuacaugggccagccucuuaacaaugaugaggaccaugcccacuggaccgaagcuaagaugcugcucgauaacauuaauacgcccgaggggaucauuccugcccuguuugaaccggagcgggaaaagagcgcggccaucgacggagaguauagacugcgcggcgaggcuagaaaaaccuucguggaacucaugcggcgcggggaucuucccguuuggcugucuuacaagguggccuccgagggcuuucaauauagcgacagacgguggugcuucgauggagaacgcaacaaucagguccuggaggaaaacauggacguggagaucuggacaaaagagggcgaaagaaagaaacuccggccuagauggcuggaugcucgcaccuacuccgacccccuugcccugcgggaguuuaaggaguucgcugccgggagacgcucugucagcggagaccucauucuggagaucggcaaacugccucagcaccucacacagcgggcgcaaaaugcccuugauaaccuggugaugcugcauaauuccgaacaagggggcagagcuuaucggcacgccauggaggagcuccccgacaccauugaaacacugaugcuucuggcucucaucgccguucugaccggcggcgugacgcuguuuuuccucucugggcgcggacuuggcaagacaagcauugggcugcugugugugauggccuccagcguccuccuguggauggcuucuguugagccgcauuggaucgcggccuccaucauucuugaauuuuuccugauggugcuccugaucccugagcccgauagacagcggaccccucaggacaaccaacuggcuuacguggucauuggacuccuuuuuaugauccugaccguggccgccaaugagaugggccugcucgaaacaaccaagaaagaucuggggauuggacacguugcuguggagaaccaccaucacgccgcgaugcuugacgucgaucugcaucccgccagcgcuuggacacucuacgccguggcuacgaccaucauuacaccuaugaugcgccacaccaucgaaaacacaaccgccaauaucucucugacggcgauugccaaccaggcugccauccugaugggccucgacaagggcuggcccauuuccaaaauggauaucggggucccgcuucuggcucugggaugcuauagccaggugaauccucucacccugacagccgcuguucuuaugcugguggcccauuacgcgauuaucggccccgggcuccaagccaaggcuaccagagaggcccagaaacggacagcugccggaaucaugaagaaccccaccgucgacggcauuguggccaucgaucuggacccuguuguguaugaugcgaaguucgaaaaacagcuggggcagauuaugcuccuuauccuguguacgucucaaauucugcucaugcgcacaaccugggcucugugcgagagcaucacacuugccaccggaccgcugaccacacucugggagggcucccccggcaaguuuuggaauacgaccaucgcugucucuauggccaacauuuucagagggagcuaccuggccggagcuggccuggccuucucccucaugaaaagccuugggggaggccggcgcgggacaggagcgcagggcgaaacccugggcgagaaguggaaaagacagcugaaucagcucuccaagucugaauuuaacacauauaagcggagcgggaucauggagguggacagauccgaagccaaagagggacugaagcgcggcgagaccacgaaacacgcugugucucgggggacagccaaacuuagaugguucguugaacgcacccuggucaaaccugagggaaaggugauugaccucggcugugggcggggaggcuggagcuacuauugcgcuggccugaagaaagugaccgaagucaagggguacacaaaaggaggccccgggcacgaggaaccuauccccauggccaccuacggauggaaucugguuaagcuccauuccggcaaagauguguuuuucauuccuccggagaagugugacacacuucugugcgauaucggggagucuagccccaacccuacgauugaagagggaagaacccugcgcgugcucaaaauggucgaacccuggcugcggggcaaucaauuuuguaucaagauccuuaacccuuauaugcccuccgugguugagacacuggagcagaugcagagaaagcacggcgggaugcucgugcgcaauccgcugagccggaacucuacccaugaaauguacugggucuccugcggaacaggcaauauugugagcgcgguuaacaugaccucuagaaugcugcucaaucgcuucacgauggcccaccggaaaccuaccuaugagagagacguggaucugggggcuggaacacgccacgucgccguggaacccgagguggcuaaccuugacaucauuggccagagaaucgaaaacauuaagcaugagcacaaauccaccuggcauuacgaugaggacaaucccuauaagacaugggccuaccacgggagcuaugaaggaaaaccuucuggcuccgcuagcuccaugggcaacggggucguuaagcugcucaccaagcccugggaugugaucccuauggugacacaaaucgccaugaccgacacgacaccguuuggacagcagcgggucuucaaagagaagguggauacccgcacccccaaagcgaagagaggcacagcccaaauuauggaaguuacggcuaaauggcuguggggguuucuuagccggaauaagaagccuagaaucuguacccgggaggaguucacacgcaaagugagaucuaacgccgcuauuggagccgucuuuguggacgagaaucaguggaacagcgccaaggaggcgguugaagacgagcgguucugggaucuggugcaucgcgaaagagagcuccacaaacagggcaagugcgcuaccugcgucuacaauaugauggggaaacgggaaaagaagcugggcgaguuuggaaaagccaagggcucccgcgccaucugguacauguggcugggggcuagauuccucgaguucgaagcccugggauuuaugaacgaggaccacugguucucucgggaaaauagccuuuccggcguggagggggagggacugcauaaacucggcuauauucugcgcgauaucucuaagauccccgggggcaacauguacgcugacgauacagccggaugggacaccagaauuacagaagaugaccuucagaaugaggcgcggaucaccgauauuauggaaccugagcacgcccugcucgcuaaaagcaucuuuaagcugacguaucaaaacaaaguugugcgcguccagagacccgccaagaauggcaccgugauggacgucauuucccggcgcgaucagagagggucuggacaggugggcacauacgggcugaacaccuucacaaauauggaagcucaacucauccggcagauggagagcgagggaaucuuuuccccgagcgaacuggagaccccuaaccuugccgaaagaguucuggacuggcucgagaaguauggcguggaacgccugaaacggauggcgauuucuggggaugacugugucgugaagcccaucgacgauagauucgccacggcucuuacagcccugaacgacaugggcaaagugcgcaaggauauuccucagugggagcccuccaaaggauggaaugacuggcagcaaguuccuuuuugcagccaucacuuccaccagcucaucaugaaggauggccgggagauugugguccccuguagaaaccaggacgaacugguggggcgcgcucggguuucucagggagccggcuggucccugagagagaccgcuugccucggaaagagcuacgcccaaauguggcagcugauguauuuucaucgccgggaucuuagacuggcggccaaugcuaucuguuccgccgugccggucgacuggauuccuacaucucgcaccacguggagcauccacgcccaucaccaguggaugaccacagaagauaugcucuccguguggaaccgggucuggaucgaggaaaaucccuggauggaggacaaaacccauauuagcucuuggggagaugugcccuaccugggcaagagagaggaccaauggugcgggucccuuaucggccugacagcucgggccaccugggcgacaaacauucagguugcuaucaaucaggugagacgccucauuggaaacgaaaauuaccuggacuauaugaccagcaugaaacgguucaagaacgagucugauccugaaggcgcccugugguga

SEQ ID NO: 19175 - RNA, 9879 nt, Artificial Sequence
  derived and/or modified CDS sequence (opt5) from DENV-1__GU131730__SS-prME
agcgugaccaugcugcugaugcugaugcccacagcccuugcuuuccaccugacgaccagaggaggggagccucauaugauugucuccaagcaggaacggggaaagucucuccuguuuaagacaagcgccggcguuaacaugugcacccuuauugcgauggaccugggggaguucugugaagauacaaugaccuacaagugcccgcgcaucacagaggcugaacccgacgauguggacuguuggugcaaugccaccgauacgugggugaccuauggaacauguucccagaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaggaacaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcgcgcugauagcggaugcguuauuaacuggaaaggccgggaacucaaguguggguccggaaucuuugugacaaaugagguccacaccuggacagaacaguauaaguuccaagccgacucuccuaaaagacugagcgcggccauuggcaaggcuugggaggagggggugugcggcauccgcuccgccacccggcuggaaaacaucauguggaaacagauuucuaacgagcucaaucauauccugcuugaaaacgacaugaagcugacgguuguggucggagauguggcuggcauucucgcccaggggaaaaagaugaucagaccgcagcccauggaguacaaauauagcuggaaguccuggggaaaggccaaaauuaucggcgcugacgugcaaaauacaaccuuuaucauugaugggccuaacacccccgaauguccugacgaucagcgcgcguggaauaucugggaggucgaggacuacggauucggcauuuuuacaaccaacaucuggcugaagcugcgggauagcuauacgcagguuugcgaccacagacuuaugucugccgcuauuaaagauuccaaggccgugcacgccgacaugggcuacuggaucgaaagcgagaaaaaugaaacauggaagcucgcucgcgccucuuucaucgaggugaagaccuguauuuggcccaaaucccauacacuguggagcaacgggguccuggaaucugagaugaucauuccgaagaucuauggaggcccuauuagccagcacaauuaccggcccggguacuucacccaaacagcgggaccuuggcaucucggcaaacuggagcuugauuuugaccugugcgaagggaccacggugguuguggaugagcacugcggaaacagaggccccucccuccggaccacaaccgucacaggcaagaucauccacgaaugguguugccgcagcuguacccugccuccccugagauucaaaggggaggacggaugcugguauggcauggagauucggccggugaaggaaaaggaggaaaaucuuguuaaaucuaugguguccgcugggagcggagaggucgacuccuuuucucucggccugcuguguaucagcauuaugaucgaagaggugaugagaucccgcuggucucggaagaugcucaugacggggacacuggccguuuucuuucuucugauuaugggacagcucaccuggaacgaucugaucagacugugcauuauggugggcgccaaugcuagcgaccgcaugggcauggggacaaccuaccuugcccugauggcgaccuucaaaaugagaccuauguuugcugucggacuccuguuccggcgccucacauccagagaggugcugcuucugacgaucggccucucucugguggccagcgucgaacugcccaacucccuugaggaacugggggauggacucgccaugggcaucaugauucugaagcuccugaccgacuuucagagccaucaacuuugggcuacacugcucucucugaccuucauccggacaaccuuuucccugcacuaugccuggaaaacgauggcuaugguucuuagcauugugucucuguucccccucugucuguccacaaccagccagaagaccacauggcucccugugcugcuugggucucugggaugcaagccgcugaccauguuucucaucgccgagaauaaaauuuggggccgcaaguccuggccccugaacgaaggcaucauggcggucgggaucgugagcauucuucuguccagccuccugaaaaacgauguuccucucgccggaccccugaucgcuggcgggaugcuuauugccuguuacgugaucucuggaagcuccgcugaccugucucuggagaaggccgccgucgugagcugggaggaagaggcugaacauuccggcgcgucucacaauauucucguugaggugcaggaugacgggacaaugaaaaucaaggaugaagagagagacgauacgcugaccauccuucugaaagccacacuccuggcugucagcggaguguauccucucuccauucccgccacccuguucgucugguacuucuggcagaagaagaaacaacggucuggcgugcuuugggacacaccuuccccucccgagguugaacgcgccgugcuggaugacggcaucuauagaauuaugcagcgggggcugcucggacgcucccaggucggcguggggguuuuucaggagaacguguuccauaccauguggcacgucacgagaggagcugugcugauguaccaaggcaagcggcuugaacccagcugggccucugugaaaaaggaccugaucuccuacgggggaggcuggagacuccagggcagcuggaauaccggggaggagguucaggucauugcgguggaacccggcaagaauccuaagaaugugcagacagcucccggcaccuuuaagacaucugagggggaagucggagccaucgcccuggauuucaaaccgggcaccuccgggagcccuauugugaaccgcgagggaaagaucguuggccucuauggcaaugggguggucacaacguccggaaccuacgugucugcuaucgcccaagcgaaagcuagccaggaaggcccccugccugagauugaggacgaaguuuuucggaagagaaaccuuacaaccauggaucugcaccccggguccggaaaaacccgccgguaucugcccgccaucgugagagaggccauuaagcgcaagcuccggacacugauccuugcuccuacgagagucguggccagcgaaauggcugaggcccugaaaggcaugccgauucgcuaccagaccacagcgguuaagucugaacauaccgggaaagagaucguggaccucaugugccacgccacauucaccaugcggcugcugucccccgucagagugccuaauuauaacaugaucauuauggaugaggcucauuuuacggaccccagcucuaucgccgcucggggcuacauuagcacacgcgugggaaugggcgaagccgccgcuaucuucaugaccgcgaccccucccggguccgucgaggccuuuccucaaucuaaugcuguuauucaggaugaagagagagacaucccggaacggagcuggaacuccggauaugaguggaucacagauuuccccggcaagaccgugugguuugugccuucuauuaaaagcgggaaugacaucgccaacugucuccgcaagaauggaaagagagucauucagcuuucccggaaaacauucgauaccgaguaccagaagacgaaaaacaacgacugggacuacgugguuacaaccgauaucagcgaaaugggcgccaauuucagagcugaccgcgugauugauccccggagaugccugaagccugucauccugaaagacgggcccgagcgcgugauucucgccggcccgaugccuguuacaguggcgucugcugcccaacggagaggacgcaucggccggaaccccaauaaggaaggggaucaguauaucuacaugggacagccccugaacaaugacgaggaucacgccccuuggaccgaggcuaagaugcuucuggacaacauuaauacgcccgaaggcaucauuccugcccucuuugagccggaaagagagaaauccgcggccaucgauggggaauaucgccugagaggagaggcucggaagaccuucgucgagcugaugcgcagaggcgaccuccccguguggcuuagcuacaaagucgccuccgaaggguuucaguauucugaucggcgcuggugcuucgacggcgagagaaacaaucaagugcuggaagagaacauggauguugaaauuuggacaaaggagggagagcggaaaaagcugagaccucgcuggcucgacgcucggaccuacagcgacccccuggcccuuagagaauuuaaagaguucgcugccggccgccgguccgugucuggggaucugauccucgaaaucggaaagcugccucagcaucugacacagagagcgcagaaugcccucgacaaccuugugaugcugcacaauagcgagcaaggcgggcgggcuuaucgccacgccauggaggaacugcccgauaccauugagacacucaugcugcuugcucugaucgccguccucaccggaggcguuacgcuguuuuuccuguccggcagagggcucggaaagacaagcauuggccuucugugugugauggccucuuccgugcugcucuggauggcuagcgucgaaccgcauuggaucgcggccucuauuauccuggaguuuuuccuuauggugcugcucaucccugaacccgaccggcagcgcaccccucaggauaaccagcuggcuuacguugugauugggcugcucuuuaugauccuuaccgucgccgccaaugagaugggacugcuggagacaaccaaaaaggaccucggcauugggcacguggcugucgaaaaccaucaccacgccgcgaugcuggauguggaccuucaucccgccuccgcuuggacacuguacgccguugcuacgaccaucauuacaccuaugaugagacacaccaucgagaacacaaccgccaauauuagccucacggcgaucgccaaccaagcugccauccugaugggacuggauaaaggcuggcccauuucuaagauggacaucggcgugccgcuccuugcucuggggugcuauagccaggucaauccucugacccucacagccgcugugcugaugcuuguugcccauuacgcgauuaucggacccggccugcaggccaaagcuacccgggaagcccaaaagcgcacagcugccgggauuaugaagaaccccaccguggauggaaucgucgccaucgaccucgauccugugguguaugacgcgaaauucgagaagcagcugggccagauuaugcugcucauccuuuguacgucccagauucugcugaugagaacaaccugggcucucugcgaaucuaucacacuggccaccgggccgcuuaccacacugugggagggaagccccggcaaauuuuggaauacgaccauugcuguuuccauggccaacaucuuccggggcagcuaccucgccggggcuggacuggccuucucccugaugaagucucucggcgggggacgcagaggcacaggggcgcaaggagagacccuuggcgaaaaauggaagcggcagcugaaucagcugagcaaguccgaguuuaacacauauaaaagaucuggcaucauggaagucgaccgcagcgaggccaaggaagggcucaaacggggagagaccacgaagcacgcuguguccagaggcacagccaaacugcgcugguucguggagcggaaucuugucaagccugaagggaagguuauugaucugggauguggcagagggggauggucuuacuauugcgcuggccucaaaaaggugaccgaggugaaaggcuacaccaaagggggacccggccaugaggaaccuauccccauggccacauacggguggaaccuggucaaacugcacagcggaaaggacguguuuuucauuccuccggaaaaaugugauacccuccuuugcgacaucggcgaguccagccccaauccuacaauugaggaagggcgcacgcugcggguucugaagaugguggagcccuggcucagaggaaaccaguuuuguaucaagauucugaauccuuauaugcccucugucguggaaacccuugagcaaaugcagcgcaaacacggcggcaugcugguucggaacccgcucuccagaaauagcacacaugagauguacugggugucuugcgggaccggaaacaucgucuccgcggugaauaugacaagccgcaugcugcugaaccgguucaccauggcccacagaaagccuacguaugaacgcgauguggaccucggcgcugggaccagacaugucgccguugagcccgaaguggcuaaccuggauaucauuggacagcggaucgagaauauuaaacacgaacacaagucuacauggcauuacgacgaggauaaccccuauaaaaccugggccuaccacggcuccuaugaggugaagccuagcggguccgcuagcucuauggucaauggagugguuaaacuucugacaaaacccugggacgugaucccuauggucacccagauugccaugacagauaccacgccguuuggccaacagcgcguguucaaggaaaaaguugacacaagaacccccaaggcgaaacggggcaccgcccagaucauggaggugacagcuaaguggcucuggggguuucugagcagaaacaagaaaccucggaucuguacgcgcgaagaguucaccagaaagguccgguccaaugccgcuauuggagccguguuuguugacgaaaaccaauggaacucugccaaagaggcgguggaggaugaacgcuucugggaccuuguccauagagagcgggaacugcacaagcagggcaaaugcgcuacaugcguguacaacaugauggggaagcgcgagaagaaacucggagaauuuggcaaggccaaagggagcagagccaucugguacauguggcugggcgcucgguuccuggaguucgaggcccucggauuuaugaaugaagaucauugguucucccgcgagaacucucugagcggcgucgaaggggagggacuucacaagcugggcuauauucucagagacaucuccaaaauucccgggggaaauauguacgcugaugacaccgccggcugggauacacggaucaccgaggacgaucugcagaacgaagcgaagaucacagacauuauggagccugaacacgcccuucuggcuaaaucuaucuuuaagcucaccuaucagaauaaggugguucgcgugcaaagacccgccaaaaacgggacggucauggaugugauuagccggcgcgaccagagaggcuccggacaggugggcaccuacgggcugaauacauucaccaacauggaggcucagcugauccggcaaauggaaagcgagggaaucuuuucuccguccgagcucgaaacaccuaaccuggccggcagaguucuugauuggcuggagaagcaugggguggaacgccucaaacggauggcgaucagcggagacgacugugucgugaagcccaucgaugacagauucgccaccgcucugacggcccuuaaugauaugggcaaaguucgcaaggacauuccucagugggagcccucuaagggguggaacgauuggcaacaggugccuuuuugcucccaccauuuccaccaacugaucaugaaagacggccgggaaauugucgugcccuguagaaaucaggaugagcucgucggacgcgcucgggugagccagggcgccggguggucccugagagagacagcuugccugggaaagucuuaugcccagauguggcaacucauguacuuucaccgccgggaccugagacuugcggccaacgcuaucuguagcgccguuccgguggauugggucccuaccucccgcacaaccuggagcauucaugcccaccaucaguggaugacgaccgaagacaugcugucuguguggaaucggguuuggaucgaggaaaaccccuggauggaggauaaaacacacauuuccagcuggggcgacgugcccuaucucgggaagagagaagaccaguggugcggaucucugaucggccuuaccgcucgggccacaugggcgaccaauauccaagucgcuauuaaccaggugagacgccugcucgggaaugagaacuaccuggauuacaugacaagcaugaaacgguucaagaaugaguccgacccugaaggcgcccugugguga

SEQ ID NO: 19176 - RNA, 9879 nt, Artificial Sequence
  derived and/or modified CDS sequence (opt5) from DENV-1__GU131731__SS-prME
agcgugaccaugcugcucaugcugaugcccacagcccuugcuuuccaccugacgacccggggcggggaaccucauaugaucgugacaaagcaggaacggggaaaaucccuccuguuuaagaccucugccggcguuaauaugugcacacuuauugcgauggaccugggggaacucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuuguuacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacguccagaauaccaccuuuaucaucgaugggccuaacacacccgaauguccugacgaucagagagcuuggaauauuugggagguugaggacuauggauucggcaucuuuaccacgaacauuuggcugaagcugcgcgauuccuacacacaggugugcgaccaccggcuuaugagcgcggccaucaaagauucuaaggcugugcaugccgacaugggcuauuggauugaauccgagaaaaaugaaaccuggaagcucgccagagcuagcuucaucgaggucaagacauguaucuggcccaaaucucacacccugugguccaacggggugcuggaaagcgagaugauuaucccgaagauuuacggaggcccuaucucucaacauaauuaucgccccggguacuucacacagaccgccggaccuuggcaccucggcaaacuggagcuugauuuugaccugugcgaagggacgaccguuguggucgaugagcacugcggaaaccggggccccagccucagaacaaccacagugaccggcaagauuauccaugaaugguguugccgguccuguacgcugccuccccugcgcuucaaaggggaggacggaugcugguacggcauggagaucagaccgguuaaggaaaaggaggaaaaucuugugaaaagcauggucucugcgggguccggagagguggacagcuuuucccucggccugcuguguauuucuaucaugauugaagagguuaugcggagcagauggucccgcaagaugcucaugacagggacccuggcuguguuccuucugcucaucaugggacagcugacauggaacgaucugauucggcuuugcaucauggucggcgccaaugccucugacagaaugggcauggggaccaccuaucuggcucucauggccacauuuaaaaugcgcccuauguucgcggugggacugcucuuuagacggcugacgagccgcgaggugcuucugcucaccauuggccugucccuggucgcuucuguugaacuucccaacagccuggaggaacucggggauggacuggccaugggcaucaugauccucaagcugcuuacagacuuccaaucccaccagcugugggccacccuccugagccugacauuuauuaaaaccacgcuuucucugcauuacgcuuggaagacaauggccauggugcucuccaucgugagccuguucccccucugucugucuaccaccucccagaagacaaccuggcuuccuguccugcuggggagccucggaugcaaaccgcugacaauguuucuuauuacggagaauaagaucuggggcagaaaaucuuggccccugaacgaaggcauuauggcuguggggguuguguccauccuccugagcucccuccugaagaacgaugucccucuugccggaccccugaucgcgggcgggaugcugauugccuguuaugugaucagcggaucuagcgcugaccucucccuggagaaagccgcugagguuucuugggaagaggaagccgagcacagcggcgccucccauaauauucuuguggaaguccaggaugacgggaccaugaagaucaaagaugaggagcgggacgauacacugaccauucuccugaaggcuacacuccuggcggugucuggagucuacccucuuagcauccccgccacccuguucgugugguauuuuuggcaaaagaaaaagcagcgcuccggcguucugugggacacgccuucucccccggaaguggagagagcuguccucgaugacggcaucuaccggauuaugcagcgcgggcugcuuggaagaagccaggugggcguugggguguuccaagaaaacgucuuccacaccauguggcacgugacacggggagccgugcugauguaucagggcaaacgccucgagccuuccugggccagcguuaagaaagaccugaucucuuacgggggaggcuggagacuccagggcuccuggaauaccggggaggaaguccaggugauugcuguggagcccggaaagaacccuaagaauguccaaacagcccccggcaccuuuaaaacaccggaaggggaggugggagcgaucgcucuggauuucaagccuggcacgagcgggucucccauuguuaaccgggaaggaaaaaucgugggccuuuacggcaauggggucgugaccacauccggaaccuauguuagcgccauugcccaggcuaaggccucccaggagggcccucugcccgagaucgaagacgagguguuuagaaaacgcaaccugaccaucauggaucuccaucccgggucuggaaagacacggagauaccugccugcgauuguccgcgaagcuaucaagcggaaacuuagaacgcugauucucgccccgacccgcgugguugccagcgagauggcugaagcccugaagggcaugcccauccgguaucaaacaaccgcugugaaauccgagcacacagggaaggagauugucgaccugaugugccaugccaccuucacgaugagacuccuuagcccugugcgcgugcccaauuacaacaugaucaucauggaugaagcgcacuuuacagacccuucuuccauugccgcucggggcuauaucagcaccagagucggaaugggcgaggccgcugccauuuucaugaccgccacacccccugggucuguugaggcuuuuccgcagagcaaugcggugauccaggaugaggaacgggacauucccgagcgcuccuggaacucuggauacgaguggaucaccgauuucccuggcaaaacagugugguuuguccccagcaucaaguccgggaaugacauugccaacugucugagaaagaauggaaaacgggugauccagcugucucgcaagaccuucgauacggaauaucagaagaccaagaacaacgacugggacuacguugugaccacagauauuagcgagaugggcgcuaauuuuagagccgaccgggucaucgauccuagacgcugccucaaacccgugauucugaaggacgggccggaacggguuauccuugccggcccuaugcccgugaccgucgcuuccgccgcgcagagacgcggacggauuggcagaacgcauaacaaggagggggaucaguacaucagcaugggacagccccugaauaccgcugaggaccacgccccuuggacagaagccaaaaugcuccuggauaacaucaauacccccgagggcauuaucccugcucuguucgaaccggagcgcgaaaagucugccgcgauugacggggaguaucggcucagaggagaggcccgcaaaacauucguggaacuuaugagacggggcgaucugcccgucuggcuguccuacaagguggcuagcgagggguuucaauauuccgaccgcagauggugcuucgauggcgaacggaacaaucagguucucgaggaaaacauggacguggagaucuggaccaaagagggagaacgcaagaaacugagaccucgguggcuugaugccagaacauacucugacccccuggcucuccgcgaguuuaaggaguucgccgcuggccggagaagcguguccggggaccugauucuggagaucggaaagcucccucagcaccuuacccagcgcgcccaaaaugcgcuggauaaccuggucaugcuccauaauucugaacagggcgggcgggccuauagacacgcuauggaggagcugcccgacacgaucgaaacacuuaugcugcucgcccugauugcuguucugaccggaggcgugacccucuuuuuccuuagcggccgggggcugggaaaaacauccaucggccugcucugugugauggccagcucuguccugcuuuggauggccuccguggagccgcauuggauugcugcgagcaucauucuggaauuuuuccucaugguucugcugaucccugagcccgaucgccagagaaccccucaggacaaccaacucgccuacguggucaucgggcuucuguuuaugauucugacaguggcugccaaugagaugggacuccuggaaacgaccaagaaagaucuuggcaucgggcacgucgccguggagaaccaccaucacgcuacaaugcuggacguugaucuccaucccgccucugcguggacccuguaugccguggcuacaaccauuaucacgccuaugaugcggcacaccauugaaaauacaaccgccaacaucucccugacagcuauugccaaccaggcggccauccucaugggacuugacaagggcuggcccaucagcaaaauggauauuggcgucccgcugcuggcucucgggugcuacucucaggugaauccucugacccuuacggccgcuguucugaugcucguggcccauuacgcuaucauuggacccggccugcaagccaaggcgacacgcgaggcccagaagagaaccgcugccgggaucaugaaaaaccccacagucgacggaauuguggcuaucgaucuggacccugugguuuaugaugccaaguucgaaaaacagcucggccagaucaugcuucugauucuguguaccagccaaauccuccugaugcggaccacaugggcccuuugcgaguccauuacgcuggcgaccgggccgcucacaacccugugggagggaucucccggcaaguuuuggaauacaaccaucgcugucagcauggccaacauuuuccgcggcuccuaccuggcuggggccggacucgccuuuagccuuaugaaaucccugggcgggggaagacggggcacgggggcucagggagaaacacugggcgagaaguggaagcgccagcucaaucagcugucuaaaagcgaguucaacaucuauaagagauccggcaucauggagguggaccggucugaagccaaagaggggcuuaagagaggagagaccacccgccacgcggugagccggggcacagccaaacugagaugguucgucgaacgcaaucucguuaagccugaggggaaggugauugaccugggauguggcagagggggaugguccuacuauugcgcuggccugaaaaaggugaccgaagucaaaggcuacacaaaagggggacccggccacgaggauccuauccccauggccacguauggguggaaccucgugaaacuucauucuggaaaggacgucuuuuucaccccuccggaaaaaugugauacacugcugugcgacauuggcgagagcucccccaauccuaccaucgaggaagggagaacacuccgcgugcugaagauggucgagcccuggcuucggggaaaccaauuuuguauuaagauccugaauccuuacaugcccagcgugguugaaacccucgagcagaugcagagaaaacacggcggcaugcuggugcgcaacccgcugucuagaaauuccacgcaugagauguacugggucagcugcgggaccggaaacauugugucugcugugaauaugacauccagaaugcuccugaaccgcuucaccauggcccaccggaagccuacauaugaaagagaugucgaccuuggcgcggggacccgccacguugccguggagcccgaaguggcuaaucuggauaucaucggacagagaauugagaacaucaaacaugaacacaagagcacauggcauuacgacgaggauaaccccuauaaaaccugggccuaccacggcucuuaugaggucaagccuuccgggagcgcuuccagcauggugaauggaguugugaagcuccugacgaaacccugggacgucauuccuauggugacacaaaucgccaugaccgauaccacaccguuuggccagcagcggguuuucaaggaaaaaguggacacgcgcacccccaaggcuaaaagaggcacagcccaaauuauggaggucaccgcgcgguggcuuuggggguuucugucuagaaacaagaagccucggaucuguacacgcgaagaguucaccagaaaagugcggagcaaugccgcuaucggagccguuuuuguggacgaaaaccaguggaacuccgcuaaggaggccgucgaggaugaacgcuucugggaccucgugcagaaagagagagaacugcauaagcagggcaaaugcgccacaugcgucuacaacaugauggggaagcgggagaagaaacugggagaauuuggcaaggcgaaagggucucgcgcuauuugguauauguggcucggcgccagauuccuggaguuugaggcccuuggauucaugaaugaagaucacugguucagccgggagaacucccugucuggcguggaaggggagggacuccacaagcugggcuacauccuucgcgacauuagcaaaauccccgggggaaauauguacgcugaugacaccgccggcugggauacgagaauuaccgaggacgaucugcaaaacgaagcuaagaucacagacaucauggagccugaacaugcccuccuggcgaccuccauuuuuaaacugacauaucagaauaagguugugcggguccagcgccccgccaagaacgggaccgugauggaugugaucucuagacgggaccagcgcggcagcggacaaguuggcacguacgggcucaauacauucaccaacauggaggcucagcugauuagacagauggaauccgagggaaucuuucuuccgagcgagcuggaaacaccuaaucucgccgagcgggugcuggauuggcuugaaaaauauggcgucgagagacugaagcgcauggcuauuucuggggacgacugugugguuaaacccaucgaugaccgguucgccaccgcgcucacggcccugaacgauaugggaaaggugagaaaagacaucccucagugggaacccuccaagggcuggaacgauuggcaacaggucccuuuuugcagccaccauuuccaccagcugauuaugaaggacgggcgcgagaucgugguccccugucggaaucaggaugagcucgugggcagagcucgcguuucucaaggagccggcuggucccugcgggaaaccgcuugccuugggaaaagcuacgcccagauguggcagcugauguauuuucacagacgcgaccuccggcuggcugccaacgcgauuuguuccgccgugccggucgauugggugccuacaucuagaaccacauggagcauccaugcucaccaucaauggaugaccacagaggacaugcuuuccguuuggaaucgcguguggauugaagagaaccccuggauggaagauaagacccacgucagcucuuggggagacgugcccuaccugggcaaacgggaggaccaguggugcgggucccucaucggacugacggccagagccacaugggcuagcaauauucagguggccaucaaccagguucggagacugaucggcaaugagaacuaucucgauuacaugaccucuaugaagcgcuucaaaaaugaaggggacccugagggcgcgcugugguga

SEQ ID NO: 19177 - RNA, 9879 nt, Artificial Sequence
  derived and/or modified CDS sequence (opt5) from DENV-1__GU131733__SS-prME
agcgugaccauguuccugaugcucaugcccaccgcccuggcuuuucaccuuacgaccagaggcggggaaccucauaugaucguguccaagcaggaacggggaaaaucucuccuguucaagacaagcgccggcguuaacaugugcacccugaucgcgauggaccuuggggaacugugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccucgccccucauguggggcugggacuggagaccagaacggaaacauggaugagcuccgagggcgcuuggaaacagauucagcggguugaaaccugggcccuccgccaccccggcuuuacagugaucgcucuguuccuugcccaugcgauugggaccucuaucacccagaagggaaucauuuuuauccugcucaugcuggugacaccuagcauggccaugagaugcgugggcauugggucccgggauuucguugagggacuuagcggcgcuacguggguggacguggugcuggagcacgggucuugugugaccacaauggccaaggauaaacccacccucgacaucgaacugcugaagacagaggucaccaacccugcuguucuccgcaaacugugcauugaagccaagaucuccaauacgacaaccgauagcagauguccgacccaaggagaggcgacacuuguggaagaacaggacgccaacuuugugugccggcgcaccuucgucgauagaggcuggggcaauggguguggacuguuuggcaaagggucucucauuacaugcgcuaaguucaagugcgugacgaaacuggagggaaagaucguucaguacgaaaaccuuaaauauuccgugaucgucaccgugcacacaggcgaccagcaucaaguugggaaugagagcaccgaacacggaacaaccgccacgauuacaccccaagcuccuacaaccgagauccagcugacagacuacggcgcccucacccuggauuguucuccccggacgggccuggacuuuaacgaaauggugcuccugacaaugaaggagaaauccuggcuuguccauaagcagugguuccuggaucucccucugcccuggaccagcggggccuccacaucucaagagaccuggaaucgccaggaccuucuggugaccuuuaaaacagcucacgcgaagaagcaggaagucgugguucucggaagccaagagggcgccaugcacacggcucugaccggggccacagaaauucagaccuccggaacaaccacgaucuucgccggccaucugaaaugcagacucaagauggauaaacugacacuuaaggggaugagcuaugugauguguaccggcucuuucaaacuggagaaggaacucgcugagacccagcacggaacaguccuggugcagauuaaguacgagggcaccgacgccccgugcaaaaucccuuuuuccacacaagaugaaaaggggguuacgcagaacggacggcugaucaccgcgaaucccauugugacagacaaagagaagccugucaacaucgaagcugagccgcccuucggcgagagcuauauugugaucggggccggagaaaaagcccuuaagcucucuugguuuaagaaaggcagcuccauugggaagauguucgaggcuaccgccagaggcgcucgccggauggccauccugggagauacagcgugggacuuuggcucuaucgggggaguguucaccagcguuggcaaacugguccaucagauuuuugggacggccuacggaguccuguucuccggcgugagcuggaccaugaagaucgggauuggcguccugcuuacauggcugggacucaauucuagauccaccagccugucuaugacauguaucgcugugggccugguuacccuuuaccucggggugaugguccaggccgauuccggaugcgugauuaacuggaaaggccgcgaacugaagugugggagcggaaucuuuguuacaaaugaggugcacaccuggacggaacaauauaaguuccaggcugacuccccuaaacggcugucugccgcgauuggcaaggccugggaggagggggucugcggcaucagaagcgcuacacgccucgaaaacaucauguggaaacagauuuccaacgagcugaaucauauccuucuggaaaacgacaugaaguuuaccgugguugugggagaugucgccggcauucucgcucaggggaaaaagaugauccggccgcaacccauggaguacaaauauucuuggaaaagcuggggaaaggccaagauuaucggcgccgacgugcagaauaccacauucaucauugaugggccuaacacccccgaauguccugacgaucagagagcuuggaauaucugggagguggaggacuacggauuuggcauuuucacgacaaacaucuggcugaagcugcgcgauuccuauacccaggucugcgaccaccggcuuaugagcgcggccauuaaagauucuaaggcuguucacgccgacaugggcuacuggaucgaauccgagaaaaaugaaacauggaagcucgccagagcuagcuucaucgaggugaagaccuguauuuggcccaaaucucauacacugugguccaacggggugcuggaaagcgagaugaucauuccgaagaucuauggaggcccuauuucucaacacaauuaccgccccggguacuuuacccagacggccggaccuuggcaucucggcaaacuggagcuugauuucgaccugugcgaagggaccacagucgugguugaugagcacugcggaaaccggggccccagccucagaaccacaaccgugacgggcaagaucauccacgaaugguguugccgguccuguacacugccuccccugcgcuuuagaggggaggacggaugcugguauggcauggagauucggccggucaaagaaaaggaggaaaaucuugucaagagcaugguuucugcgggguccggagagguggacagcuucucccucggccugcuguguaucucuauuaugaucgaagaggucaugagaagccgcuggucccggaaaaugcucaugaccgggacacuggcuguguuuuuccuucugauuaugggacagcucaccuggaacgaucugaucagacugugcauuaugguuggcgccaaugccucugaccgcaugggcauggggaccacauaccuugcucugauggccacguuuaagaugagaccuauguucgcggugggacuccuguuucggcgccucaccagcagagagguccugcuucugacaaucggccucucccugguggcuucuguggaacugcccaacagccuugaggaacugggggauggacucgccaugggcaucaugauucugaaacuccugaccgacuuccaaucccaucagcuuugggccacacugcucagccugaccuuuaucaagacgacauucucucugcacuaugcuuggaaaaccauggccaugguccuuuccauuguuagccuguuuccccucugucugucuaccacaucccagaagaccacauggcucccugugcugcuugggagccugggaugcaagccgcugacgauguuccucaucgcugagaauaaaauuuggggccggcgcucuuggccccugaacgaaggcaucauggccguggggaucgucuccauucuucugagcucccuccugaagaacgaugugccucucgcgggaccccugaucgccggcgggaugcuuauugcuuguuacguuaucagcggaucuagcgccgaccugucccuggagaaagcugccgaggugucuugggaagaggaagccgagcauagcggcgcuucccacaauauucucgucgaagugcaggaugacgggaccaugaagaucaaagaugaggagagagacgauacacugaccauccuucugaaggcgacacuccuggccguuucuggaguguauccucucagcauucccgcuacccuguucgucugguacuuuuggcagaagaagaagcagcgguccggcgugcuuugggacacgccuucucccccggaagucgagcgcgccgugcuggaugacggcaucuauagaauuaugcagcgggggcugcucggacgcagccagguuggcgugggggucuuccaagaaaacguguuucauaccauguggcacguuacaagaggagccgugcugauguaccagggcaaacggcuugagccuuccugggcuagcgucaagaaagaccugaucucuuacgggggaggcuggagacuccagggcuccuggaauaccggggaggaaguccaggugauugccguugagcccggaaagaacccuaaaaauguccaaacagcgcccggcaccuucaagacaccggaaggggaggugggagcuaucgcccuggauuuuaagccuggcacgagcgggucucccauugugaaccgcgaaggaaaaaucgucggccucuauggcaauggggugguuaccacauccggaaccuacgugagcgccaucgcucaggcccgggcgucccaggagggcccucugcccgagauugaagacgaggucuucagaaagcgcaaccuuaccaucauggaucugcaccccgggucuggaaaaacacggagauaucugccugcuauugugcgcgaagccaucaagcggaaacucagaacgcugauucuugccccgacccgcguuguggcuagcgagauggccgaagcucugaagggcaugcccauccgguaccaaacaaccgccgucaaguccgagcauacagggaaagagaucguggaccucaugugccacgcgaccuuuacgaugagacugcugagcccuguucgggugcccaauuauaacaugauuaucauggaugaagcccauuucacagacccuucuuccauugcugcccgcggcuacaucagcaccagagucggaaugggcgaggcugccgccauuuuuaugaccgcuacacccccugggucuguggaagcguucccgcagagcaaugccgugauccaggaugaggaacgggacauccccgagcgcuccuggaacucuggauaugaguggauuaccgauuuuccuggcaagacagucugguucguucccagcaucaaauccgggaaugacauugcuaacugucucagaaagaauggaaaacgggugauccagcuuucuagaaagaccuucgauacggaauaccaaaagaccaagaacaacgacugggacuacguggucaccacagauauuagcgagaugggcgccaauuuucgcgccgaccgggugaucgauccuagacgcugccugaagcccguuauucugaaagacgggccggaacgggugauccucgcuggcccuaugcccgucaccguggccuccgcggcucagagacgcggacggaucggcagaaaccacaauaaggagggggaucaguauauuuacaugggacagccccugaacaaugacgaggaucaugcccacuggacggaagccaaaaugcuucuggacaacaucaauaccccugagggcauuauccccgcucucuucgaaccugagcgcgaaaagagcgccgcgauugauggggaguauagacugcggggagaggcccgcaagacauuuguugaacugaugagacggggcgaccucccgguguggcuuucuuacaaagucgcuuccgagggguuccaauauagcgaucgcagauggugcuuugacggcgaacggaacaaucaggugcuggaggaaaacauggaugucgagaucuggaccaaggagggagaacgcaagaagcugcgcccccgguggcucgacgccagaacauacuccgacccucuggcucuuagagaguucaaagaauuugccgcuggccggagaucugugagcggggaucugauccucgagauuggaaagcugccccagcaccugacccagcgggcccaaaaugcgcucgacaaccuuguuaugcugcauaauuccgaacagggcgggcgcgccuauagacacgcuauggaggagcugccugauacaaucgaaacccucaugcugcuugcccugauugcugugcucacgggaggcgugacacuguucuuucugucuggccgggggcucggaaaaaccagcaucggccuucugugugucauggccuccagcguucugcucuggauggccucuguggagccccauuggauugcugcguccaucauccuggaguucuuucuuauggugcugcucauuccggagccugaccgccagagaacaccccaggauaaccaacuggccuacgucgugaucgggcuccucuucaugauucuuacaguugcugccaaugagaugggacugcuggaaaccacaaagaaggaccucggcaucgggcacguggccgucgagaaccaccaucacgcugccaugcuggauguggaccuucauccugcgagcgccuggacgcuguacgcugucgccaccacaauuaucacccccaugaugcggcacacaauugaaaacaccacggcuaauaucucucucaccgccaucgcgaaccaggccgcuauucugaugggacuggauaaaggcuggccuaucuccaagauggacauuggcgugccccuccuugcccuggggugcuauagccagguuaauccgcugacacucaccgcugccgugcugaugcuugucgcucauuacgccaucauuggaccuggccugcaagcgaaagccacacgcgaggcucagaagagaaccgccgcugggaucaugaaaaaccccacgguggauggaaucguugccauugaccucgaucccguggucuaugacgccaaguuugaaaagcagcugggccagaucaugcugcucauucuuuguacaucucaaauccugcugaugcggaccacaugggcgcucugcgagagcauuacccuggcuaccgggccucuuacaacgcugugggagggauccccgggcaaauucuggaauaccacaaucgccgugucuauggcuaacaucuuccgcggcagcuaccucgccggggccggacuggcuuuuucccugaugaaaagccucggcgggggaagacggggcaccggggcccagggagaaacacuuggcgagaaauggaagagacagcugaaucagcuguccaaaucugaguucaacaccuauaagcgcagcggcauuauggagguggaccgguccgaagcgaaggaggggcucaaaagaggagagacgacaaagcacgccguuucucgcggcaccgcuaaacugcggugguuugucgaaagaaaucuugugaagcccgaggggaaagugaucgaucugggauguggccgcgggggauggagcuacuauugcgccggccucaagaaggucaccgaaguuaaaggcuacacaaaaggcgggccugggcacgaggaacccauuccuauggcuaccuacggguggaaccuggugaaacugcauuccggaaaggacguguucuuuauucccccugagaaaugugauacacuccuuugcgacauuggcgagucuagcccgaaucccacgaucgaagaggggcggacccugagaguccugaagaugguggaaccuuggcuccgcggaaaccaauucuguauuaaaauccugaaucccuauaugccuuccguuguggagacacuugagcagaugcagcggaagcacggcggcaugcuggucagaaacccccucagccgcaauucuacccaugaaauguacuggguguccugcgggacaggaaacaucguuagcgccgugaauaugaccucucggaugcugcugaacagauuuacgauggcgcaccgcaagccgaccuaugagagagaugucgaccucggcgccgggacacggcacguggcuguggaaccugaggucgccaacauugauaucauuggacagcgcaucgaaaauauuaaacaugagcacaaguccaccuggcauuacgacgaggauaaccccuauaaaacaugggcuuaccacggcagcuaugaaguuaagcccucuggguccgccagcuccauggugaauggaguggucaaacugcuuaccaagccuugggacgugauccccaugguuacacaaaucgcuaugaccgauacgacaccuuucggccagcagagaguguuuaaggagaaagucgacacccggaccccgaaggccaaaagaggcacagcgcaaauuauggaagugacggccaaguggcuguggggguuccucagccggaacaaaaagccccgcaucuguaccagagaggaauuuacacggaagguucgcucuaaugcugccauuggagcuguguucgucgacgagaaccaguggaauagcgccaaagaggccguggaagaugagagauuuugggaccugguucaucgggaacgcgagcuucacaagcagggcaaaugcgcgaccugcguguacaacaugauggggaagagagagaaaaagcugggagaguucggcaaggcuaaagggucccgggccaucugguacauguggcucggcgcccgcuuccuggaguuugaagcucugggauucaugaaugaggaucacugguuuucuagagaaaacagccucuccggcgucgagggggagggacugcauaaacuuggcuauauucugcgggacaucucuaaaaucccugggggaaauauguacgccgaugacacagcuggcugggauacccgcauuacagaagacgaucuccagaacgaggccagaaucaccgacauuauggaacccgagcacgcgcugcuugccaagagcaucuucaaacugacguaucaaaauaaggugguccgggugcagcgcccugcuaaaaacgggaccguuauggaugugauuuccagacgggaccagagaggcucuggacaggucggcacauacgggcucaauaccuuuacaaacauggaagcccaacugauccgccagauggagagcgagggaaucuucucccccagcgaacuggagaccccgaaccucgcugaacgggugcuggauuggcuugagaaguauggcguggaaagacugaagcgcauggccauuucuggggacgacuguguugugaaaccuaucgaugaccgguuugcgacggcccucacagcucugaaugauaugggaaaggucagaaaagacauuccccagugggagccuuccaagggcuggaacgauuggcagcaagugcccuucugcagccaucacuuucaccagcuuaucaugaaagacgggcgcgagauuguugugccuugucggaaucaggaugaacuggucggcagagcccgcgugucucagggagcuggcuggucccuccgggagaccgccugccugggaaagagcuacgcucaaauguggcagcugauguauuuccauagacgcgaccuccggcuggccgcgaacgccaucuguuccgcuguccccguggauuggauuccgacaucuagaaccacguggagcauccacgcccaucaccaguggaugaccacagaagacaugcuuuccguuuggaaucggguguggaucgaggaaaacccuuggauggaggauaagacccauauuagcucuuggggagacguccccuaccugggcaaaagagaggaccaauggugcgggucccucaucggacugacagcccgcgcuaccugggccacaaauauucagguggcgaucaaccagguucggagacuuauuggcaaugaaaacuaccuggauuauaugaccagcaugaagcgcuuuaaaaaugagucugaccccgaaggggcucucugguga

SEQ ID NO: 19178 - RNA, 9879 nt, Artificial Sequence
  derived and/or modified CDS sequence (opt5) from DENV-1__GU131734__SS-prME
agcgugacaaugcugcucaugcugaugcccacagcccuugcuuuccaccugacgaccagaggcggggaaccucauaugaucgucuccaagcaggaacggggaaaaucucuccuguuuaagacaagcgccggcguuaacaugugcacccuuauugcgauggaccugggggaguucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacagauccugccguucuccgcaaacugugcauugaagcgaagaucuccaacaccacgacagacagcagauguccgacccaaggagaggccacccuuguggaagaacaagaugcuaauuuugugugccggcgcacauucgucgacagaggcuggggcaacggguguggacuguuuggcaaagggucucucaugaccugcgccaaguucaagugcgugacaaaacuggagggaaagauuguucaguacgaaaaucuuaaauauuccgugaucgucacggugcacaccggcgaccagcaucaaguugggaacgagagcacagaacacggaaccacagcuaccaucacgccccaggccccuucuaccgagauucagcugacagauuacggcgcccucacccuggacuguagcccccggacaggccuggauuuuaaugaaauggugcuccugaccaugaaggagaaaagcuggcuuguccauaagcagugguuccuggaccucccucugcccuggacguccggggcuucuacaagccaagagaccuggaaccgcaaagaucuucuggugacauuuaagaccgcgcacgccaagaaacaggaagucgugguucucggaucccaggagggcgcuaugcacaccgcccugacaggggccacggaaauccaaaccagcggaacaaccacaauuuucgcuggccaucugaagugcagacucaaaauggacaagcugacccuuaaagggaugucuuaugugauguguacggauuccuucaagcuggagaaggaagucgccgagacacagcacggcaccgugcucguucagaucaaauacgagggaaccgacgcgccgugcaagauuccuuuuagcacacaggaugaaaaaggcgugacccaaaaugggcggcugaucacagcuaaccccaucgucacggacaaggagaaaccugugaauauugaagccgagccgcccuucggagagucuuauaucgugauuggcgccggggaaaaggcucugaaacuuagcugguuuaaaaagggauccucuaucggcaaaauguucgaggccaccgcuagaggggcccgccggauggcgauucucggcgauacagccugggacuuuggaagcaucggcgggguuuucaccuccgucggaaagcuggugcaucagaucuuuggcacagcuuacggggugcuguucagcggagucucuuggaccaugaaaauuggcaucggggugcuccugacguggcuuggccugaacuccagaagcaccucucucuccaugacauguauugccguuggacuggugacccuguaccuuggcgucauggugcaggcugacagcgggugcguuaucaauuggaagggacgcgaacucaaguguggcuccgggauuuuugugacaaacgagguccacaccuggacagaacaguauaaauuccaagccgauucuccuaagcggcugagcgcggccaucggaaaggcuugggaggagggcgugugcgggauuagauccgccacccgccuggaaaauaucauguggaagcagaucucuaacgagcucaaccauauucugcuugaaaaugacaugaaauuuacgguuguggucggcgauguggcuggaauccuggcccagggcaagaaaaugauucggccgcagcccauggaguacaaguauagcuggaaguccugggggaaagccaagaucauuggagcugacgugcaaaacacaaccuucaucaucgauggcccuaauacccccgaauguccugacgaucagagagcguggaacauuugggaggucgaggacuacggguuuggaaucuucacaaccaauauuuggcucaaacugcgcgauagcuauacgcagguuugcgaccaccggcugaugucugccgcuaucaaggauuccaaagccgugcacgccgacaugggcuacuggauugaaagcgagaagaacgaaacauggaaacuugcuagagccucuuucaucgaggugaaaaccuguaucuggcccaagucccauacacucuggagcaauggcguccuggaaucugagaugauuaucccgaaaauuuaugggggaccuaucagccagcacaacuaccgccccggcuacuuuacccaaacagcggggccuuggcaucugggaaagcucgagcuggauuucgaccuuugcgaaggcaccacggugguuguggacgagcacugcgggaaucggggacccucccugagaaccacaaccgucacaggcaaaauuauccacgaaugguguugccggagcuguacccucccuccccugcgcuuuaagggcgaggaugggugcugguauggaauggagaucagaccggugaaggaaaaagaggaaaaccugguuaagucuaugguguccgcuggcagcggggaggucgacuccuucucucuuggacuccuguguauuagcaucaugauugaagaggugaugcgguccagauggucucgcaaaaugcugaugacgggcacacucgccgucuuuuuccugcuuaucauggggcagcugaccuggaaugaucucauucggcugugcaucauggugggagccaacgcuagcgacagaaugggcaugggcacaaccuaccuggcccuuauggcgaccuuuaagaugcgcccuauguucgcugucgggcugcucuuuagacggcugacaucccgcgaggugcuccugcuuacgauuggacugucucucguggccagcgucgaacugcccaauucccuggaggaacuuggcgaugggcuggccaugggaaucaugauccucaaacugcucauugacuuccagagccaucaacugugggcuacccuucugucucucacauuuaucaagaccacauucucccugcacuaugccuggaagaccauggcuaugguucugagcauugugucucuuuuuccccugugucucuccacgacaagccagaaaaccaccuggcugccugugcuccugggcucucuugggugcaagccgcugacaauguuccugaucgccgagaacaaaauuuggggaagaaaguccuggccccucaaugaaggcaucauggcggucggcaucgugagcauucugcuuuccgcccugcucaaaaacgauguuccucuggcugggccccucaucgccggaggcaugcugauugcuuguuacgugaucagcgggucuagcgccgaccuuucccuggagaaggccgcugaggucucuugggaagaggaagcggagcauagcggagccucccacaacauucugguggaaguucaggaugacggcaccaugaaaaucaaggaugaggagcgggacgauacacucacgauccugcuuaaggcuacccugcucgccgugucuggggucuauccucugagcauucccgccacacucuucgugugguacuuuuggcagaaaaagaaacaacgcuccggaguccugugggacaccccuucucccccggaaguggagagagcuguucuugacgauggcaucuaucggauuaugcagcgcggccugcuggggagaagccaggugggagucggcguguuccaggaaaauguuuuucauacaauguggcacgugaccagaggggccguccucauguaccaaggaaagcgccuggagccuuccugggcgagcgugaaaaaggaccuuaucucuuacggcgggggauggagacugcagggcuccuggaacacgggcgaggaagugcagguuauugcugucgagcccgggaagaauccuaaaaacgugcagaccgcccccggaacauucaagaccagcgaaggcgaggugggggccaucgcucucgauuuuaaaccgggaacaucuggcuccccuauugucaaucgggaagggaagaucgugggacuguauggcaacggcguugugaccacaagcgggacguacgucuccgccaucgcgcaagcuaaagccucucaggagggaccccucccugagauugaagacgagguguucagaaagcgcaaucugaccaucauggaucuucaccccggcagcgggaagacacggagauaucugcccgccauuguucgcgaagcuaucaaacggaagcugagaacccucauucuggccccuacccgcguggucgcuuccgagauggccgaagcgcuuaaaggaaugccgauccgguaccagacaacggccgugaaguccgagcauaccggcaaagagaucguugaccugaugugccacgcuacauuuaccaugagacuccugucucccgugcgcgucccuaacuauaauaugauuaucauggaugaagcccauuucacagaccccuccagcauugcugcccggggguacaucucuaccagagugggcaugggagaggccgcugcgauuuuuaugacggccacaccucccggcagcguggaggcuuucccucaauccaacgccgucauccaggaugaagaacgggacaucccggagcgcucuuggaauagcggguaugaguggauuaccgauuuucccggaaagaccguuugguucgugccuuccaucaagucuggcaacgacauugccaauugucugcgcaagaacgggaagcgggugauccagcucagccgcaaaacauucgacaccgaauaccagaagaccaagaauaacgauugggacuacgucgugaccacggauauuuccgagaugggagcuaacuuuagagccgaccggguuaucgaucccagacgcugccuuaagccugugauucugaaggacggccccgaacgggucauccuggcggggccgaugccugugacaguugcuagcgccgcccaaagacgcggccggaucggaagaaaucacaacaaagagggcgaucaguauauuuacauggggcagccccucaauaacgacgaggaucaugcucacuggaccgaagccaagaugcugcuugacaauaucaacacacccgagggaauuaucccugcgcuguucgaacccgagcgcgaaaaaucugccgcuauugauggcgaguaucggcucagaggggaggcccgcaagaccuuuguggaacugaugagacggggagaccugccugucuggcucuccuacaaaguggcuagcgagggcuuccaguauuccgaucgcagauggugcuuugacggggaacggaauaaccaaguccuugaggaaaauauggacguggagaucuggacgaaggagggcgaacgcaaaaagcugagaccgcgguggcuggaugccagaaccuacucugacccccucgcucugcgcgaguucaaggaauuugccgcgggacggagaagcguuuccggcgaucuuauccuggagauugggaaacucccucagcaccugacacagcgcgcccagaacgcucuggacaaucucgugaugcuucauaacucugaacaaggaggccgggccuauagacacgcuauggaggagcugcccgauaccaucgaaacacugaugcuccuggcccuuauugccgugcugaccgggggagucacacucuucuuucugagcggccggggccuggggaagaccuccaucggacuccuuuguguuauggcuagcucugugcugcuguggauggcguccguggagccucauuggauugccgcuagcaucauccucgaguucuuucugaugguccuucugauucccgagccggaccgccagagaacgccucaggauaaucagcucgccuacgugguuaucggccugcuguucaugauucucacaguggccgcuaacgagauggggcuucuggaaaccaccaaaaaggaccugggaaucggccacgucgccguggagaaucaccaucacgcggccaugcucgaugucgaccugcaucccgcuucugccuggacacuuuacgcuguggccaccacaauuaucacgccuaugaugcggcacaccauugaaaacacaaccgcgaacaucucccugacagccaucgcuaaucaagccgcuauucucauggggcuggauaaaggauggcccaucagcaagauggacauuggcguuccucugcucgcccuuggcugcuauucucaggugaacccccugacccugacggcugccguccucaugcugguggcgcauuacgccaucauugggccgggacuucaggcuaaggccacccgcgaggcucagaaacggacagccgccggcaucaugaagaauccuaccguugaugggaucguggcgauugaccuggaccccgucguguaugaugcuaaauuugaaaagcagcucggacagaucaugcugcugauucucuguacaagccagauccuucugaugcggaccacgugggcccugugcgaguccauuacacucgcuaccggcccccugacaacccuuugggaggggucuccuggaaaauucuggaacaccacaaucgccgugagcauggccaauaucuuccgcggcuccuaccuggcuggcgccgggcucgcguuuagccugaugaagucccugggaggcgggagacggggaacgggcgcccaaggggaaacccucggagagaaguggaaacgccagcuuaaccagcugucuaagagcgaguucaauacauauaaaagauccggcauuauggagguugaccggucugaagcuaaggagggccugaaaagaggggagaccacaaagcacgccgucagccgcggaaccgcuaagcuccggugguuuguggaaagaaaccuggugaaaccggagggcaaggucaucgaucuuggguguggacgcggcgggugguccuacuauugcgccggacugaaaaagguuacggaagugaaaggcuacacaaagggcgggcccggacacgaggaaccuauucccauggcgaccuacggcuggaaucucgugaaacugcauucugggaaggacgucuucuuuaucccucccgagaagugugauacccugcucugcgacauuggagagagcuccccuaacccgacaaucgaagagggccggacccuuagagugcugaaaaugguugaacccuggcugcgcgggaaucaguucuguauuaagauccucaacccuuauaugcccagcguggucgagacacuggagcaaaugcagcggaaacacggaggcaugcuugugagaaauccucugucucgcaacuccacgcaugaaauguacuggguuagcugcggcaccgggaauaucgugucugccgucaacaugacaucccggaugcuccugaauagauuuaccauggcucaccgcaagcccacauaugagcgggauguggaccugggagccggcaccagacacguggcugucgaaccggagguugccaaccucgauauuaucgggcagcgcauugaaaacaucaaacaugagcacaagagcacguggcauuacgacgaggauaauccuuauaagaccugggcuuaccacggaucuuaugaagugaaacccuccggcagcgccuccagcauggugaacggggucgugaagcugcuuacaaaacccugggacguuauuccuauggugacccagaucgcgaugacagacaccacacccuucggacaacagagagucuuuaaggagaaaguggauacccggacgccuaaggccaagcgcggcacagcucagaucauggaaguuaccgccaaauggcuguggggcuuccucucuagaaauaagaaaccgcggauuuguaccagagaggaauuuacacggaaggugcgcagcaacgcugccaucggggccgucuucguggacgagaaucaauggaacuccgcgaaagaggcuguugaagaugagagauuuugggaccuggugcaucgggaacgcgagcuucacaagcagggaaagugcgccacgugcgucuacaauaugaugggcaaaagagaaaagaaacugggggaguucggaaaggccaaaggcucucgggcuauuugguacauguggcucggggcccgcuuccuggaguuugaagcucugggcuucaugaacgaggaucacugguuuagcagagaaaauucccucucuggaguggagggcgaggggcugcauaaacuuggauauauccugcgggacauuagcaaaauccccggcgggaacauguacgccgaugacaccgcgggaugggauacacgcaucaccgaagacgaucuccagaaugaggccaagauuacagacaucauggaaccugagcacgcucugcuugccaaguccauuuucaaacugaccuaucagaacaaggucgugagaguucaacggcccgcuaaaaauggcacagugauggaugucaucucucgcagagaccagcgggggagcggccaggugggaaccuacggccucaacacguuuaccaauauggaagcccagcugauucgccaaauggaguccgaggggaucuucagcccuucugaacuggagacacccaaccucgcgggaagagugcuggacuggcuugaaaagcauggcguugagcggcugaaaagaauggccaucuccggggaugacuguguggucaagccgauugaugaccgcuuugcugccgcucucaccgcccugaacgauaugggaaaggugcggaaagacaucccucagugggaacccagcaagggcuggaaugauuggcagcagguuccuuucugcucucaccacuuucaucaacuuauuaugaaagacgggagagagaucgugguccccugucgcaaccaggaugagcuggugggccgggcuagagucucccagggagccggcuggagccuccgcgaaacagcgugccuggggaaguccuaugcccagauguggcaacugauguacuuccaccggagagaccuccgccuggcugccaaugccauuuguucugcugugccuguugauugggugcccaccagccggacgacaugguccauccaugcccaccaucaguggaugaccacagaggacaugcuuagcgucuggaacagaguguggauugaagagaauccguggauggaagacaaaacccacaucucuuccuggggagauguuccuuaucugggcaagcgcgaggaccaguggugcgggagccucaucggacugacggcgcgggcuaccugggccacaaacauucaaguggccaucaaucaggucagacggcuuauuggcaacgagaauuaccuggauuacaugaccucuaugaagagauuuaaaaacgaaagcgaccccgagggggcucucugguga

SEQ ID NO: 19179 - RNA, 9879 nt, Artificial Sequence
  derived and/or modified CDS sequence (opt5) from DENV-1__GU131738__SS-prME
agcgugaccaugcugcucaugcugaugcccaccgcccuugcuuuccaccugacgaccagaggaggggagccucauaugaucgugaccaagcaggaacggggaaaaucccuccuguuuaagaccucugccggcguuaauaugugcacgcuuauugcgauggaccugggggagcucugugaagauaccaugacguacaaaugcccccgcaucaccgaggcugaacccgacgauguggacuguuggugcaaugccacggauaccugggugacauauggaaccuguagccaaacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuauccagaacggacggcugauuacagcuaaucccaucgugacggacaaagagaagccugucaacauugaagccgagccgcccuuuggcgagagcuauaucgugauuggggccggagaaaaagcucuuaagcucucuugguucaagaaaggcagcuccaucgggaagauguuugaggccaccgcuagaggcgcccgccggauggcgauccugggagauacagccugggacuucggcucugucgggggaguuuuuaccagcgucggcaaacuggugcaucagauuuucgggacagcuuacggagugcucuuuuccggcgucagcuggaccaugaagaucgggauuggcgugcugcuuacguggcugggacucaauucuagauccaccagccugucuaugacauguaucgccguuggccuggugacccuuuaccucggggucauggugcaggcugauuccggaugcguuauuaacuggaaaggccgcgaacugaagugugggagcggaaucuucgugacaaaugagguccacaccuggacagaacaauauaaguuucaggccgacuccccuaaacggcugucugcggccauuggcaaggcuugggaggagggggugugcggcaucagaagcgccacccgccucgaaaacaucauguggaaacagauuuccaacgagcugaaucauauccuucuggaaaacgacaugaaguucacgguuguggucggagauguggugggcauucucgcucaggggaaaaagaugauccggccgcaacccauggagcacaaauacucuuggaaaagcuggggaaaggccaagauuaucggcgccgacguccagaauacaaccuuuaucauugaugggccuaacacccccgaauguccugacgaucagagagcuuggaauaucugggagguugaggacuauggauucggcauuuuuacaaccaacaucuggcugaagcugcgcgauuccuacacacaggugugcgaccaccggcuuaugagcgcggccauuaaagauucuaaggcugugcaugccgacaugggcuauuggaucgaauccgagaaaaaugaaacauggaagcucgccagagcuagcuucaucgaggucaagaccuguauuuggcccaaaucucacacacugugguccaacggggugcuggaaagcgagaugaucauuccgaagaucuacggaggcccuauuucucaacauaauuaucgccccggguacuucacccagacagccggaccuuggcaccucggcaaacuggagcuugauuuugaccugugcgaagggaccacgguuguggucgaugagcacugcggaaaccggggccccagccucagaaccacaaccgugacaggcaagaucauccaugaaugguguugccgguccuguacccugccuccccugcgcuucaaaggggaggacggaugcugguacggcauggagauuagaccgguuaaggaaaaggaggaaaaucuugugaaaagcauggucucugcgggguccggagagguggacagcuuuucccucggccugcuguguaucucuauuaugaucgaagagguuaugcggagcagauggucccgcaagaugcucaugacggggacacuggcuguguuccuucugcucauuaugggacagcugaccuggaacgaucugauccggcuuugcauuauggucggcgccaaugccucugacagaaugggcauggggacaaccuaucuggcucucauggccaccuuuaaaaugcgcccuauguucgcggugggacugcucuuuagacggcugacaagccgcgaggugcuucugcucacgaucggccugucccuggucgcuucuguugaacuucccaacagccuggaggaacucggggauggacuggccaugggcaucaugauucucaagcugcuuaccgacuuccaaucccaccagcugugggccacacuccugagccugaccuuuaucaaaacaacccuuucucugcauuacgcuuggaagacgauggccauggugcucuccauugugagccuguucccccucugucugucuacaaccucccagaagaccacauggcuuccuguccugcuggggagccucggaugcaaaccgcugaccauguuucuuaucacagagaauaagauuuggggcagaaaaucuuggccccugaacgaaggcaucauggcuguggggguuguguccauccuccugagcucccuccugaagaacgaugucccucuugccggaccccugauugcgggcgggaugcugaucgccuguuaugugauuagcggaucuagcgcugaccucucccuggagaaagccgcugagguuucuugggaagaggaagccgagcacagcggcgccucccauaauauccuuguggaaguccaggaugacgggacgaugaagauuaaagaugaggagcgggacgauacccugacaauccuccugaaggcuacccuccuggcggugucuggagucuacccucuuagcauccccgccacacuguucgugugguauuuuuggcaaaagaaaaagcagcgcuccggcguucugugggacaccccuucucccccggaaguggagagagcuguccucgaugacggcauuuaccggaucaugcagcgcgggcugcuuggaagaagccaggugggcguugggguguuccaagaaaacgucuuccacacgauguggcacgugacccggggagccgugcugauguaucagggcaaacgccucgagccuuccugggccagcguuaagaaagaccugauuucuuacgggggaggcuggagacuccagggcuccuggaauacaggggaggaaguccaggugaucgcuguggagcccggaaagaacccuaagaauguccaaaccgcccccggcacauuuaaaaccccggaaggggaggugggagcgauugcucuggauuucaagccuggcacaagcgggucucccaucguuaaccgggaaggaaaaauugugggccuuuacggcaauggggucgugacgaccuccggaacauauguuagcgccaucgcccaggcuaaggccucccaggagggcccucugcccgagaucgaagacgagguguuuagaaaacgcaaccugaccauuauggaucuccaucccgggucuggaaagacccggagauaccugccugcgaucguccgcgaagcuauuaagcggaaacuuagaacacugauccucgccccgacgcgcgugguugccagcgagauggcugaagcccugaagggcaugcccauucgguaucaaaccacagcugugaaauccgagcacaccgggaaggagaucgucgaccugaugugccaugccacauucaccaugagacuccuuagcccugugcgcgugcccaauuacaacaugaucauuauggaugaagcgcacuuuacggacccuucuuccaucgccgcucggggcuauauuagcacaagagucggaaugggcgaggccgcugccaucuucaugaccgccacacccccugggucuguugaggcuuuuccgcagagcaaugcggugauucaggaugaggaacgggacauccccggacgcuccuggaacucuggcuacgaguggaucacagauuucccugggaaaaccgugugguuuggacccacaauuaagagcggcaaugacaucgccaacugucugagaaagaaugggaaacgggucauucagcugucccgcaagaccuucgauacggaguaucagaagaccaagaacaacgacugggacuacgugggcaccacagauaucucugaaaugggagcuaauuuuagagccgaccggguuauugauccuagacgcugccucaaacccgugauccugaaggacggcccggagcgggucauucuugccgggccuaugcccgugaccguugcuagcgccgcgcagagacgcggacggaucggcagaaaccauaauaaggaaggggaucaguacaucuauaugggacagccccugaacaaugacgaggaucacgcucacuggacggaggccaaaaugcuccuggacaacauuaauaccccugaaggcaucauucccgcccuguucgagccugaacgcgagaaguccgcugccaucgauggggaauaccggcucagaggcgaggcgcgcaaaacauucguggagcuuaugagacggggagaccugccggucuggcugagcuauaagguggccucugaaggcuuucaauacuccgaucgcagauggugcuucgacggggagcggaacaaucagguccucgaagagaacauggauguggaaauuuggaccaaagagggagagcgcaagaaacugagaccccgguggcuugacgcuagaacauauagcgacccucuggcccuccgcgaauuuaaggaguucgcugccggccggagauccguuucuggggaucugauccuggaaaucggaaagcucccccagcaucuuacccagcgcgcucaaaaugcccuggacaaccuggugaugcuccacaauagcgagcagggcggccgggcguacagacaugccauggaggaacugccugauacaauugagacccuuaugcugcucgcucugaucgccgugcugacagggggagucacacucuuuuuccuuuccggccgggggcugggaaaaaccucuauuggccugcucuguguuauggcuagcuccgugcugcuuuggauggccagcguggaaccccacuggaucgccgcuucuauuauccuggaguuuuuccucaugguccugcugaucccggaaccugaccgccagagaacaccccaggauaaccaacucgcguaugugguuauugggcuucuguuuaugauccugacaguggccgcuaaugagaugggacuccuggagaccacaaagaaagaccuuggcauuggccacgucgccguggaaaaccaucaccaugccacgaugcuggaugucgaccuccacccugcuuccgccuggacccuguacgcgguggccacaaccaucauuacacccaugaugcggcauaccaucgagaacacgaccgcuaauauuagccugacagccaucgcuaaccaggccgcgauccucauggggcuugauaagggauggccuauuucuaaaauggacaucggcguuccccugcuggcccucgggugcuacucccaggugaauccgcugacccuuacagcugccguccugaugcucguggcucacuaugccauuaucggaccuggccugcaagcuaaggccacccgcgaagcgcagaagagaacggccgcugggauuaugaaaaaccccacaguugauggaaucguggccaucgaccuggaucccgucguguacgacgcuaaguucgagaaacagcucggccagauuaugcuucugauccuguguaccagccaaauucuccugaugcggacaaccugggcccuuugcgaaucuaucacccuggccacaggcccucucacgacccugugggaggggagcccgggaaaguuuuggaauacaaccauugcgguguccauggcuaacaucuuccgcggcucuuaucuggccggggcuggacucgccuuuagccuuaugaaaucccugggcgggggaagacggggcacaggcgcccagggggagacccugggagaaaaguggaagcgccagcucaaucagcugagcaaauccgaguucaacaucuacaagagaucuggcauuauggaaguugaccggagcgaggcuaaagaagggcuuaagagaggagagacgacacgccacgccgucucccggggcaccgcgaaacugagaugguucguggagcgcaaucucgugaagcccgaagggaaggucaucgaucugggauguggccggggcggguggucuuauuacugcgccggacugaaaaagguuaccgaggugaaaggcuauacaaaagggggaccuggccaugaggaacccauuccuauggcuaccuacggguggaaccucgugaaacuucacagcggaaaggacgucuuuuucacacccccugaaaaaugugauacgcugcugugcgacaucggcgaguccucuccgaaucccaccauugaggaaggcagaacacuccgcgugcugaagaugguugagccuuggcuucgggggaaccaauuuuguaucaagauucugaaucccuacaugccuagcguggucgaaacccucgagcagaugcagagaaaacauggaggcaugcuggugcgcaacccccugucccggaauagcacacacgagauguauuggguuucuugcgggaccggaaacaucguguccgccgucaauaugacgagcagaaugcuccugaaccgcuucaccauggcucaccggaagccgacauacgaaagagauguggaccuuggcgccgggacccgccauguggcggucgagccugaaguugccaaccuggauaucauuggacagagaaucgagaauauuaaacacgaacauaagucuacauggcacuaugacgaggauaaccccuacaaaaccugggcuuaucauggcuccuacgaggugaagcccagcggcucugccuccagcauggugaauggggucgugaagcuccugacaaaaccuugggacguuauccccauggugacccaaauugcuaugacggauacaaccccuuuuggacagcagcgggucuucaaggaaaaaguggacacccgcacaccgaaggccaaaagaggcacggcucaaaucauggagguuaccgcccgguggcuuuggggguuucuguccagaaacaagaagccccggaucuguacacgcgaagaguucaccagaaaagugcggagcaaugcggccauuggagcugucuuuguggacgaaaaccaguggaacucugccaaggaggcuguugaggaugaacgcuucugggaccucggccagaaagagagagaacugcacaagcaggggaaaugcgccacaugcguguauaacaugaugggcaagcgggagaagaaacugggagaauuuggcaaggccaaagggagccgcgcgaucugguacauguggcucggagcuagauuccuggaguuugaggcccuuggcuucaugaaugaagaucacugguucucccgggagaacucucugagcggggucgaaggagagggccuccauaagcugggguacauucuucgcgacaucuccaaaauuccuggcggaaauauguaugccgaugacaccgcuggcugggauacaagaaucaccgaggacgaucugcaaaacgaagccaagaucacggacauuauggagcccgaacacgcucuccuggccaccucuaucuuuaaacugacauaccagaauaaggugguccgggugcagcgcccugcgaagaacgggaccguuauggaugugauuagcagacgggaccagcgcggauccggccaagucgggacauauggacucaauaccuucacgaacauggaggcccagcugaucagacagauggaaucugagggcauuuuucuucccagcgagcuggaaacaccgaaccucgcugagcgggugcuggauuggcuugaaaaauacgggguggagagacugaagcgcauggccaucuccggcgacgacuguguugugaaaccuaucgaugaccgguucgcuaccgcccucacagcgcugaaugauaugggaaaggucagaaaagacauuccccagugggaaccuagcaagggcuggaacgauuggcaacaggugcccuuuugcucucaucacuuccaccagcugaucaugaaggacgggcgcgagauuguugugccuugucggaaucaggaugagcucgucggcagagcccgcgugucccaaggcgcuggguggagccugcgggaaaccgccugccuuggaaaaucuuaugcucagauguggcagcugauguacuuucauagacgcgaccuccggcuggccgcuaacgccaucuguuccgcgguccccguggauuggguuccgacgagcagaaccacaugguccauucacgcccaucaccaauggaugaccacagaggacaugcuuucuguguggaaucgcgucuggaucgaagagaacccuuggauggaagauaagacccaugugagcuccuggggcgacguucccuaucuggggaaacgggaggaccaguggugcggcagccucauuggacugacagcuagagccaccugggccucuaauauccagguggcuaucaaccagguccggagacugauuggcaaugagaacuaccucgauuacaugacguccaugaagcgcuucaaaaaugaaggggaccccgagggagcccugugguga

SEQ ID NO: 19180 - RNA, 9879 nt, Artificial Sequence
  derived and/or modified CDS sequence (opt5) from DENV-1__JF937604__SS-prME
agcgugaccaugcugcucaugcugaugcccacagcccuugcuuuccaccugacgacccggggcggggaaccucauaugaucgucuccaagcaggaacggggaaaaucucuccuguuuaagaccagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcaccggcgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagacguucgggaccgccuacggagugcucuuuuccggcgucagcuggacaaugaagauugggaucggcgugcugcuuaccuggcugggacucaauucuagauccacaagccugucuaugaccuguauugcuguuggccuggugacacuuuaccucggggucauggugcaggccgauuccggaugcguuaucaacuggaaaggccgcgaacugaagugugggagcggaauuuucgugaccaaugagguccacacguggacagaacaauauaaguuucaggcugacuccccuaaacggcugucugccgcgaucggcaaggccugggaggagggggugugcggcauuagaagcgcuacccgccucgaaaacaucauguggaaacagaucuccaacgagcugaaucauauucuucuggaaaacgacaugaaguucaccguuguggucggagauguggccggcauccucgcucaggggaaaaagaugauucggccgcaacccauggaguacaaauauucuuggaaaagcuggggaaaggccaagaucauuggcgccgacgugcagaauacaaccuuuaucaucgaugggccuaacacgcccgaauguccugacgaucagagagcuuggaauauuugggaggucgaggacuacggauucggcaucuuuacaaccaacauuuggcugaagcugcgcgauuccuauacacagguuugcgaccaccggcuuaugagcgcggccaucaaagauucuaaggcugugcacgccgacaugggcuacuggauugaauccgagaaaaaugaaaccuggaagcucgccagagcuagcuucaucgaggugaagacauguaucuggcccaaaucucauacccugugguccaacgggguccuggaaagcgagaugauuaucccgaagauuuauggaggcccuaucucucaacacaauuaccgccccggguacuucacgcagaccgccggaccuuggcaucucggcaaacuggagcuugauuuugaccugugcgaagggacaaccgugguuguggaugagcacugcggaaaccggggccccagccucagaacaaccacggucacaggcaagauuauccacgaaugguguugccgguccuguacccugccuccccugcgcuucagaggggaggacggaugcugguauggcauggagauccggccggugaaagaaaaggaggaaaaucuuguuaagagcauggugucugcgggguccggagaggucgacagcuuuucccucggccugcuguguauuucuaucaugauugaagaggugaugagaagccgcuggucccggaaaaugcucaugacagggacccuggcuguuuucuuucuucugaucaugggacagcucaccuggaacgaucugauuagacugugcaucauggugggcgccaaugccucugaccgcaugggcauggggacaacguaccuugcucugauggccaccuucaagaugagaccuauguuugcggucggacuccuguuccggcgccucacaagcagagaggugcugcuucugaccauuggccucucccugguggcuucugucgaacugcccaacagccuugaggaacugggggauggacucgccaugggcaucaugauccugaaacuccugacagacuuucaauccuaucagcuuugggccacccugcucagccugacguucauuaagacaaccuuuucucugcauuacgcuuggaaaaccauggccaugguucuuuccaucgugagccuguucccccucugucugucuacaaccucccagaagacaacguggcucccugugcugcuugggagccugggaugcaagccgcugaccauguuucucauugcugagaauaaaaucuggggccggcgcucuuggccccugaacgaaggcauuauggccgucgggaucguguccauccuucugagcucccuccugaagaacgauguuccucucgcgggaccccugauugccggcgggaugcuuaucgcuuguuaugugauuagcggaucuagcgccgaccugucccuggagaaagcugccgaggucucuugggaagaggaagccgagcacagcggcgcuucccauaauauccucguggaaguucaggaugacgggacaaugaagauuaaagaugaggagagagacgauacccugacaauccuucugaaggcgacccuccuggccgugucuggagucuacccucucagcauccccgcuacgcuguucgugugguauuucuggcagaagaagaagcagcgguccggcguccuuugggacaccccuucucccccggaaguggagcgcgccguucuggaugacggcauuuacagaaucaugcagcgggggcugcucggacgcagccaggugggcgucgggguguuucaagaaaacguuuuccacacaauguggcaugugaccagaggagccguccugauguaccagggcaaacggcuugagccuuccugggcuagcgugaagaaagaccugauuucuuaugggggaggcuggagacuccagggcuuuuggaauacaggggaggaagugcagguuaucgccgucgagcccggaaagaacccuaaaaaugugcaaaccgcgcccggcacauucaagacgccggaaggggaggugggagcuauugcccuggauuuuaagccuggcaccuccgggagccccaucgucaaccgcgaaggaaaaauugugggccucuacggcaaugggguugugacaaccucuggaaccuaugucuccgccaucgcucaggccaaggcgagccaggagggcccucugcccgagaucgaagacgagguguuccggaaaagaaaccuuacaauuauggaucugcaccccggguccggaaagacgcgccgguaccugccugcuaucguuagagaagccauuaaacgcaagcuccggacccugauccuugccccgacaagaguggucgcuucugagauggccgaagcucugaagggcaugcccauucgcuaucaaaccacagccgugaaaagcgagcacaccgggaaggagaucguugaccucaugugccaugcgacguuuacaaugcggcugcuguccccugugagaguccccaauuacaacaugaucauuauggaugaagcccacuucaccgacccuagcucuaucgcugcccggggcuauauuuccacccgcgugggaaugggcgaggcugccgccaucuuuaugacagcuacacccccugggagcguggaagcguucccgcagucuaaugccgucauucaggaugaggaaagagacauccccgagcggagcuggaacuccggauacgaguggaucacagauuuuccuggcaaaaccguuugguucgugcccucuauuaagagcgggaaugacaucgcuaacugucuccgcaaaaauggaaagagagugauucagcuuucccggaagacguucgauacagaauaccagaagaccaagaacaacgacugggacuaugucgugacaaccgauaucucugagaugggcgccaauuuuagagccgaccgcguuauugauccucggagaugccugaaacccgugauccugaaggacgggccggaacgcgucauucucgcuggcccuaugcccgugacgguugccagcgcggcucagcggagaggacgcaucggccggaaccauaauaaagagggggaucaguacaucuauaugggacagccccugaacaaugacgaggaucacgcccauuggaccgaagccaagaugcuucuggacaacauuaauacaccugagggcaucauucccgcucucuucgaaccugagagagaaaaguccgccgcgaucgauggggaguaccgccugagaggagaggcccggaaaaccuuuguggaacugaugcgcagaggcgaccucccggucuggcuuagcuauaagguggcuucugagggguuccaauacuccgaucggcgcuggugcuuugacggcgaaagaaacaaucagguccuggaggaaaacauggauguggagauuuggacaaaagagggagaacggaagaaacugagaccccgcuggcucgacgcccggaccuaugcugacccucuggcccuuagagaguucaaggaauuugcugccggccgccggagcguuuccggggaucugauccucgagaucggaaaacugccccagcaccugacacagagagcgcaaaaugcccucgacaaccuugugaugcugcacaauucugaacagggcgggcgggcuuaccgccaugccauggaggagcugccugauaccauugaaacgcucaugcugcuugcucugaucgccgugcucacaggaggcgucacccuguucuuucugagcggcagagggcucggaaagaccuccauuggccuucuguguguuauggccucuagcgugcugcucuggauggcuuccguggagccccacuggaucgcggccagcauuauccuggaguucuuucuuaugguccugcucaucccggagccugaccggcagcgcacaccccaggauaaccaacuggcuuacgugguuauugggcuccuguucaugauccuuaccguggccgccaaugagaugggacugcuggaaacaacgaagaaagaccucggcauugggcaugucgcuguggagaaccaccaccaugccgcgaugcuggaugucgaccuucacccugccucugcuuggacccuguaugccguggcuacaaccaucauuacacccaugaugagacauaccaucgaaaacacgaccgccaauauuucccucacagcgaucgccaaccaggcugccauccugaugggacuggauaagggcuggccuauuagcaaaauggacaucggcguuccccuccuugcucuggggugcuacucucaggugaauccgcugacccucacagccgcuguccugaugcuuguggcccacuaugcgauuaucggaccuggccugcaagccaaggcuacccgggaggcccagaaacgcacggcugccgggauuaugaagaaccccacaguugauggaaucguggccaucgaccucgaucccgucguguacgacgcgaaguuugaaaaacagcugggccagauuaugcugcucauccuuuguaccucccaaauucugcugaugagaacaaccugggcucucugcgagagcaucacccuggccacagggccucuuacgacccugugggagggaucuccgggcaaguucuggaauacaaccauugcugugagcauggccaacaucuuccggggcuccuaucucgccggggcuggacuggccuuuucucugaugaaaagccucggcgggggacgcagaggcacaggggcgcagggagaaacccuuggcgagaaguggaaacggcagcugaaucagcuguccaagagcgaguucaacacguacaagaaauccggcaucauggagguugacagaucugaagccaaggaggggcucaaacgcggagagacaaccaagcaugcugucagccggggcaccgccaaacugagaugguuuguggaacgcaaucuugugaagcccgaggggaaggucauugaucugggauguggcagagggggaugguccuauuacugcgcuggccucaaaaagguuacagaagugaaaggcuacaccaaagggggaccuggccacgaggaacccaucccuauggccacauauggguggaaccuggugaaacugcacucuggaaaggacgucuucuuuauucccccugagaaaugugauacgcuccuuugcgacaucggcgagagcuccccgaaucccaccauugaagaggggagaacacugcgcgugcugaagaugguugaaccuuggcuccggggaaaccaauucuguaucaagauucugaaucccuacaugccuucuguggucgagacccuugagcagaugcagagaaaacauggcggcaugcuggugcgcaacccccucagcagaaauuccacacacgaaauguauuggguuagcugcgggaccggaaacaucgugucugcggucaauaugacguccagaaugcugcugaaccgcuuuaccauggcccaucggaagccgacauacgagagagauguggaccucggcgcugggacccgccacguggccgucgaaccugagguugcuaaccuggauaucauuggacagagaaucgaaaauauuaaacacgagcauaagagcacauggcacuaugacgaggauaaccccuacaaaaccugggccuaucauggcucuuacgaagugaagcccuccgggagcgcuucuuccauggugaauggagucgugaaacuucugacaaaaccuugggacguuauccccauggugacccaaauugccaugacggauacaaccccuuucggccagcagcgggucuuuaaggagaaaguggacacccgcacaccgaaggcgaaacaaggcacggcccagaucauggaaguuaccgcuaaguggcucuggggguuccugagcagaaacaagaaaccccggaucuguacaagagaggaauuuacccggaaggugcgcuccaaugccgcuauuggagccgucuucguggacgagaaccaguggaauagcgccaaagaggcgguugaagaugagagauuuugggaccuugugcaccgggaacgcgagcugcauaagcagggcaaaugcgcuacaugcgucuacaacaugauggggaagagagaaaagaaacucggagaguucggcaaggccaaagggucucgggccaucugguauauguggcugggcgcucgcuuccuggaguuugaagcccucggauucaugaaugaggaucacugguuuagcagagaaaacucccugucuggcguggagggggagggacuucacaagcugggcuacauucuccgggacaucagccaaauuccugggggaaauauguaugcugaugacaccgccggcugggauacacgcaucaccgaagacgaucugcagaacgaggcgagaaucacggacauuauggaacccgagcaugcccuucuggcuaaauccaucuucaagcucaccuaccagaauaaagucgugcggguucagcgcccugccaagaacgggacagugauggaugucauuucuagacgggaccaacgcggcagcggacaggugggcaccuaugggcugaauacauuuaccaacauggaagcucagcugaucagacagauggaguccgagggaauuuucucucccagcgaacucgagacgccgaaccuggccgaacgggugcuugauuggcuggagaaguacggcguugaaagacucaaacgcauggcgaucuccggggacgacuguguggucaagccuaucgaugaccgguuugccacagcucugaccgcccuuaaugauaugggaaaagugagaaaggacauuccccaaugggagccuagcaaaggcuggaacgauuggcagcagguucccuucugcucucaccauuuucaccagcugaucaugaaggacgggcgcgagauuguggucccuugucggaaucaagaugaacucgugggcagagcucgcgucucccagggagccggcuggagccugcgggagacagcuugccuggggaagucuuaugcccagauguggcaacucauguacuuccacagacgcgaccugcggcuugcggccaacgcuaucuguuccgccgugcccguugauuggauuccgaccagcagaacgaccugguccauccaugcccaccaucaguggaugacaaccgaagacaugcugucuguguggaaucgcgucuggauugaggaaaacccuuggauggaggauaaaacacacaucagcuccuggggagacgugcccuaccucggcaagcgggaggaccaguggugcgggagccugaucggacuuaccgcuagagccacaugggcgaccaauauucagguugcuaucaaccaagugcggagacugauuggcaaugaaaacuaucucgauuacaugacgucuaugaaacgcuuuaagaaugaguccgaccccgaaggggcccugugguga

SEQ ID NO: 19181 - RNA, 9879 nt, Artificial Sequence
  derived and/or modified CDS sequence (opt5) from DENV-1__JF937605__SS-prME
agcgugaccaugcugcucaugcugaugcccaccgcccuugcuuuccaccugacgaccagaggcggggagccucauaugaucgucuccaagcaggaacggggaaaaucucuccuguuuaagaccagcgccggcguuaacaugugcacccuuauugcgauggaccugggggagcucugugaagauacaaugaccuacaaaugcccgagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaggaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacacugcaagagaccuggaaucgccaggaccuccuggugaccuucaaaacagcucacgcgaagaagcaggaagucgugguucugggaucucaagagggcgccaugcacacggcucucaccggggccacagaaauucagaccagcggaacaaccacgaucuuugccggccaucugaaaugcagacuuaagauggauaaacugacacucaaggggauguccuaugugauguguaccggcagcuucaaacuggagaaggaagucgcugagacccagcacggaacagugcugguucagauuaaguacgagggcaccgacgccccgugcaaaaucccuuucucuacacaagaugaaaagggggugacgcagaacggacggcuuaucaccgcgaaucccauugucacagacaaagagaagccugugaacaucgaagcugagccgcccuuuggcgaguccuauauugugaucggggccggagaaaaagcccucaagcugagcugguucaagaaaggcucuagcauugggaagauguuugaggcuaccgccagaggcgcucgccggauggccauccugggagauacagcgugggacuucggcuccaucgggggaguuuuuaccucugucggcaaacucgugcaucagauuuucgggacggccuacggagugcuguuuagcggcgucuccuggaccaugaagaucgggauuggcgugcuucugacauggcucggacugaauagcagaucuaccucccugagcaugacauguaucgcuguuggccuugugacccucuaccugggggucauggugcaggccgauucuggaugcguuauuaacuggaaaggccgcgaacugaaguguggguccggaaucuucgugacaaaugagguccacaccuggacggaacaauauaaguuucaggcugacagcccuaaacggcucuccgccgcgauuggcaaggccugggaggagggggugugcggcaucagaucugcuacacgccuggaaaacaucauguggaaacagauuagcaacgagcuuaaucauauccugcucgaaaacgacaugaaguucaccguuguggucggagauguggccggcauucuggcucaggggaaaaagaugauccggccgcaacccauggaguacaaauauuccuggaagucuuggggaaaggccaaaauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaaacuucgcgauagcuauacccagguuugcgaccaccggcucauguccgcggccauuaaagauagcaaggcugugcacgccgacaugggcuacuggaucgaaucugagaaaaaugaaacauggaagcuggccagagcuuccuucaucgaggugaagaccuguauuuggcccaaaagccauacacuguggucuaacgggguccucgaauccgagaugaucauuccgaagaucuauggaggcccuauuagccaacacaauuaccgccccggguacuucacccaggccgcgggaccuuggcaucugggcaaacuugagcuggauuuugaccucugcgaagggacgaccgugguuguggaugagcacugcggaaaccggggccccucucugagaacaaccacagucaccggcaagaucauccacgaaugguguugccggagcuguacgcugccuccccuucgcuucagaggggaggacggaugcugguauggcauggagauucggccggugaaagaaaaggaggaaaaucucguuaaguccauggugagcgcugggucuggagaggucgacuccuuuagccugggccugcucuguaucuccauuaugaucgaagaggugaugagaucucgcuggagccggagaaugcugaugacagggacccuugccguuuucuuucugcucauuaugggacagcugacauggaacgaucugauccgccuuugcauuauggugggcgccaaugcuuccgacagaaugggcauggggaccaccuaccuggcccucauggcgacauucaaaaugcggccuauguuugcugucggacuccuguuccgcagacugacgucucgggaggugcuucugcucaccaucggccugagccugguggccuccgucgaacuucccaacucucuggaggaacucggggauggacuggccaugggcaucaugauucucaagcugcuuacagacuuucaaagccaucagcugugggcuacccuccugucccugacauucaucaaaaccacguuuagccuucacuaugccuggaagacaauggcuaugguucugucuauugugucccucuucccccugugucucagcaccaccucucagaaaacaaccuggcugccugugcuucuggggucccugggaugcaagccgcucacaauguuucugaucgccgagaauaagauuuggggccgcagaagcuggccccuuaacgaaggcaucauggcggucgggaucgugucuauucugcucuccagccugcucaaaaacgauguuccucuggccggaccccuuaucgcuggcgggaugcugauugccuguuacgugaucuccggaagcucugcugaccugagccucgagaaggccgccaaagucuccugggaggaagaggcugaacauucuggcgcgagccacaauauucugguggagguucaggaugacgggacgaugaagaucaaagaugaggaacgggacgauacccuuacaauccugcucaaggccacccugcucgcuguguccggagucuauccucugucuauucccgccacacuuuucgugugguacuucuggcagaagaagaagcagcgcagcggcguccugugggacaccccuagcccucccgagguggaaagagccguucuggaugacggcaucuaucggauuaugcagcgcgggcuccugggaagaucucaggugggcgucgggguguuucaagagaacguuuuccauacgauguggcacgugacccggggagcuguccuuauguaccagggcaaaagacuggaacccagcugggccaaugugaagaaagaccucaucuccuacgggggaggcuggcgccugcagggcagcuggaacacaggggaggaggugcagguuauugcggucgaacccggaaagaauccuaaaaacgugcaaaccgcucccggcacauuuaagaccccggagggggaagugggagccaucgcccucgauuucaagccuggcacaucugggucccccauugucaaucgggagggaaaaaucgugggccuguauggcaacgggguugugacgaccagcggaacauacgucucugcuaucgcccaggcgaaggcuucccaggaaggcccucuucccgagauugaggacgaaguguuuagaaaacgcaaucugaccaucauggaucugcaccccgggagcggaaagacccggagauaucucccugccauuguucgcgaggccaucaaacggaagcugagaacacuuauucuggcuccgacgcgcguggucgccuccgaaauggcugaggcccucaagggcaugcccauccgguaccaaaccacagcggugaaaucugaacauaccgggaaggagaucguugaccugaugugccacgccacauucaccaugagacugcucagcccugugcggguccccaacuauaauaugauuaucauggaugaggcucauuuuacggacccuuccagcauugccgcucgcggcuacaucucuacaagagugggaaugggcgaagccgccgcuauuuucaugaccgcgacacccccuggguccguggaggccuuuccgcagagcaacgcugucauccaggaugaggaacgggacauccccgaacgcucuuggaauagcggauaugaguggauuacagauuucccuggcaaaaccguuugguuugugcccuccaucaagucugggaacgacauugccaauugucuucgcaagaacggaaagcgggugauccagcugagcagaaagacauucgauaccgaguaccagaaaacgaagaacaaugacugggacuacgucgugacaaccgauauuuccgaaaugggcgccaacuuccgcgcugaccggguuaucgauccuagacgcugccugaaacccgugauucucaaggacgggccggagcgggucauccuggccggcccuaugcccgugacaguugcgucugcugcccagagacgcggacggaucggcagaaaucacaacaaagaaggggaucaguauauuuacaugggacagccccuuaauaacgacgaggaucaugcccacuggaccgaggcuaagaugcugcucgacaauaucaacacgccugaaggcauuauccccgcccuguuugagccugaacgcgaaaaguccgcggccauugauggggaauauagacugcggggagaggcucgcaaaaccuucguggagcucaugagacggggcgaccuuccggucuggcuguccuacaagguggccagcgaaggguuucaauauucugaucgcagauggugcuucgacggcgagcggaauaaccagguccuggaagagaauauggauguggaaaucuggacaaaagagggagagagaaagaaacuccgcccccgguggcuggacgcuagaaccuacuccgacccucuugcccugcgcgaauuuaaggaguucgcugccggccggagaagcguuuccggggaucucauccuggaaauuggaaaacugccccagcaccucacacagcgggcgcaaaacgcccuugacaaucuggugaugcugcauaacucugagcagggcgggcgcgcuuauagacacgccauggaggagcucccugauaccaucgagacacugaugcuucuggcucucauugccgugcugaccggaggcgucacgcuguuuuuccucagcggccgggggcuuggaaagacauccaucggccugcuguguguuauggccucuagcgugcuccuguggauggcuuccguggaaccccauuggauugcggccagcaucauccuugaguuuuuccugaugguccuccugauuccggaaccugaccgccagagaacaccccaggauaaucaacuggcuuacgugguuaucgggcuccuuuuuaugauucugaccguggccgccaacgagaugggacugcucgagacaaccaagaaagaccugggcaucgggcacgucgcuguggaaaaccaccaucacgccgcgaugcuugaugucgaccugcauccugccucugcuuggacacucuacgccguggcuacgaccauuaucacacccaugaugcggcacaccauugagaauacaaccgccaacaucucccugacggcgaucgccaaucaggcugccauucugaugggacucgauaagggcuggccuaucagcaaaauggacauuggcguuccccuucuggcucuggggugcuauucucaggugaacccgcucacccugacagccgcuguccuuaugcugguggcccauuacgcgaucauuggaccuggccuccaagccaaggcuacccgcgaagcccagaaaagaacagcugccgggaucaugaagaaucccaccguugauggaaucguggccauugaccuggaucccgucguguaugacgcgaaguucgagaaacagcugggccagaucaugcuccuuauucuguguacgucccaaauccugcucaugcggacaaccugggcucugugcgaaagcauuacacuugccaccgggccucugaccacacucugggagggaucuccgggcaaguuuuggaacacgaccaucgcugugagcauggccaauaucuuccgcggcuccuaccuggccggggcuggacuggccuucucucucaugaaaagccuuggcgggggaagacggggcacaggggcgcagggagagacccugggcgaaaaguggaaaagacagcugaaccagcucuccaagagcgaguuuaauacauauaagcgcuccggcauuauggaaguugaccggucugaggccaaagaagggcugaagagaggagagaccacgaaacacgcugucagccgcggcacagccaaacuucggugguucguggagagaaaccuggugaaacccgaagggaaggucaucgaucucggauguggccgcgggggaugguccuacuauugcgcuggccugaagaaaguuaccgaggugaagggcuacaccaaagggggaccuggccacgaggagcccauuccuauggccacauacggguggaaucuggugaagcuccauucuggaaaagacgucuuuuucauucccccugaaaagugugauacccuucugugcgacaucggcgagagcuccccgaaccccacaaucgaggaagggcggacgcugagagugcucaaaaugguugagccuuggcugcgcggaaaucaauuuuguauuaagauccuuaaccccuauaugccuucuguggucgaaacccuggagcagaugcagcggaagcacggcggcaugcucgugagaaauccccugagccgcaacuccacacaugagauguacuggguuagcugcgggaccggaaauaucgugucugcggucaacaugacaucccggaugcugcucaacagauucaccauggcccaccgcaaaccgacguaugaaagagauguggaccugggcgcugggacccggcacguggccgucgagccugaaguugcuaaucuugauauuaucggacagcgcauugagaacaucaagcaugaacacaaaagcacauggcauuacgacgaggauaaucccuauaagaccugggccuaccacggcucuuaugaggugaaacccuccgggagcgcuucuuccauggugaacggagucgugaagcugcucacaaagccuugggacguuauucccauggugacccaaaucgccaugacagauaccacgccuuuuggccagcagagagucuucaaagaaaagguggacacacggaccccgaaagcgaagagaggcaccgcccaaaucauggagguuacagcuaaauggcuguggggguuucuuagccggaauaagaagccccgcauuuguacgagagaagaguucacccggaaagugcgcuccaacgccgcuaucggagccgucuuuguggacgaaaaucaguggaacagcgccaaggaggcgguugaggaugaaagauucugggaccuggugcaucgggagcgcgaacuccacaaacagggcaagugcgcuacaugcgucuacaauaugauggggaaaagagagaagaagcugggagaauuuggcaaagccaaggggucucgggccauuugguacauguggcugggcgcucgcuuccucgaguucgaggcccugggauuuaugaacgaagaucacugguucagcagagaaaauucccuuucuggcguggaaggggagggacugcauaaacucggcuauauccugcgggacauuagcaagaucccugggggaaacauguacgcugaugacaccgccggcugggauacacgcaucaccgaggacgaucuucagaaugaagcgagaauuacagacaucauggagcccgaacacgcccugcucgcuaaauccauuuuuaagcugaccuaucaaaacaaagucgugcggguucagcgcccugccaagaaugggacggugauggaugucaucucuagacgggaccagagaggcagcggacaggugggcaccuacgggcugaacacauucaccaacauggaggcucaacucauucgccagauggaauccgagggaaucuuuucucccagcgagcuggaaacaccgaaucuugccgagcgggugcuggauuggcucgaaaaguauggcguugagagacugaaacgcauggcgaucuccggggacgacuguguggucaagccuauugaugaccgguucgccaccgcucuuacggcccugaacgauaugggaaaagugagaaaggacaucccccagugggaaccuagcaaaggcuggaaugauuggcagcaaguucccuuuugcucucaucacuuccaccagcucauuaugaaggacgggcgcgagaucguggucccuugucggaaccaggaugagcuggugggcagagcucgcgucucccagggagccggcuggagccugcgggaaacagcuugccucgggaagucuuacgcccaaauguggcagcugauguauuuucauagacgcgaccuucggcuggcggccaaugcuauuuguuccgccgugcccguugauuggaucccgaccagcagaacaaccugguccauucacgcccaucaccaguggaugacgaccgaggacaugcucucuguguggaaccgggucuggaucgaagagaauccuuggauggaagauaaaacacauaucagcuccuggggagacgugcccuaccugggcaagagagaggaccaauggugcgggagccuuauuggacugaccgcucgcgccacaugggcgaccaacauccagguugcuauuaaucaggugcggagacucaucggcaacgagaauuaccuggauuauaugacaucuaugaaacgcuucaagaacgaauccgaccccgagggggcccugugguga

SEQ ID NO: 19182 - RNA, 9879 nt, Artificial Sequence
  derived and/or modified CDS sequence (opt5) from DENV-1__JF937608__SS-prME
agcgugaccaugcugcucaugcugaugcccaccgcgcuugcuuuccaccugacgacccggggaggggaaccucauaugaucguguccaagcaggaacggggaaagucucuccuguuuaagacaagcgccggcguuaacaugugcacccuuauugcgauggaccugggggaacucugugaagauaccaugaccuacaaaugccccagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagaagguugaaaccugggcccugcggcaccccggcuucacagugaucgcucuuuuucuggcccaugcgauugggaccucuaucacccagaagggaaucauuuucauccuccugaugcuugucacaccuagcauggccaugcgcugcgugggcauuggguccagagauuuuguugagggacugagcggcgcuacguggguggacgucgugcucgagcacgggucuugugugaccacaauggccaaagauaagcccacccuggacaucgaacugcucaaaacagaggucaccaacccugcuauucugcggaaacuuugcaucgaagccaaaauuuccaauacgacaaccgauagccgcuguccgacccaaggagaggcgacacugguugaagaacaggacgccaacuucgugugcagacggaccuuuguggaucgcggcuggggcaauggguguggacucuucggcaaggggucucugaucacaugcgcuaaguuuaaaugcgucacgaaacuugagggaaaaaucgugcaguacgaaaaccugaaguauuccguuauugugaccguccacacaggcgaccagcaucaaguggggaaugagagcaccgaacacggaacaaccgccacgaucacaccccaggcuccuacaaccgagauucagcucacagacuacggcgcccugacccuggauuguucucccagaacgggccucgacuucaacgaaaugguucugcuuacaaugaaagagaaguccuggcuggugcauaaacagugguuucucgaucugccucuucccuggaccagcggggccuccacaucucaagagaccuggaaucggcaggaccugcucgucaccuucaagacagcucacgcgaagaaacaggaaguggucgugcugggaagccaagagggcgccaugcacacggcucugaccggggccacagaaauccagaccuccggaacaaccacgauuuuugccggccaucucaagugccgccugaaaauggauaaacuuacacugaaagggaugagcuauguuauguguaccggcucuuucaagcucgagaaggaaguggcugagacccagcacggaacaguccuggugcagaucaaauacgagggcaccgacgccccgugcaagaucccuuucuccacacaagaugaaaaagggguuacgcagaacggaagacugauuaccgcgaaucccaucgugacagacaaggagaaaccugucaacauugaagcugagccgcccuuuggcgagagcuauaucgugauuggggccggagaaaaggcccuuaagcucucuugguucaaaaagggcagcuccaucgggaaaauguuugaggcuaccgcccggggcgcuagacgcauggccauccugggagauacagcgugggacuucggcucuauugggggaguguuuaccagcguuggcaagcugguccaucagaucuucgggacggccuacggagugcucuuuuccggcgugagcuggaccaugaaaauugggaucggcguccugcuuacauggcugggacucaauucucgguccaccagccugucuaugacauguauugcugugggccugguuacccuuuaccucggggugaugguccaggccgauuccggaugcgugaucaacuggaagggcagagaacugaagugugggagcggaauuuucguuacaaaugaggugcacaccuggacggaacaauauaaauuucaggcugacuccccuaagcgccugucugccgcgaucggcaaagccugggaggagggggucugcggcauccggagcgcuacaagacucgaaaacauuauguggaagcagaucuccaacgagcugaaucauauucuucuggaaaacgacaugaaauucaccgugguugugggagaugucgccggcauccucgcucaggggaagaaaaugauucgcccgcaacccauggaguacaaguauucuuggaaaagcuggggaaaggccaagaucaucggcgccgacgugcagaauaccacauuuauuaucgaugggccuaacacccccgaauguccugacgaucagcgggcuuggaauauuugggagguggaggacuacggauucggcaucuuuacgacaaacauuuggcugaaacugagagauuccuauacccaggucugcgaccaccgccuuaugagcgcggccaucaaggauucuaaagcuguucacgccgacaugggcuacuggaucgaauccgagaagaaugaaacauggaagcucgcccgggcuagcuucauugaggugaaaaccuguaucuggcccaagucucauacacugugguccaacggggugcuggaaagcgagaugauuaucccgaaaauuuauggaggcccuaucucucaacacaauuacagacccggguacuucacccagacggccggaccuuggcaucucggcaagcuggagcuugauuuugaccugugcgaagggaccacagucgugguugaugagcacugcggaaaccgcggccccagccuccggaccacaaccgugacgggcaaaaucauucacgaaugguguugcagauccuguacacugccuccccugcgguuccgcggggaggacggaugcugguauggcauggagaucagaccggucaaggaaaaggaggaaaaucuugugaaaagcaugguuucugcgggguccggagagguggacagcuuuucccucggccugcuguguauuucuaucaugauugaagaggucaugcggagcagauggucccgcaagaugcucaugaccgggacacuggcuguguuccuucugcucaucaugggacagcugaccuggaacgaucugauucggcuuugcaucaugguuggcgccaaugccucugacagaaugggcauggggaccacauaccuggcucucauggccacguuuaaaaugcgcccuauguucgcggugggacugcucuuuagacggcugaccagccgcgagguccuucugcucacaaucggccugucccugguggcuucuguggaacuucccaacagccuggaggaacucggggauggacuggccaugggcauuaugauccucaagcugcuuaccgacuuccaaucccaucagcugugggccacacuccugagccugaccuuuauuaaaacgacauucucucuucacuaugcuuggaagaccauggccaugguccuguccaucguuagccucuuuccccugugucucucuaccacaucccagaagaccacauggcugccugugcuucuggggagccugggaugcaaaccgcucacgauguuccugauugcugagaauaagaucuggggcagacggucuuggccccuuaacgaaggcaucauggccguggggauugucuccauccugcucagcucccugcucaaaaacgaugugccucuggcgggaccccuuauugccggcgggaugcugaucgcuuguuacguuauuagcggaucuagcgccgaccugucccucgagaaggcugccgaggugucuugggaagaggaagccgagcauagcggcgcuucccacaauauccuggucgaagugcaggaugacgggaccaugaaaaucaaggaugaggagcgcgacgauacacuuaccauucugcucaaagcgacacugcucgccguuucuggaguguauccucugagcauccccgcuacccuuuuugucugguacuucuggcaaaagaagaaacagagauccggcgugcugugggacacgccuucucccccggaagucgagcgggccgugcuggaugacggcauuuaucgcaucaugcagagagggcuccugggacggagccagguuggcgugggggucuuccaagaaaacguguuucauaccauguggcacguuacacgcggagccgugcuuauguaccagggcaagagacuggagccuuccugggcuagcgucaaaaaggaccucauuucuuacgggggaggcuggcggcugcagggcuccuggaauaccggggaggaaguccaggugaucgccguugagcccggcaagaacccuaagaauguccaaacaacccccggcacauucaagacgccggaaggggaggugggagcgauugcucucgauuuuaaaccuggcaccagcgggucucccaucgugaacagagaaggaaagaucgucggccuguauggcaauggggugguuacaaccuccggaaccuacgugagcgccauugcccaggcuaaagccucccaggagggcccucuucccgagaucgaagacgaggucuuccgcaagcggaaccugacaauuauggaucugcaccccgggucuggaaaaacgagacgcuaucucccugcgaucgugcgggaagcuauuaagagaaagcugcgcacccuuauccuggccccgacacggguuguggccagcgagauggcugaagcccucaaaggcaugcccaucagauaccaaaccacagcugucaaguccgagcauaccgggaaagagauuguggaccugaugugccacgccacguuuacaaugcgccugcucagcccuguucgggugcccaauuauaacaugaucauuauggaugaagcgcauuucaccgacccuucuuccaucgccgcuagaggcuacauuagcacccgggucggaaugggcgaggccgcugccaucuuuaugacagccacacccccugggucuguggaggcuuucccgcagagcaaugcggugauccaggaugaggaacgcgacauucccgagagauccuggaacucuggauaugaguggaucacagauuuuccuggcaagaccgucugguucguucccagcauuaaauccgggaaugacaucgccaacugucuucggaagaauggaaagcgcgugauucagcugucuagaaaaacguuugauacagaauaccaaaagaccaaaaacaacgacugggacuacguggucacaaccgauaucagcgagaugggcgcuaauuuccgggccgacagagugauugauccucgccggugccugaagcccguuauccucaaagacgggccggaaagagugauccuggccggcccuaugcccgucacgguggcuuccgccgcgcagcgccggggaagaauuggccgcaaccacaauaaggagggggaucaguauaucuacaugggacagccccuuaacaaugacgaggaucaugcucacuggaccgaagccaagaugcugcucgacaacauuaauacaccugagggcaucauucccgcccuguucgaaccugagcgggaaaagagcgcugccaucgauggggaguauagacugcgcggagaggcgagaaagaccuuuguugagcucaugcggcgcggcgaccuuccgguguggcugucuuacaaagucgccuccgagggguuccaauauagcgauagacgguggugcuuugacggcgaacgcaacaaucaggugcuggaggaaaacauggaugucgagaucuggacaaaggagggagaacgcaagaagcuccggcccagauggcuggacgcucgcaccuacuccgacccucuugcccugcgggaguucaaagaauuugcugccggcagacgcucugugagcggggaucucauucuggagaucggaaagcugccccagcaccucacacagcgggcucaaaaugcccuugacaaccugguuaugcugcauaauuccgaacagggcgggagagcguaucggcacgccauggaggagcucccugauaccauugaaacgcugaugcuucuggcucucaucgccgugcugacaggaggcgugacccuguucuuucucucuggccgcgggcuuggaaagaccagcauuggccugcugugugucauggcuuccagcguucuccuguggauggccucuguggagccccauuggaucgccgcuuccaucauucuugaguucuuucugauggugcuccugaucccggagccugacagacagcggacaccccaggauaaccaacuggcguacgucgugauugggcuccuuuucaugauccugaccguugccgcuaaugagaugggacugcucgaaacaacgaaaaaggaccugggcauugggcacguggccgucggaaaccaccaucacgccgcuaugcuugauguggaccugcauccugccagcgcguggacccucuacgccgucgcuacaaccaucauuacacccaugaugcgccacaccaucgagaacacgaccgccaauaucucucugacagcuauugccaaccaggcggccauccugaugggccucgauaaaggcuggccuauuuccaagauggacaucggggugccccuucuggcucugggaugcuauagccagguuaauccgcucacccugacagccgcugugcuuaugcuggucgcccauuacgcuauuaucggcccugggcuccaagccaaagcgaccagagaagcccagaagcggacggcugccggaaucaugaagaaccccacaguggauggcauuguugcuaucgaccuggaucccguggucuaugacgccaaauuugagaagcagcuggggcagauuaugcuccuuauccuguguaccucucaaauucugcucaugcgcacaaccugggcccugugcgaaagcaucacccuugcgacaggaccucugacgacccucugggagggcuccccgggcaaauucuggaauacaaccaucgcugugucuauggccaacauuuuuagagggagcuaccuggcuggagccggccuggccuucucccucaugaaaagccuugggggaggccggcgcgggacaggagcucagggcgagacccugggcgaaaaauggaagagacagcugaaucagcucuccaagucugaguucaacacguauaaacggagcgggaucauggaaguggacagauccgaggccaaggaaggacugaaacgcggcgagacaaccaagcacgcgguuucucgggggaccgccaaacuuagaugguuugucgagcgcaaucuggugaagcccgaaggaaaggugauugaucucggcugugggcggggaggcuggagcuacuauugcgcuggccugaaaaaggucacagagguuaaaggguacaccaagggaggcccugggcacgaagaacccaucccuauggccacauacggauggaaccuggugaaacuccauuccggcaaggacguguucuuuauucccccugaaaaaugugauacgcuucugugcgacaucggggagucuagcccgaaucccaccauugaggaaggaagaacacugcgcguccucaagaugguggagccuuggcugcggggcaaccaauucuguaucaagauccuuaaucccuauaugccuuccguuguggaaacccuggagcagaugcagagaaaacacggcgggaugcucguccgcaacccccugagcagaaauucuacacaugagauguacuggguguccugcggaaccggcaacauuguuagcgcugugaauaugacgucuagaaugcugcucaaccgcuuuaccauggcccaccggaagccgacauaugaaagagaugucgaccugggggcgggaacccgccacguggccguggagccugaagucgcuaaccuugauaucauuggccagagaaucgagaauauuaaacaugaacacaaguccacauggcauuacgacgaggauaaccccuauaaaaccugggccuaccacgggagcuaugagguuaagcccucuggauccgcuagcuccauggugaauggcguggucaagcugcucacaaaaccuugggacgugauccccaugguuacccaaaucgccaugacggauacaaccccuuucggccagcagcggguguuuaaggaaaaagucgacacccgcacaccgaaggcuaaaagagggacggcccaaauuauggaggugaccgcgaaguggcuguggggauuccuuagccggaacaagaaacccagaaucuguacacgggaagaguuuacccgcaagguuagaucuaaugccgcuauuggcgccguguucgucgacgaaaaccaguggaauagcgcuaaagaggccguggaggaugaacgguuuugggaccugguucaucgcgagagagaacuccacaagcaggggaaaugcgccacaugcguguacaacaugaugggaaagcgggagaagaaacugggcgaguucgggaaggcgaaaggcucccgcgcuaucugguacauguggcugggagccagauuucucgaguucgaggcccugggcuucaugaaugaagaucacugguuuucucgggagaacagccuuuccggggucgaaggagagggccugcauaagcucggguauauucugcgcgacaucucuaaaaucccuggaggcaauauguacgcugaugacaccgccgggugggauacaagaauuaccgaggacgaucuucagaacgaagcucggaucacggacauuauggagcccgaacacgcccugcucgccaagagcaucuucaaacugaccuaucaaaauaaggugguccgcgugcagagaccugccaagaacggcacaguuauggaugugauuucccggcgcgaccagagaggaucuggccaggucgggaccuacggacugaauacauuuaccaacauggaggcucaacucauccggcagauggaaagcgagggcaucuucucccccagcgagcuggaaacgccgaaccuugccgagagagugcuggauuggcucgaaaaauaugggguggagcgccugaagcggauggcuauuucuggagacgacuguguugugaaaccuaucgaugacagauuugccacagcgcuuaccgcccugaaugauaugggcaagguccgcaaagacauuccccagugggaaccuuccaagggguggaacgauuggcagcaagugcccuucugcagccaucacuuucaccagcucaucaugaaggacggccgggagauuguugugccuuguagaaaucaggaugagcuggucggacgcgcucgggugucucagggcgccggguggucccugagagaaacagcuugccucggaaaaagcuacgcccaaauguggcagcugauguauuuccaucgccgggaccuuagacuggcugccaacgcgaucuguuccgccguccccguggauuggauuccgaccucucgcacgaccuggagcauccacgcucaucaccaguggaugacaaccgaggacaugcucuccguuuggaaucggguguggaucgaagagaacccuuggauggaagauaagacacauauuagcucuuggggcgacguccccuaccuggggaaaagagaggaccaauggugcggaucccuuaucggccugaccgcccgggccacaugggcuaccaauauucagguggccaucaaccagguuagacgccucauugggaaugagaacuaccuggauuauaugacgagcaugaagcgguuuaaaaaugaaucugaccccgagggcgcgcugugguga

SEQ ID NO: 19183 - RNA, 9879 nt, Artificial Sequence
  derived and/or modified CDS sequence (opt5) from DENV-1__GU131739__SS-prME
agcgugaccaugcugcucaugcugaugcccacagcccuugcuuuccaccugacgaccagaggcggggaaccucauaugaucguguccaagcaggaacgggggaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggagguggaggacuacggauucggcauuuuuacgacaaacaucuggcugaaacuucgcgauuccuauacccaggucugcgaccaccggcucaugagcgcggccauuaaagauucuaaggcuguucacgccgacaugggcuacuggaucgaauccgagaaaaaugaaacauggaagcuggccagagcuagcuucaucgaggugaagaccuguauuuggcccaaaucucauacacugugguccaacggggugcucgaaagcgagaugaucauuccgaagaucuauggaggcccuauuucucaacacaauuaccgccccggguacuucacccagacggccggaccuuggcaucugggcaaacuugagcuggauuuugaccucugcgaagggaccacagucgugguugaugagcacugcggaaaccggggccccagccugagaaccacaaccgugacgggcaagaucauccacgaaugguguugccgguccuguacacugccuccccuucgcuucagaggggaggacggaugcugguauggcauggagauucggccggucaaagaaaaggaggaaaaucucgucaagagcaugguuucugcgggguccggagagguggacagcuuuucccugggccugcucuguaucucuauuaugaucgaagaggucaugagaagccgcuggucccggaaaaugcugaugaccgggacacuugcuguguucuuucugcucauuaugggacagcugaccuggaacgaucugaucagacuuugcauuaugguuggcgccaaugccucugaccgcaugggcauggggaccacauaccuggcucucauggccacguucaagaugagaccuauguuugcggugggacugcuguuccggcgccugaccagcagagagguccuucugcucacaaucggccugucccugguggcuucuguggaacuucccaacagccuggaggaacucggggauggacuggccaugggcaucaugauucucaaacugcuuaccgacuuucaaucccaucagcugugggccacacuccugagccugaccuucaucaagacgacauuuucucuucacuaugcuuggaaaaccauggccaugguccuguccauuguuagccucuucccccugugucucucuaccacaucccagaagaccacauggcugccugugcuucuggggagccugggaugcaagccgcucacgauguuucugaucgcugagaauaaaauuuggggccggcgcucuuggccccuuaacgaaggcaucauggccguggggaucgucuccauucugcucagcucccugcucaagaacgaugugccucuggcgggaccccuuaucgccggcgggaugcugauugcuuguuacguuaucagcggaucuagcgccgaccugucccucgagaaagcugccgaggugucuugggaagaggaagccgagcauagcggcgcuucccacaauauucuggucgaagugcaggaugacgggaccaugaagaucaaagaugaggagagagacgauacaccuaccauccuucugaaggcgacacuccuggccguuucuggaguguauccccucagcauuccugcuacccuguucgucugguacuucuggcagaagaagaagcagcgguccggcgugcuuugggacacgcccucuccgccugaagucgagcgcgccgugcuggaugacggcaucuauagaauuaugcagcgggggcugcucggacgcagccagguuggcgugggggucuuucaagaaaacguguuccauaccauguggcacguuacaagaggagccgugcugauguaccagggcaaacggcuugagcccuccugggcuagcgucaagaaagaccugaucucuuacgggggaggcuggagacuccagggcuccuggaauaccggggaggaaguccaggugauugccguugagccuggaaagaaccccaaaaauguccaaacagcgccgggcaccuuuaagacaccugaaggggaggugggagcuaucgcccuggauuucaagcccggcacgagcgggucuccuauugugaaccgcgaaggaaaaaucgucggccucuauggcaauggggugguuaccacauccggaaccuacgugagcgccaucgcucaggccaaggcgucccaggagggcccccugcccgagauugaagacgaggucuuucggaaaagaaaccuuaccaucauggaucugcacccugggucuggaaagacacgccgguaucugccggcuauugugagagaagccaucaaacgcaagcuccggacgcugauucuugcccccaccagaguuguggcuagcgagauggccgaagcucugaagggcaugccuauccgcuaccaaacaaccgccgucaaauccgagcauacagggaaggagaucguggaccucaugugccacgcgaccuucacgaugcggcugcugagccccguuagagugccuaauuauaacaugauuaucauggaugaagcccauuuuacagaccccucuuccauugcugcccggggcuacaucagcacccgcgucggaaugggcgaggcugccgccauuuucaugaccgcuacaccuccggggucuguggaagcguuuccccagagcaaugccgugauccaggaugaggaaagagacaucccugagcgguccuggaacucuggauaugaguggauuaccgauuuccccggcaaaacagucugguuuguuccuagcaucaaguccgggaaugacauugcuaacugucuccgcaaaaauggaaagagagugauccagcuuucucggaagaccuucgauacggaauaccagaagacaaagaacaacgacugggacuacguggucaccacagauauuagcgagaugggcgccaauuucagagccgaccgcgugaucgauccccggagaugccugaaaccgguuauucugaaggacgggccugaacgcgugauccucgcuggccccaugcccgucaccguggccuccgcggcucagcggagaggacgcaucggccggaaccacaauaaagagggggaucaguauauuuacaugggacagccucugaacaaugacgaggaucaugcccacuggacggaagccaagaugcuucuggacaacaucaauacccccgagggcauuaucccugcucucuuugaaccggagagagaaaagagcgccgcgauugauggggaguaucgccugagaggagaggcccggaaaacauucguugaacugaugcgcagaggcgaccuccccguguggcuuucuuacaaggucgcuuccgagggguuucaauauagcgaucggcgcuggugcuucgacggcgaaagaaacaaucaggugcuggaggaaaacauggaugucgagaucuggaccaaagagggagaacggaagaaacugagaccucgcuggcucgacgcccggacauacuccgacccccuggcucuuagagaguuuaaggaguucgccgcuggccgccggucugugagcggggaucugauccucgagauuggaaaacugccucagcaccugacccagagagcccaaaaugcgcucgacaaccuuguuaugcugcauaauuccgaacagggcgggcgggccuaucgccacgcuauggaggagcugcccgauacaaucgaaacccucaugcugcuugcccugauugcugugcucacgggaggcgugacacuguuuuuccugucuggcagagggcucggaaagaccagcaucggccuucugugugucauggccuccagcguucugcucuggauggccucuguggagccgcauuggauugcugcguccaucauccuggaauuuuuccuuauggugcugcucauuccugagcccgaccggcagcgcaccccucaggauaaccaacuggccuacgucgugaucgggcugcucuuuaugauucuuacaguugcugccaaugagaugggacugcuggaaaccacaaagaaagaccucggcaucgggcacguggccgucgagaaccaccaucacgcugccaugcuggauguggaccuucaucccgcgagcgccuggacgcuguacgcugucgccaccacaauuaucaccccuaugaugagacacacaauugaaaacaccacggcuaauaucucucucaccgccaucgcgaaccaggccgcuauucugaugggacuggauaagggcuggcccaucuccaaaauggacauuggcgugccgcuccuugcccuggggugcuauagccagguuaauccucugacacucaccgcugccgugcugaugcuugucgcucauuacgccaucauuggacccggccugcaagcgaaggccacacgggaggcucagaaacgcaccgccgcugggaucaugaagaaccccacgguggauggaaucguugccauugaccucgauccuguggucuaugacgccaaguucgaaaaacagcugggccagaucaugcugcucauucuuuguacaucucaaauccugcugaugagaaccacaugggcgcucugcgagagcauuacccuggcuaccgggccgcuuacaacgcugugggagggaucccccggcaaguuuuggaauaccacaaucgccgugucuauggcuaacaucuuccggggcagcuaccucgccggggccggacuggcuuucucccugaugaaaagccucggcgggggacgcagaggcaccggggcccagggagaaacacuuggcgagaaguggaaacggcagcugaaucagcuguccaagucugaauuuaacaccuauaagagaagcggcauuauggagguggaccgcuccgaagcgaaagaggggcucaagcggggagagacgacaaaacacgccguuucuagaggcaccgcuaagcugcgcugguucgucgaacggaaucuugugaaaccugaggggaaggugaucgaucugggauguggcagagggggauggagcuacuauugcgccggccucaagaaagucaccgaaguuaagggcuacacaaaagggggacccggccacgaggaaccuauucccauggcuaccuacggguggaaccuggugaagcugcauuccggaaaagacguguuuuucaucccuccggagaagugugauacacuccuuugcgacauuggcgagucuagccccaauccuacgaucgaagaggggcgcacccugcggguccugaaaaugguggaacccuggcucagaggaaaccaauuuuguauuaagauccugaauccuuauaugcccuccguuguggagacacuugagcagaugcagcgcaagcacggcggcaugcugguccggaacccgcucagcagaaauucuacccaugaaauguacuggguguccugcgggacaggaaacaucguuagcgccgugaauaugaccucucgcaugcugcugaaccgguucacgauggcgcacagaaaaccuaccuaugagcgcgaugucgaccucggcgccgggacaagacacguggcuguggaacccgaggucgccaaccuggauauuaucggacagcggauugaaaauaucaagcaugagcacaaauccaccuggcauuacgacgaggauaaccccuauaagacaugggcuuaccacggcagcuaugaaguuaaaccuucuggguccgccagcuccauggugaauggaguggucaaacuucugaccaagcccugggacgugauuccuaugguuacacaaaucgcuaugaccgauacgacaccguuuggccagcagcgcguguucaaagagaaggucgacaccagaacccccaaagccaagcggggcacagcgcaaaucauggaagugacggccaaauggcucuggggguuucugagcagaaacaagaagccucggauuuguacccgcgaggaguucacaagaaaaguucggucuaaugcugccaucggagcuguguuugucgacgagaaccaguggaauagcgccaaggaggccguggaagaugagcgcuucugggaccuuguucauagagaacgggagcugcacaaacagggcaagugcgcgaccugcguguacaacaugauggggaaacgcgaaaagaagcucggagaguuuggcaaagcuaagggguccagagccauuugguacauguggcugggcgcccgguuccuggaguucgaagcucucggauuuaugaaugaggaucacugguucucucgcgaaaacagccuguccggcgucgagggggagggacuucauaaacugggcuauauccucagagacauuucuaagauccccgggggaaauauguacgccgaugacacagcuggcugggauacccggaucacagaagacgaucugcagaacgaggcccgcauuaccgacaucauggaaccugagcacgcgcuucuggccaaaagcauuuuuaagcucacguaucaaaauaaaguggucagagugcagcggcccgcuaagaacgggaccguuauggaugugaucucccgcagagaccagcggggcucuggacaggucggcacauacgggcugaauaccuucacaaacauggaagcccaacugauuagacagauggagagcgagggaaucuuuuccccgagcgaacucgagaccccuaaccuggcugaacgcgugcuugauuggcuggagaaguauggcguggaacggcucaaaagaauggccaucucuggggacgacuguguugugaagcccauugaugaccgcuucgcgacggcccugacagcucuuaaugauaugggaaaaguccggaaggacaucccucagugggagcccuccaaaggcuggaacgauuggcagcaagugccuuuuugcagccaucacuuccaccagcugauuaugaaggacgggagagagaucguugugcccugucgcaaucaggaugaacucgucggccgggccagagugucucagggagcuggcuggucccugcgcgagaccgccugccugggaaagagcuacgcucaaauguggcagcucauguauuuucaucggagagaccugcgccuugccgcgaacgccauuuguuccgcugucccgguggauuggaucccuacaucucggaccacguggagcauucacgcccaucaccaguggaugaccacagaagacaugcuguccguuuggaauagaguguggaucgaggaaaaccccuggauggaggauaaaacccauaucagcucuuggggagacguccccuaccucggcaagcgggaggaccaauggugcgggucccugauuggacuuacagccagagcuaccugggccacaaauauccagguggcgauuaaccagguucgccggcugaucggcaaugaaaacuaccucgauuauaugaccagcaugaaaagauucaagaaugagucugacccugaaggggcucugugguga

SEQ ID NO: 19184 - RNA, 9879 nt, Artificial Sequence
  derived and/or modified CDS sequence (opt5) from DENV-1__GU131740__SS-prME
agcgugaccaugcugcugaugcugaugcccaccgcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaagugcccgagaaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgugccgugcaagauuccuuuuagcacccaggaugaaaaaggggucacacaaaacggacggcugaucacggcgaaucccaucgugaccgacaaggagaaaccugugaacauugaagcugagccgcccuucggcgagucuuauaucguuauuggggccggagaaaaggcccugaaacuuagcugguuuaaaaagggcuccucuaucgggaaaauguucgaggcuacagccagaggcgcucgccggauggccauucucggagauaccgcgugggacuuuggcagcaucgggggagucuucacauccgugggcaagcuggugcaucagaucuuugggaccgccuacggaguccuguucagcggcgugucuuggacgaugaaaauugggaucggcguucuccugaccuggcuuggacucaauuccagaagcacaucucucuccaugaccuguauugcugugggccuggucacacuguaccuuggggugaugguucaggccgauagcggaugcgugaucaacuggaagggccgcgaacucaaguguggguccggaauuuuugucaccaaugaggugcacacauggaccgaacaguauaaauuccaagcugacucuccuaagcggcugagcgccgcgaucggcaaagccugggaggaggggguuugcggcauuagauccgcuacgcgccuggaaaacaucauguggaagcagaucucuaacgagcucaaucauauucugcuugaaaacgacaugaaauuuacaguggucgugggagauguggccggcauccuggcucaggggaagaaaaugauucggccgcagcccauggaguacaaguauagcuggaaguccuggggaaaagccaagaucauuggcgccgacguccaaaauaccaccuucaucaucgaugggccuaacacacccgaauguccugacgaucagagagcuuggaauauuugggagguugaggacuacggauuuggcaucuucaccacgaacauuuggcucaaacugcgcgauagcuauacacaggugugcgaccaccggcugaugucugcggccaucaaggauuccaaagcugugcacgccgacaugggcuacuggauugaaagcgagaagaaugaaaccuggaaacuugccagagcuucuuucaucgaggucaaaacauguaucuggcccaagucccauacccucuggagcaacggggugcuggaaucugagaugauuaucccgaaaauuuauggaggcccuaucagccagcacaauuaccgccccggguacuuuacacaaaccgccggaccuuggcaucugggcaagcucgagcuggauuucgaccuuugcgaagggacgaccguuguggucgaugagcacugcggaaaccggggccccucccugagaacaaccacagugaccggcaaaauuauccacgaaugguguugccggagcuguacgcucccuccccugcgcuuuaagggggaggacggaugcugguauggcauggagaucagaccgguuaaggaaaaagaggaaaaucuggugaagucuauggucuccgcggggagcggagagguggacuccuucucucuuggccuccuguguauuagcaucaugauugaagagguuaugcgguccagauggucucgcaaaaugcugaugacagggacccucgcuguguuuuuccugcuuaucaugggacagcugacauggaacgaucucauucggcugugcaucauggucggcgccaaugccagcgacagaaugggcauggggaccaccuaccuggcucuuauggccacauuuaagaugcgcccuauguucgcggugggacugcucuuuagacggcugacgucccgcgaggugcuccugcuuaccauuggccugucucucgucgcuagcguugaacugcccaacucccuggaggaacuuggggauggacuggccaugggcaucaugauccucaaacugcucacagacuuccagagccaucaacugugggccacccuucugucuuuuacauucauuaagaccacguuuucccuccacuaugcuuggaagacaauggccauggugcugagcaucgugucucuguucccccuuugucuguccaccaccagccagaaaacaaccuggcucccuguccugcucgggucucugggaugcaagccgcuuacaauguuccugauugcugagaauaaaguguggggcagaaaguccuggccccugaacgaaggcaucauggccguugggauugugagcauccuccuguccagccuucugaaaaacgaugucccucucgcgggaccccugaucgccggcgggaugcucauugcuuguuacgugaucucuggaagcuccgccgaccugucucuugagaaggcugccgagguuagcugggaagaggaagccgagcauuccggcgcuucucacaauauucugguggaaguccaggaugacgggacgaugaaaaucaaggaugaggagcgggacgauacccugacaauucuccugaaggcgacccuucuggccgugagcggagucuauccucucuccauccccgcuacacuguuugugugguacuucuggcagaaaaagaaacaacgcucuggcguucucugggacaccccuuccccucccgaaguggagagagccguccuggaugacggcaucuaucggauuaugcagcgcgggcuucugggaagaucccaggugggcguugggguguuucaggaaaacgucuuccauacgauguggcacgugacccggggagccgugcugauguaccaaggcaagcgccucgagcccagcugggcuucuguuaaaaaggaccugaucuccuacgggggaggcuggagacuucagggcagcuggaauacaggggaggaaguccaggugauugccguggagcccggaaagaacccuaaaaauguccagaccgcgcccggcacauuuaagaccucugaaggggaggugggagcuaucgcccuggauuucaaaccgggcacauccgggagcccuauuguuaaccgggaaggaaagaucgugggccucuauggcaauggggucgugacgaccuccggaacauacguuucugccauugcucaagccaaagcgagccaggagggcccccugccugagaucgaagacgagguguuuagaaagcgcaaccucaccaucauggaucugcaccccggguccggaaagacccggagauaucuucccgcuauuguccgcgaagccaucaaacggaagcugagaacacugauucucgccccuacgcgcgugguugcuagcgagauggccgaagcucugaaaggcaugccgauccgguaccagaccacagccgugaagucugagcauaccgggaaagagauugucgaccuuaugugccacgcgacauucaccaugagacugcucucccccgugcgcgugccuaauuauaacaugaucaucauggaugaagcccauuuuacggaccccagcucuauugcugcccggggcuacaucagcacaagagucggaaugggcgaggcugccgccauuuucaugaccgcuaccccucccggguccauggaagcguuuccucaaucuaaugccguuauccaggaugaggaacgggacauuccggagcgcagcuggaacuccggauaugaguggaucacagauuuccccggcaagaccgugugguucgugccuucuaucaagagcgggaaugacauugcuaacugucugcgcaagaauggaaagcgggucauccagcugucccgcaaaacauuugauaccgaauaccagaagacgaaaaacaacgacugggacuacgugguuacaaccgauauuagcgagaugggcgccaauuucagagccgaccgggugaucgaucccagacgcugccucaagccugucauucuuaaggacgggcccgaacgggugauccuggcuggcccgaugccuguuacaguggccucugcggcucaaagacgcggacggauuggcagaaaccacaauaaagagggggaucaguauaucuacaugggacagccccugaacaaugacgaggaucaugcccacuggaccgaagccaagaugcuccuggacaacaucaauacgcccgagggcauuaucccugcucuuuuugaacccgagcgcgaaaaauccgccgcgauugauggggaguaucggcugagaggagaggcccgcaagaccuucgucgaacucaugagacggggcgaccugccuguguggcugagcuacaaagucgcuuccgagggguuucaguauucugaucgcagauggugcuucgacggcgaacggaacaaucaagugcucgaggaaaacauggauguugagaucuggacaaaggagggagaacgcaagaaacuuagaccgcgguggcuggacgccagaaccuacagcgacccccuggcucuccgcgaguuuaaagaguucgccgcuggccggagauccgugucuggggaucugauucuugagaucggaaaacugccucagcaccucacacagcgcgcccagaaugcgcuggacaaccuggugaugcuccauaauagcgaacaaggcgggcgggccuauagacacgcuauggaggagcuucccgauaccaucgaaacacugaugcugcucgcccugauugcuguccuuaccggaggcguuacgcuguuuuuccucuccggccgggggcugggaaagacaagcaucggccugcucugugugauggccucuuccgugcuucuguggauggccagcgucgagccucauuggauugcugcgucuaucauucuggaauuuuuccucauggugcugcuuauccccgagccggaccgccagagaaccccucaggauaaccagcuggccuacguugugaucgggcuccuguuuaugauucugaccgucgcugccaaugagaugggacuccuugaaacaaccaaaaaggaccugggcaucgggcacgccgcuguggagaaccaccaucacgccgcgaugcuggaugucgaccuccaucccgccuccgcuuggacacuguacgccguggcuacgaccauuaucacaccuaugaugcggcacaccauugaaaacacaaccgccaauaucagccuuacggcgauugccaaccaagcugccauccugaugggacucgauaaaggcuggcccaucucuaagauggacauuggcguuccucugcuggcucucgggugcuauagccaggugaauccccuuacccugacagccgcuguccugaugcucguggcccauuacgcgaucauuggaccgggccugcaggccaaggcuacccgcgaggcccagaagagaacagcugccgggaucaugaagaacccuaccguugauggaauuguggccaucgaccuugaucccgucguguaugacgcgaaauucgaaaagcagcugggccagaucaugcuccugauucuguguacgucccagauccuccuuaugcggacaaccugggcucugugcgagucuauuacacuggccaccgggccccucaccacacugugggagggaagcccuggcaaauucuggaauacgaccaucgcuguguccauggccaacauuuuucgcggcagcuaccuugccggggcuggacuggccuucucccucaugaagucucugggcgggggaagacggggcacaggggcgcaaggagaaacccugggcgagaaguggaaacgccagcucaaucagcuuagcaaguccgaauuuaacacauauaaaagaucuggcaucauggagguugaccggagcgaagccaaggaggggcugaaaagaggagagaccacgaagcacgcugucucccgcggcacagccaagcugcggugguucguggaaagaaaucucgugaaaccggaggggaaggucaucgaucugggauguggccgcgggggauggucuuacuauugcgcuggccuuaaaaagguuaccgaagugaaaggcuacaccaaagggggacccggccacgaggaaccuauucccauggccacauacggguggaaccuggugaaacuccauagcggaaaggacgucuuuuucaucccucccgagaagugugauacccugcugugcgacauuggcgaguccagcccuaauccgacaaucgaagaggggcggacgcucagagugcuuaaaaugguugaacccuggcugcgcggaaaccaguuuuguauuaagauccugaauccuuauaugcccucuguggucgagacccucgagcaaaugcagcggaaacacggcggcaugcuggugagaaacccucuuucccgcaauagcacacaugaaauguacuggguuucuugcgggaccggaaacauuguguccgcggucaauaugacaagccggaugcugcucaacagauucaccauggcccaccgcaagcccacguaugagcgggauguggaccugggcgcugggaccagacacguggccgucgaaccggagguugcuaaccuggauaucaucggacagcgcauugaaaauaucaaacaugagcacaagucuacauggcauuacgacgaggauaacccuuauaagaccugggccuaccacggcuccuaugaagugaaacccagcggguccgcuagcucuauggugaauggagucgugaagcuccugacaaaacccugggacguuauuccuauggugacccagaucgccaugacagauaccacgcccuuuggccaacagagagucuucaaggagaaaguggacacacggaccccuaaggcgaagcgcggcaccgcccagauuauggaaguuacagcuaaauggcuuuggggguuucugagcagaaacaagaaaccgcggaucuguacgagagaggaguucacccggaaggugcgcuccaaugccgcuaucggagccgucuuuguggacgagaaccaauggaacucugccaaagaggcgguugaagaugagagauucugggaccucgugcaucgggaacgcgagcugcacaagcagggcaagugcgcuacaugcgucuacaacaugauggggaaaagagaaaagaaacuuggagaguucggcaaggccaaagggagccgggccauuugguacauguggcugggcgcucgcuuucucgaguucgaagcccugggauuuaugaaugaggaucacugguucuccagagaaaacucucugagcggcguggagggggagggacuccauaagcugggcuauauccuucgggacauuuccaaaauccccgggggaaauauguacgcugaugacaccgccggcugggauacacgcauuaccgaagacgaucugcagaacgaggcgaagaucacagacaucauggaaccugagcacgcccuccuggcuaagucuauuuuuaaacuuaccuaucagaauaaggucgugagaguucaacggcccgccaaaaacgggacggugauggaugucaucagccgcagagaccagcggggcuccggacaggugggcaccuacgggcugaauacauucaccaacauggaagcucagcucauucgccaaauggagagcgagggaaucuuuucuccuuccgaacuggagacacccaaccuggccggcagagugcucgauuggcuggaaaagcaugggguugagcggcuuaaaagaauggcgauuagcggagacgacuguguggucaagccgaucgaugaccgcuucgccaccgcucugacggcccucaaugauaugggcaaggugcggaaagacaucccucagugggaacccucuaagggguggaacgauuggcagcagguuccuuuuugcucccaccacuuccaucaacugauuaugaaagacggcagagagaucgugguccccugucgcaaucaggaugagcuugugggacgggcuagagucagccagggcgccggguggucccugcgcgaaacagcuugccucggaaagucuuaugcccagauguggcaacugauguacuuucaccggagagaccugcgccucgcggccaacgcuauuuguagcgccgugccuguugauugggugcccaccucccggacaaccuggagcauccaugcccaccaucaguggaugacgaccgaggacaugcugucugucuggaauagaguguggauugaagagaacccguggauggaagauaaaacacacaucuccagcuggggcgacguuccuuaucuugggaagcgcgaggaccaguggugcggaucucugauuggccucaccgcucgggccacaugggcgaccaauauccaaguggcuaucaaccaggucagacggcugauugggaaugagaacuaccuugauuacaugacaagcaugaagagauucaaaaaugaauccgaccccgagggcgcccugugguga

SEQ ID NO: 19185 - RNA, 9879 nt, Artificial Sequence
  derived and/or modified CDS sequence (opt5) from DENV-1__GU131741__SS-prME
agcgugacaaugcugcugaugcugaugcccacggcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccagaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggugucuacaagccaagagaccuggaaucgcaaagaccuucuggucacauuuaagaccgcucacgcgaagaaacaggaagugguugugcucggaucccaggagggcgccaugcacaccgcucugacaggggccacggaaauucaaaccagcggaacaaccacaaucuucgccggccaucugaagugcagacucaaaauggauaagcugacccuuaaagggaugucuuaugucauguguacgggcuccuucaagcuggagaaggaaguggcugagacacagcacggaaccguucucgugcagauuaaauacgagggcaccgacgccccgugcaagaucccuuuuagcacacaggaugaaaaaggggucacccaaaacggacggcugaucacagcgaaucccauugugacggacaaggagaaaccugugaacaucgaagcugagccgcccuucggcgagucuuauauuguuaucggggccggagaaaaggcccugaaacuuagcugguuuaaaaagggcuccucuauugggaaaauguucgaggcuaccgccagaggcgcucgccggauggccauccucggagauacagcgugggacuuuggcagcaucgggggagucuucaccuccgugggcaagcuggugcaucagauuuuugggacagccuacggaguccuguucagcggcgugucuuggaccaugaaaaucgggauuggcguucuccugacguggcuuggacucaauuccagaagcaccucucucuccaugacauguaucgcugugggccuggucacccuguaccuuggggugaugguucaggccgauagcggaugcgugauuaacuggaagggccgcgaacucaaguguggguccggaaucuuugucacaaaugaggugcacaccuggacagaacaguauaaauuccaagcugacucuccuaagcggcugagcgccgcgauuggcaaagccugggaggaggggguuugcggcaucagauccgcuacccgccuggaaaacaucauguggaagcagauuucuaacgagcucaaucauauccugcuugaaaacgacaugaaauuuacgguggucgugggagauguggccggcauucuggcucaggggaagaaaaugauccggccgcagcccauggaguacaaguauagcuggaaguccuggggaaaagccaagauuaucggcgccgacguccaaaauacaaccuucaucauugaugggccuaacacccccgaauguccugacgaucagagagcuuggaauaucugggagguugaggacuacggauuuggcauuuucacaaccaacaucuggcucaaacugcgcgauagcuauacacaggugugcgaccaccggcugaugucugcggccauuaaggauuccaaagcugugcacgccgacaugggcuacuggaucgaaagcgagaagaaugaaacauggaaacuugccagagcuucuuucaucgaggucaaaaccuguauuuggcccaagucccauacacucuggagcaacggggugcuggaaucugagaugaucauuccgaaaaucuauggaggcccuauuagccagcacaauuaccgccccggguacuuuacccaaacagccggaccuuggcaucugggcaagcucgagcuggauuucgaccuuugcgaagggaccacgguuguggucgaugagcacugcggaaaccggggccccucccugagaaccacaaccgugacaggcaaaaucauccacgaaugguguugccggagcuguacccucccuccccugcgcuuuaagggggaggacggaugcugguauggcauggagauuagaccgguuaaggaaaaagaggaaaaucuggugaagucuauggucuccgcggggagcggagagguggacuccuucucucuuggccuccuguguaucagcauuaugaucgaagagguuaugcgguccagauggucucgcaaaaugcugaugacggggacacucgcuguguuuuuccugcuuauuaugggacagcugaccuggaacgaucucauccggcugugcauuauggucggcgccaaugccagcgacagaaugggcauggggacaaccuaccuggcucuuauggccaccuuuaagaugcgcccuauguucgcggugggacugcucuuuagacggcugacaucccgcgaggugcuccugcuuacgaucggccugucucucgucgcuagcguugaacugcccaacucccuggaggaacuuggggauggacuggccaugggcaucaugauucucaaacugcucaccgacuuccagagccaucaacugugggccacacuucugucucucaccuuuaucaagacaaccuucucccugcacuaugcuuggaagacgauggccauggugcugagcauugugucucuuuuuccccugugucucuccacaaccagccagaaaaccacauggcugccuguccuccuggggucucuuggaugcaagccgcugaccauguuccugaucgcugagaauaaaauuuggggcagaaaguccuggccccucaacgaaggcaucauggccguggggaucguuagcauucugcuuuccagccugcucaaaaacgaugugccucuggcgggaccccucaucgccggcgggaugcugauugcuuguuacgucaucucuggaagcuccgccgaccuuucucuggagaaggcugccgaggugagcugggaagaggaagccgagcauuccggcgcuucucacaauauucugguugaagugcaggaugacgggacaaugaaaaucaaggaugaggagcgggacgauacgcucaccauccugcuuaaggcgacacugcucgccgucagcggaguguauccucuguccauucccgcuacccucuucgucugguacuuuuggcagaaaaagaaacaacgcucuggcgugcugugggacacaccuuccccucccgaaguugagagagccgugcuugaugacggcaucuaucggauuaugcagcgcgggcugcugggaagaucccaggucggcguggggguuuuccaggaaaacguguuucauaccauguggcacgucacgcggggagccgugcucauguaccaaggcaagcgccuggagcccagcugggcuucugugaaaaaggaccuuaucuccuacgggggaggcuggagacugcagggcagcuggaauaccggggaggaaguucaggucauugccguggagcccggaaagaacccuaaaaaugugcagacagcgcccggcaccuucaagacaucugaaggggaggucggagcuaucgcccucgauuuuaaaccgggcaccuccgggagcccuauugugaaccgggaaggaaagaucguuggccuguauggcaaugggguggucacaacguccggaaccuacgugucugccaucgcucaagccaaagcgagccaggagggcccccucccugagauugaagacgagguuuucagaaagcgcaaccugacaaucauggaucuucaccccggguccggaaagacccggagauaucugcccgcuauugugcgcgaagccaucaaacggaagcugagaacccucauucuggccccuacacgcgucguggcuagcgagauggccgaagcucuuaaaggcaugccgauccgguaccagacgaccgccguuaagucugagcauacagggaaagagaucguggaccugaugugccacgcgaccuuuacaaugagacuccugucccccguccgcgugccuaauuauaacaugauuaucauggaugaagcccauuucaccgaccccagcucuauugcugcccggggcuacaucagcacgagagugggaaugggcgaggcugccgccauuuuuaugacagcuaccccucccggguccgucgaagcguucccucaaucuaaugccguuauccaggaugaggaacgggacaucccggagcgcagcuggaacuccggauaugaguggauuaccgauuuucccggcaagacagugugguucgugccuucuaucaagagcgggaaugacauugcuaacugucugcgcaagaauggaaagcgggucauccagcucucccgcaaaaccuucgauacagaauaccagaagaccaaaaacaacgacugggacuacgugguuacgacagauauuagcgagaugggcgccaauuuuagagccgaccgggugaucgaucccagacgcugccuuaagccugucauucugaaggacgggcccgaacgggugauccuggcuggcccgaugccuguuaccguggccucugcggcucaaagacgcggacggaucggcagaaaccacaauaaagagggggaucaguauauuuacaugggacagccccucaacaaugacgaggaucaugcccacuggacagaagccaagaugcugcuugacaacaucaauacccccgagggcauuaucccugcucuguucgaacccgagcgcgaaaaauccgccgcgauugauggggaguaucggcucagaggagaggcccgcaagacguuugucgaacugaugagacggggcgaccugccuguguggcucagcuacaaagucgcuuccgagggguuccaguauucugaucgcagauggugcuuugacggcgaacggaacaaucaagugcuugaggaaaacauggauguugagaucuggaccaaggagggagaacgcaaaaagcugagaccgcgguggcuggacgccagaacauacagcgacccccucgcucugcgcgaguucaaggaauuugccgcuggccggagauccgugucuggggaucuuauccuggagauuggaaaacucccucagcaccugacccagcgcgcccagaaugcgcuggacaaccucgugaugcuucauaauagcgaacaaggcgggcgggccuauagacacgcuauggaggagcugcccgauacaaucgaaacccugaugcuccuggcccuuauugcuguccugacaggaggcguuacccucuucuuucuguccggccgggggcugggaaagacgagcaucggccuccuuugugugauggccucuuccgugcugcuguggauggccagcgucgagccucauuggauugcugcgucuaucauccucgaguucuuucugauggugcuucugauucccgagccggaccgccagagaacaccucaggauaaccagcucgccuacguugugaucgggcugcuguucaugauucucaccgucgcugccaaugagaugggacuucuggaaaccaccaagaaggaccugggcaucgggcacguggccgucgagaaccaccaucacgcugccaugcucgauguggaccugcaucccgcguccgccuggacccuuuacgcuguugccacaacgauuaucaccccuaugaugcggcacacaauugaaaacaccacagcuaauaucagccugaccgccaucgcgaaccaagccgcuauucucaugggacuggauaaaggcuggcccaucucuaagauggacauuggcgugccucugcucgcccuugggugcuauagccaggucaauccccugacgcugaccgcugccgugcucaugcugguugcucauuacgccaucauuggaccgggccuucaggcgaaggccacacgcgaggcucagaagagaaccgccgcugggaucaugaagaacccuacaguggauggaaucgucgccauugaccuggaucccgugguguaugacgccaaauuugaaaagcagcucggccagaucaugcugcugauucucuguaccucccagauccuucugaugcggacgacaugggcgcugugcgagucuauuacccucgcuacagggccccugaccacccuuugggagggaagcccuggcaaauucuggaauacaacgaucgccguuuccauggcuaacaucuuccgcggcagcuaccuggccggggccggacucgcuuuuucccugaugaagucucugggcgggggaagacggggcaccggggcccaaggagaaacacucggcgagaaguggaaacgccagcuuaaucagcugagcaaguccgaguucaacaccuauaaaagaucuggcauuauggaggucgaccggagcgaagcgaaggaggggcugaaaagaggagagacaaccaagcacgccgugucccgcggcacggcuaagcuccggugguuuguggaaagaaaucuggucaaaccggaggggaagguuaucgaucuuggauguggccgcgggggauggucuuacuauugcgccggccugaaaaaggugacagaagugaaaggcuacaccaaagggggacccggccacgaggaaccuauucccauggcuaccuacggguggaaccucgucaaacugcauagcggaaaggacguguucuuuaucccucccgagaagugugauacacugcucugcgacauuggcgaguccagcccuaauccgaccaucgaagaggggcggacacuuagaguucugaaaaugguggaacccuggcugcgcggaaaccaguucuguauuaagauccucaauccuuauaugcccucugucguggagacgcuggagcaaaugcagcggaaacacggcggcaugcuuguuagaaacccucugucccgcaauagcacccaugaaauguacugggugucuugcgggacaggaaacaucgucuccgccgugaauaugaccagccggaugcuccugaacagauuuacaauggcgcaccgcaagcccaccuaugagcgggauguggaccugggcgccgggacgagacacgucgcuguugaaccggagguggccaaccucgauauuaucggacagcgcauugaaaauaucaaacaugagcacaagucuaccuggcauuacgacgaggauaacccuuauaagacaugggcuuaccacggcuccuaugaagugaaacccagcggguccgccagcucuauggucaauggagugguuaagcugcuuaccaaacccugggacgugauuccuauggucacacagaucgcuaugaccgauacaacccccuucggccaacagagaguguuuaaggagaaaguugacacgcggacaccuaaggccaagcgcggcaccgcgcagaucauggaagugaccgccaaauggcuguggggguuccucagcagaaacaagaaaccgcggauuuguacaagagaggaauuuacgcggaagguccgcuccaaugcugccaucggagcuguguucguugacgagaaccaauggaacucugccaaagaggccguggaagaugagagauuuugggaccugguccaucgggaacgcgagcuucacaagcagggcaagugcgcgaccugcguguacaacaugauggggaaaagagaaaagaaacugggagaguucggcaaggcuaaagggagccgggccauuugguacauguggcucggcgcccgcuuccuggaguuugaagcucugggauucaugaaugaggaucacugguuuuccagagaaaacucucucagcggcgucgagggggagggacugcauaaacuuggcuauauccugcgggacauuuccaaaauccccgggggaaauauguacgccgaugacacagcuggcugggauacccgcaucacagaagacgaucuccagaacgaggccaagauuaccgacaucauggaaccugagcacgcgcugcuugccaagucuauuuucaaacugacauaucagaauaaggugguuagagugcaacggcccgcuaaaaacgggaccgucauggaugugaucagccgcagagaccagcggggcuccggacaggugggcacguacgggcucaauaccuuuacaaacauggaagcccagcugauucgccaaauggagagcgagggaaucuucucuccuuccgaacuggagacccccaaccucgcuggcagaguucuggauuggcuugaaaagcaugggguggagcggcugaaaagaauggccaucagcggagacgacugugucgugaagccgauugaugaccgcuuugcgacagcccucaccgcucugaaugauaugggcaagguucggaaagacaucccucagugggaacccucuaagggguggaacgauuggcaacaggugccuuucugcucccaccacuuucaucaacuuauuaugaaagacggcagagagaucgucgugcccugucgcaaucaggaugagcuggucggacgggccagagugagccagggcgcuggguggucccuccgcgaaacggccugccugggaaagucuuaugcucagauguggcaacugauguacuuccaccggagagaccuccgccuggccgcgaacgccauuuguagcgcuguuccuguggauuggguccccacaucccggaccacauggagcauccaugcccaccaucaguggaugaccacggaggacaugcuuucuguguggaauagaguuuggauugaagagaacccguggauggaagauaaaacccacaucuccagcuggggcgacgugccuuaucuggggaagcgcgaggaccaguggugcggaucucucaucggccugacagcccgggcuaccugggccacaaauauucaagucgcgaucaaccaggugagacggcuuauugggaaugagaacuaccuggauuacaugaccagcaugaagagauuuaaaaaugaauccgaccccgagggcgcucucugguga

SEQ ID NO: 19186 - RNA, 9879 nt, Artificial Sequence
  derived and/or modified CDS sequence (opt5) from DENV-1__GU131743__SS-prME
agcgugaccaugcugcucaugcugaugcccaccgcccuugcuuuccaccugacgaccagaggaggggaaccucauaugaucgucuccaagcaggaacggggaaaaucucuccuguuuaagaccagcgccggaguuaacaugugcacccuuauugcgauggaccugggggaacucugugaagauaccaugaccuacaaaugccccagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccaggccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucagaggggaggacggaugcugguauggcauggagauucggccggugaaagaaaaggaggaaaaucuuguuaagagcauggugucugcuggguccggagaggucgacagcuuuucccucggccugcuguguaucucuauuaugaucgaagaggugaugagaagccgcuggucccggagaaugcucaugacagggacccuggccguuuucuuucuucugauuaugggacagcucacauggaacgaucugauccgccugugcauuauggugggcgccaaugcuucugacagaaugggcauggggaccaccuaccuugcccugauggcgacauucaaaaugcggccuauguuugcugucggacuccuguuccgcagacucacgagccgggaggugcugcuucugaccaucggccucucccugguggccucugucgaacugcccaacagccuugaggaacugggggauggacucgccaugggcaucaugauucugaagcuccugacagacuuucaaucccaucagcuuugggcuacccugcucagccugacauucaucaaaaccacguuuucucugcacuaugccuggaagacaauggcuaugguucuuuccauugugagccuguucccccucugucugucuaccaccucccagaaaacaaccuggcucccugugcugcuugggagccugggaugcaagccgcugacaauguuucucaucgccgagaauaagauuuggggccgcagaucuuggccccugaacgaaggcaucauggcggucgggaucguguccauucuucugagcucccuccugaaaaacgauguuccucucgccggaccccugaucgcuggcgggaugcuuauugccuguuacgugaucagcggaucuagcgcugaccugucccuggagaaggccgccgaggucucuugggaagaggaagcugagcauagcggcgcgucccacaauauucucguggaaguucaggaugacgggacgaugaaaaucaaggaugaggagcgggacgauacccugacaauccuucugaaagccacccuccuggcugugucuggagucuauccucucagcauucccgccacacuguucgugugguacuucuggcaaaagaaaaagcagcgcuccggcguccuuugggacaccccuucucccccggaaguggagagagccguucuggaugacggcaucuaucggauuaugcagcgcgggcugcucggaagaagccaggugggcgucgggguguuucaagaaaacguuuuccauacgauguggcacgugacccggggagcuguccugauguaccagggcaagagacuugagccuuccugggccagcgugaaaaaggaccugaucucuuacgggggaggcuggcgccuccagggcuccuggaauacaggggaggaagugcagguuauugcggucgagcccggcaagaacccuaagaaugugcaaaccgcucccggcacauuuaaaaccccggaaggggaggugggagccaucgcccuggauuucaagccuggcacaagcgggucucccauugucaaccgggaaggaaagaucgugggccucuauggcaaugggguugugacgaccuccggaacauacgucagcgcuaucgcccaggcgaaggcuucccaggagggcccucugcccgagauugaagacgagguguuuagaaagcgcaaccuuaccaucauggaucugcaccccgggucuggaaaaacccggagauaucugccugccauuguucgcgaagccaucaagcggaaacucagaacacugauucuugcuccgacgcgcguggucgccagcgagauggcugaagcccugaagggcaugcccauccgguaccaaaccacagcggugaaguccgagcauaccgggaaagagaucguugaccucaugugccacgccacauucaccaugagacugcugagcccugugcggguccccaauuauaacaugauuaucauggaugaagcucauuuuacggacccuucuuccauugccgcucgcggcuacaucagcacaagagugggaaugggcgaggccgccgcuauuuucaugaccgcgacacccccugggucuguggaagccuuuccgcagagcaaugcugucauccaggaugaggaacgggacauccccgagcgcuccuggaacucuggauaugaguggauuacagauuucccuggcaagaccguuugguuugugcccagcaucaaauccgggaaugacauugccaacugucucagaaagaauggaaaacgggugauccagcuuucuagaaagacauucgauaccgaauaccaaaagacgaaaaacaacgacugggacuacgucgugacaaccgauauuagcgagaugggcgccaauuuccgcgcugaccggguuaucgauccuagacgcugccugaagcccgugauucugaaagacgggccggaacgggucauccucgccggcccuaugcccgugacaguugcguccgcugcccagagacgcggacggaucggcagaaaccacaauaaggagggggaucaguauauuuacaugggacagccccugaacaaugacgaggaucaugcccacuggaccgaagcuaaaaugcuucuggacaacaucaauacgccugagggcauuauccccgcccucuuugaaccugagcgcgaaaagagcgcggccauugauggggaguauagacugcggggagaggcucgcaagaccuucguggaacugaugagacggggcgaccucccggucuggcuuucuuacaaaguggccuccgagggguuucaauauagcgaucgcagauggugcuucgacggcgaacggaacaaucagguccuggaggaaaacauggauguggagaucuggacaaaggagggagaacgcaagaaacugcgcccccgguggcucgacgcuagaaccuacuccgacccucuggcccuucgcgaguuuaaagaguucgcugccggccggagaucuguuagcggggaucugauccucgagauuggaaagcugccccagcaccugacacagcgggcgcaaaaugcccucgacaaccuugugaugcugcauaauuccgaacagggcgggcgcgcuuauagacacgccauggaggagcugccugauaccaucgaaacacucaugcugcuugcucugauugccgugcucaccggaggcgucacgcuguuuuuccugucuggccgggggcucggaaaaacaagcaucggccuucuguguguuauggccuccagcgugcugcucuggauggcuucuguggagccccauuggauugcggccuccaucauccuggaauuuuuccuuaugguccugcucauuccggagccugaccgccagagaacaccccaggauaaccaacuggcuuacgugguuaucgggcugcucuuuaugauucuuaccguggccgccaaugagaugggacugcuggaaacaaccaagaaggaccucggcaucgggcacgucgcuguggagaaccaccaucacgccgcgaugcuggaugucgaccuucauccugccagcgcuuggacacuguacgccguggcuacgaccauuaucacacccaugaugcggcacaccauugaaaacacaaccgccaauaucucucucacggcgaucgccaaccaggcugccauucugaugggacuggauaaaggcuggccuaucuccaagauggacauuggcguuccccuccuugcucuggggugcuauagccaggugaauccgcugacccucacagccgcuguccugaugcuuguggcccauuacgcgaucauuggaccuggccugcaagccaaagcuacccgcgaggcccagaagagaacagcugccgggaucaugaaaaaccccaccguugauggaaucguggccauugaccucgaucccgucguguaugacgcgaaguucgaaaagcagcugggccagaucaugcugcucauucuuuguacgucucaaauccugcugaugcggacaaccugggcucucugcgagagcauuacacuggccaccgggccucuuaccacacugugggagggauccccgggcaaauuuuggaauacgaccaucgcugugucuauggccaacaucuuccgcggcagcuaccucgccggggcuggacuggccuucucccugaugaaaagccucggcgggggaagacggggcacaggggcgcagggagaaacccuuggcgagaaauggaagagacagcugaaucagcuguccaaaucugaauuuaacacauauaagcgcagcggcauuauggagguugaccgguccgaagccaaggaggggcucaaaagaggagagaccacgaagcacgcugucucucgcggcacagccaaacugcggugguucguggaaagaaaucuugugaagcccgaggggaaagucaucgaucugggauguggccgcgggggauggagcuacuauugcgcuggccucaagaagguuaccgaagugaaaggcuacaccaaagggggaccuggccacgaggaacccauuccuauggccacauacggguggaaccuggugaaacugcauuccggaaaggacgucuuuuucauucccccugagaaaugugauacccuccuuugcgacauuggcgagucuagcccgaaucccacaaucgaagaggggcggacgcugagagugcugaagaugguugaaccuuggcuccgcggaaaccaauuuuguauuaaaauccugaaucccuauaugccuuccguggucgagacccuugagcagaugcagcggaagcacggcggcaugcuggugagaaacccccucagccgcaauucuacacaugaaauguacuggguuuccugcgggaccggaaacaucgugagcgcggucaauaugacaucucggaugcugcugaacagauucaccauggcccaccgcaagccgacguaugagagagauguggaccucggcgcugggacccggcacguggccgucgaaccugagguugcuaaccuggaugugauuggacagcgcaucgaaaauauuaaacaugagcacaaguccacauggcauuacgacgaggauaaccccuauaaaaccugggccuaccacggcagcuaugaagugaagcccucuggguccgcuagcuccauggucaauggagugguuaaacuucugacaaagccuugggacgugauccccauggucacccaaauugccaugacagauaccacgccuuuuggccagcagagaguguucaaggagaaaguugacacacggaccccgaaggcgaaaagaggcaccgcccaaaucauggaagugacagcuaaguggcucuggggguuucugagccggaacaaaaagccccgcaucuguacgagagaggaguucacccggaagguccgcucuaaugccgcuauuggagccguguuuguugacgagaaccaguggaauagcgccaaagaggcgguggaagaugagagauucugggaccuuguccaucgggaacgcgagcugcacaagcagggcaaaugcgcuacaugcguguacaacaugauggggaagagagagaaaaagcucggagaguuuggcaaggccaaagggucccgggccaucugguacauguggcugggcgcucgcuuccuggaguucgaagcccucggauuuaugaaugaggaucacugguucucuagagaaaacagccuguccggcgucgagggggagggacuucauaagcugggcuauauucuccgggacaucucuaaaauuccugggggaaauauguacgcugaugacaccgccggcugggauacacgcaucaccgaagacgaucugcagaacgaggcgagaaucacagacauuauggaacccgagcacgcccuucuggcuaagagcaucuuuaaacucaccuaucaaaauaaggugguucgggugcagcgcccugccaaaaacgggacggucauggaugugauuuccagacgggaccagagaggcucuggacaggugggcaccuacgggcugaauacauucaccaacauggaagcucaacugauccgccagauggagagcgagggaaucuuuucccccagcgaacucgagacaccgaaccuggccgaacggguucuugauuggcugggcaaguaugggguggagagacucaagcgcauggcgaucucuggagacgacugugucgugaaaccuaucgaugaccgguucgccaccgcucugacggcccuuaaugauaugggcaagguuagaaaagacauuccccagugggaaccuuccaagggguggaacgauuggcagcaagugcccuuuugcagccaucacuuccaccagcugaucaugaaagacggccgcgagauugucgugccuugucggaaucaggaugagcucgucggcagagcucgcgugucucagggcgccggguggucccugcgggaaacagcuugccugggaaagagcuacgcccaaauguggcagcucauguauuuucauagacgcgaccugcggcuugcggccaacgcuaucuguuccgccguucccguggauuggauuccgaccucuagaacaaccuggagcauccacgcccaucaccaguggaugacgaccgaggacaugcuguccgucuggaaucggguguggauugaagagaacccuuggauggaagauaagacacauaucagcucuuggggcgacguucccuaccucgggaaaagagaggaccaauggugcggaucccugaucggccuuaccgcucgcgccacaugggcgaccaauauucagguggcuaucaaccagguccggagacugauugggaaugagaacuaccucgauuauaugacaagcaugaagcgcuucaaaaaugaaucugaccccgagggcgcccugugguga

SEQ ID NO: 19187 - RNA, 9879 nt, Artificial Sequence
  derived and/or modified CDS sequence (opt5) from DENV-1__JN093516__SS-prME
agcgugaccaugcugcugaugcugaugcccaccgcccuugcuuuccaccugacgaccagaggaggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagaagguugaaacaugggcucuccggcaccccggcuuuaccgugaucgcccuguuccuugcgcaugccauugggacaucuaucacccagaagggaaucauuuuuauccugcucaugcuggucaccccuagcauggcuaugcgcugcgugggcauuggguccagagauuucguugagggacuuagcggcgccacauggguggacgucgugcuggagcacgggucuugugugacgaccauggcuaaagauaagcccacacucgacaucgaacugcugaaaaccgaggucacaaacccugccguucuccggaagcugugcauugaagcgaaaaucuccaauaccacgacagauagccgcuguccgacccaaggagaggccacccuuguggaagaacaggacgcuaacuuugugugcagacggacauucgucgaucgcggcuggggcaauggguguggacuguuuggcaaggggucucucauuaccugcgccaaguucaaaugcgugacaaagcuggagggaaaaacgguucagcacgaaaaccuuaaguacuccgugaucgucaccgugcauacaggcgaccagcaccaaguugggaaugagagcaccgaacauggaacaaccgcuacgaucacaccccaggccccuucuacagagauucagcugaccgacuauggcgcccucacacuggauuguucccccagaaccggccuggacuuuaacgaaauggugcuccugacgaugaaagaaaagagcuggcuuguccacaaacagugguuccuggaucucccucugcccuggacauccggggcuucuaccagccaagagacauggaaucggaaggaccuucuggugaccuuuaagaccgcgcacgccaaaaagcaggaagucgugguucucggaucccaggagggcgcuaugcauacagcccugacgggggccaccgaaauccaaacaagcggaaccacaaccauuuucgcuggccaccugaaaugccgccucaagauggauaaacugacgcuuaaggggaugucuuacgugauguguacaggcuccuucaagcuggagaaagaagucgccgagacccagcauggaaccgugcucguucagaucaaguaugagggcacagacgcgccgugcaaaauuccuuuuagcacccaggaugaaaagggggugacacaaaacggaagacugaucacggcuaaucccaucgucaccgacaaagagaagccugugaacauugaagccgagccgcccuucggcgagucuuacaucgugauuggggccggagaaaaggcucugaaacuuagcugguuuaagaaaggcuccucuaucgggaagauguucgaggccacaacccggggcgcuagacgcauggccauucucggagauacagcgugggacuuuggcagcaucgggggaguuuucaccuccgucggcaaacuggugcaccagaucuuugggacggccuauggagugcuguucagcggcgucucuuggaccaugaagauugggaucggcgugcuccugacauggcuuggacucaauucccggagcaccucucucuccaugacauguauugcuguuggccuggugacccuguaccuuggggucauggugcaggccgauagcggaugcguuaucaacuggaagggcagagaacucaaauguggguccggaauuuuugugacaaaugagguccauaccuggacggaacaguacaaguuccaagcugacucuccuaaacgccugagcgccgcgaucggcaaggccugggaggagggggugugcggcauucgguccgcuacaagacuggaaaacaucauguggaaacagaucucuaacgagcucaaucacauucugcuugaaaacgacaugaaguuuaccguuguggucggagauguggccggcauccuggcucaggggaaaaagaugauucgcccgcagcccauggaguauaaguacagcuggaaauccuggggaaaggccaaaaucauuggcgccgacgugcaaaauaccacauucaucaucgaugggccuaacacccccgaauguccugacgaucagcgggcuuggaauauuugggaggucgaggacuauggauuuggcaucuucacgacaaacauuuggcucaagcugagagauagcuacacccagguuugcgaccaccgccugaugucugcggccaucaaagauuccaaggcugugcaugccgacaugggcuauuggauugaaagcgagaagaaugaaacauggaaacuugcccgggcuucuuucaucgaggugaagaccuguaucuggcccaaaucccacacacucuggagcaacgggguccuggaaucugagaugauuaucccgaagauuuacggaggcccuaucagccagcauaauuauagacccggguacuuuacccaaacggccggaccuuggcaccugggcaaacucgagcuggauuucgaccuuugcgaagggaccacagugguuguggaugagcacugcggaaaccgcggccccucccugcggaccacaaccgucacgggcaagauuauccaugaaugguguugcagaagcuguacacucccuccccugcgguuuaagggggaggacggaugcugguacggcauggagauccgcccggugaaagaaaaggaggaaaaucugguuaaaucuaugguguccgcggggagcggagaggucgacuccuucucucuuggccuccuguguauuagcaucaugauugaagaggugaugagaucccgguggucuagaaagaugcugaugaccgggacacucgcugucuuuuuccugcuuaucaugggacagcugaccuggaacgaucucauucgccugugcaucauggugggcgccaaugccagcgaccggaugggcauggggaccacauaucuggcucuuauggccacguuuaaaaugagaccuauguucgcggucggacugcucuuucgcagacugaccucccgggaggugcuccugcuuacaauuggccugucucucguggcuagcgucgaacugcccaacucccuggaggaacuuggggauggacuggccaugggcaucaugauccucaagcugcucaccgacuuccagagccaccaacugugggccacacuucugucucucaccuuuauuaagacgacauucucccugcauuacgcuuggaaaaccauggccaugguucugagcaucgugucucuuuuuccccugugucucuccaccacaagccagaagaccacauggcugccugugcuccuggggucucuuggaugcaaaccgcugacgauguuccugauugcugagaauaagaucuggggccgcaaauccuggccccucaacgaaggcauuauggccgucgggaucgugagcauccugcuuuccagccugcucaagaacgauguuccucuggcgggaccccucauugccggcgggaugcugaucgcuuguuaugugauuucuggaagcuccgccgaccuuucucuggagaaagcugccgaggucagcugggaagaggaagccgagcacuccggcgcuucucauaauauccugguggaaguucaggaugacgggaccaugaagauuaaggaugaggagagagacgauacacucaccauccugcuuaaagcgacacugcucgccgugagcggagucuacccucuguccauccccgcuacccucuucgugugguauuuuuggcagaagaaaaagcaacggucuggcguccugugggacacgccuagcccucccgaaguggagcgcgccguucuugaugacggcauuuacagaaucaugcagcgggggcugcugggacgcucccaggugggcgucgggguguuccaggaaaacguuuuucacaccauguggcacgugacaagaggagccguccucauguaucaaggcaaacggcuggagcccagcugggcuucugugaagaaggaccuuauuuccuacgggggaggcuggcgccugcagggcagcuggaauaccggggaggaagugcagguuaucgccgucgagcccggcaaaaauccuaagaaugugcagacagcgcccggcaccuucaaaacaucugaaggggaggugggagcuauugcccucgauuuuaagccgggcacguccgggagcccuaucgucaacagagaaggaaaaauugugggccuguacggcaaugggguugugaccacauccggaaccuaugucucugccaucgcucaagccaaggcgagccaggagggcccccucccugagaucgaagacgagguguuccggaagagaaaccugaccauuauggaucuucaucccggguccggaaaaacacgccgguaccugcccgcuaucguuagagaagccauuaagcgcaaacugcggacgcucauccuggccccuaccagaguggucgcuagcgagauggccgaagcucuuaagggcaugccgauucgcuaucagacaaccgccgugaaaucugagcacacagggaaggagaucguugaccugaugugccaugcgaccuuuacgaugcggcuccugucccccgugagagucccuaauuacaacaugaucauuauggaugaagcccacuucacagaccccagcucuaucgcugcccgcggcuauauuagcacccgggugggaaugggcgaggcugccgccaucuuuaugaccgcuacaccucccggguccguggaagcguucccucaaucuaaugccgucauucaggaugaggaaagagacaucccggagcggagcuggaacuccggauacgaguggaucaccgauuuucccggcaagacaguuugguucgugccuucuauuaaaagcgggaaugacaucgcuaacugucugcgcaagaauggaaaaagagugauucagcucucccggaagaccuucgauacggaauaucagaaaacaaagaacaacgacugggacuacgucgugaccacagauaucagcgagaugggcgccaauuuucgcgccgacagaguuauugauccccggagaugccuuaagccugugauccugaaagacgggcccgaacgcgucauucuggcuggcccgaugccugugaccguugccucugcggcucaacggagaggacgcaucggccggaaccauaauaaggagggggaucaguacaucuauaugggacagccccucaacaaugacgaggaucacgcccacuggacggaagccaaaaugcugcuugacaacauuaauacccccgagggcaucauuccugcucuguucgaacccgagagagaaaaguccgccgcgaucgauggggaguaccgccuccggggagaggccagaaaaacauuuguggaacugaugcgcagaggcgaccugccugucuggcucagcuauaagguggcuuccgagggguuccaguacucugaucggcgcuggugcuuugacggcgaaagaaacaaucaaguccuugaggaaaacauggauguggagauuuggaccaaagagggagaacggaagaagcugcgcccgagauggcuggacgcccggacauauagcgacccccucgcucugagagaguucaaagaauuugccgcuggccgccgguccguuucuggggaucuuauccuggagaucggaaagcucccucagcaucugacccagagagcccagaaugcgcuggacaaccucgugaugcuucacaauagcgaacaaggcgggcgcgccuaccggcaugcuauggaggagcugcccgauacaauugaaacccugaugcuccuggcccuuaucgcugugcugacgggaggcgucacacucuucuuucuguccggcagagggcugggaaaaaccagcauuggccuccuuuguguuauggccucuuccgcccugcuguggauggcuagcguggagccucacuggaucgcggccucuauuauccucgaguucuuucugauggugcuucugauccccgagccggaccggcagcgcaccccucaggauaaccagcucgcuuaugucgugauugggcugcuguucaugauccucacaguugccgccaaugagaugggacuucuggaaaccacaaagaaagaccugggcauugggcacguggcugucgagaaccaucaccaugccacgaugcucgauguggaccugcaccccgcguccgccuggacccuuuacgcugucgccacaaccaucauuacaccuaugaugagacauaccaucgaaaacacgaccgcuaauauuagccugacagccaucgcgaaccaagccgcuauccucaugggacuggauaagggcuggcccauuucuaagauggacaucggcgugccucugcucgcccuugggugcuacagccagguuaauccccugacccugacagcugccgugcucaugcuggucgcucacuaugccauuaucggaccgggccuucaggcgaaagccacccgggaggcucaaaagcgcacggccgcugggauuaugaaaaacccuacaguggauggaaucguugccaucgaccuggaucccguggucuacgacgccaaguuugaaaaacagcucggccagauuaugcugcugauccucuguaccucccagauucuucugaugagaacaaccugggcgcugugcgagucuaucacccucgcuacagggccccugacgacccuuugggagggaagcccuggcaaguucuggaauacaaccauugccguguccauggcuaacaucuuccggggcagcuaucuggccggggccggacucgcuuuuucccugaugaagucucugggcgggggacgcagaggcacaggggcccaaggagaaacccucggcgagaaauggaagcggcagcuuaaucagcugagcaaauccgaguucaacacguacaagcgcucuggcaucauggagguggacagaagcgaagcgaaagaggggcugaagcggggagagacaaccaagcacgccguuuccagaggcaccgcuaaacuccgcugguuugucgaacggaaucuggugaagccggaggggaaagugauugaucuuggauguggcagagggggauggucuuauuacugcgccggccugaagaaagucacagaaguuaagggcuauaccaaagggggacccggccaugaggaaccuauccccauggcuacauacggguggaaccucgugaagcugcacagcggaaaggacguguucuuuauuccucccgagaaaugugauacgcugcucugcgacaucggcgaguccagcccuaauccgaccauugaagaggggcgcacacuucggguccugaagaugguggaacccuggcugagaggaaaccaguucuguaucaaaauucucaauccuuacaugcccucuguuguggagacccuggagcaaaugcagcgcaagcauggcggcaugcuuguccggaacccucuguccagaaauagcacacacgaaauguauugggugucuugcgggaccggaaacaucguuuccgccgugaauaugacgagccgcaugcuccugaaccgguuuaccauggcgcacagaaaacccacauacgagcgcgaugucgaccugggcgccgggacccggcauguggcuguggaaccggaggucgccaaccucgauaucauuggacagagaaucgaaaauauuaagcacgagcauaagucuacauggcacuaugacgaggauaacccuuacaaaaccugggcuuaucauggcuccuacgaaguuaagcccagcggguccgccagcucuauggugaauggaguggucaaacugcuuacaaagcccugggacgugaucccuaugguuacccagauugcuaugacggauacaacccccuucggccaacagcgcguguuuaaagagaaggucgacaccagaacaccuaaggccaaacggggcacggcgcagaucauggaagugaccgccaaguggcuguggggguuccucagccgcaacaaaaagccgagaaucuguacacgggaggaauuuaccagaaaaguucgguccaaugcugccauuggagcuguguucgucgacgagaaccaauggaacucugccaaggaggccguggaagaugagcgcuuuugggaccugguucacagagaacgggagcuucacaagcagggcaaaugcgcgacaugcguguauaacaugauggggaagcgcgagaaaaagcugggagaguucggcaaagcuaaggggagcagagccaucugguacauguggcucggcgcccgguuccuggaguuugaagcucugggauucaugaaugaggaucauugguuuucccgcgaaaacucucucagcggcgucgagggggagggacugcacaaacuuggcuacauucugagagacaucuccaagauucccgggggaaauauguaugccgaugacaccgcuggcugggauacacggaucaccgaagacgaucuccagaacgaggccaagaucacggacauuauggaaccugagcaugcgcugcuugccaaaucuaucuucaagcugaccuaccagaauaaagugguccgcgugcaaagacccgcuaagaacgggacaguuauggaugugauuagccggcgcgaccagagaggcuccggacaggucggcaccuaugggcucaauacauuuaccaacauggaagcccagcugauccggcaaauggagagcgagggaauuuucucuccuuccgaacuggagacgcccaaccucgcuggccgcgugcuggauuggcuugaaaaacacgggguggagagacugaagcggauggccaucagcggagacgacuguguugugaagccgaucgaugacagauuugcgacagcccucaccgcucugaaugauaugggcaaaguccgcaaggacauuccucagugggaacccucuaaaggguggaacgauuggcaacaggugccuuucugcucccaccauuuucaccaacuuaucaugaaggacggccgggagauuguugugcccuguagaaaucaggaugagcuggucggacgcgcccgggugagccagggcgcuggguggucccucagagaaacagccugccugggaaaaucuuacgcucagauguggcaacugauguauuuccaucgccgggaccucagacuggccgcgaacgccaucuguagcgcugucccuguggaguggguucccaccucccgcacgaccuggagcauucacgcccaucaccaguggaugacaaccgaagauaugcuuucuguguggaaucgggucuggaucgaggaaaacccguggauggaggacaagacacacauuuccagcuggggcgaugugccuuaccuggggaagagagaggaccaguggugcggaucucucaucggccugaccgcccgcgcuacaugggccaccaauauccaaguugcgauuaaccaggugcggagacuuaucgggaaugaaaacuaucuggacuacaugacgagcaugaaacgguuuaagaaugaguccgaucccgaaggcgcucucugguga

SEQ ID NO: 19188 - RNA, 9879 nt, Artificial Sequence
  derived and/or modified CDS sequence (opt5) from DENV-1__GU131746__SS-prME
agcgugaccaugcugcucaugcugaugcccacagcccuugcuuuccaccugacgacccggggcggggaaccucauaugaucguguccaagcaggaacggggaaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcaccggcgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggagguggaggacuacggauucggcauuuuuacgacaaacaucuggcugaaacuucgcgauuccuauacccaggucugcgaccaccggcucaugagcgcggccauuaaagauucuaaggcuguucacgccgacaugggcuacuggaucgaauccgagaaaaaugaaacauggaagcuggccagagcuagcuucaucgaggugaagaccuguauuuggcccaaaucucauacacugugguccaacggggugcucgaaagcgagaugaucauuccgaagaucuauggaggcccuauuucucaacacaauuaccgccccggguacuucacccagacggccggaccuuggcaucugggcaaacuugagcuggauuuugaccucugcgaagggaccacagucgugguugaugagcacugcggaaaccggggccccagccugagaaccacaaccgugacgggcaagaucauccacgaaugguguugccgguccuguacacugccuccccuucgcuucagaggggaggacggaugcugguauggcauggagauucggccggucaaagaaaaggaggaaaaucucgucaagagcaugguuucugcgggguccggagagguggacagcuuuucccugggccugcucuguaucucuauuaugaucgaagaggucaugagaagccgcuggucccggaaaaugcugaugaccgggacacuugcuguguucuuucugcucauuaugggacagcugaccuggaacgaucugaucagacuuugcauuaugguuggcgccaaugccucugaccgcaugggcauggggaccacauaccuggcucucauggccacguucaagaugagaccuauguuugcggugggacugcuguuccggcgccugaccagcagagagguccuucugcucacaaucggccugucccugguggcuucuguggaacuucccaacagccuggaggaacucggggauggacuggccaugggcaucaugauucucaaacugcuuaccgacuuucaaucccaucagcugugggccacacuccugagccugaccuucaucaagacgacauuuucucuucacuaugcuuggaaaaccauggccaugauucuguccaucgucagccucuucccccugugucucucuaccacaucccagaagaccacauggcugccuguucuucuggggagccugggaugcaagccgcucacgauguuucugauugcugagaauaaaaucuggggccggcgcucuuggccccuuaacgaaggcaucauggccguggggauuguguccauccugcucagcucccugcucaagaacgaugucccucuggcgggaccccuuauugccggcgggaugcugaucgcuuguuacgugauuagcggaucuagcgccgaccugucccucgagaaagcugccgagguuucuugggaagaggaagccgagcauagcggcgcuucccacaauauccugguggaaguccaggaugacgggaccaugaagaucaaagaugaggagagagacgauacacuuaccauucugcucaaggcgacacugcucgccgugucuggaguuuauccucugagcauccccgcuacccuuuucgugugguacuucuggcagaagaagaagcagcgguccggcguccugugggacacgccuucucccccggaaguggagcgcgccguccuggaugacggcauuuauagaaucaugcagcgggggcuccugggacgcagccaggugggcguugggguguuucaagaaaacgucuuccauaccauguggcacgugacaagaggagccguucuuauguaccagggcaaacggcuggagccuuccugggcuagcgugaagaaagaccucauuucuuacgggggaggcuggagacugcagggcuccuggaauaccggggaggaaguccaggugaucgccguggagcccggaaagaacccuaaaaauguucaaacagcgcccggcaccuuuaagacaccggaaggggaggucggagcuauugcccucgauuucaagccuggcacgagcgggucucccaucgugaaccgcgaaggaaaaaucgugggccuguauggcaauggggucgugaccacauccggaaccuacguuagcgccauugcucaggccaaggcgucccaggagggcccucuucccgagaucgaagacgagguguuucggaaaagaaaccugaccauuauggaucugcaccccgggucuggaaagacacgccgguaucucccugcuaucgucagagaagccauuaaacgcaagcugcggacgcuuauccuggccccgaccagagugguugcuagcgagauggccgaagcucucaagggcaugcccauccgcuaccaaacaaccgccgugaaauccgagcauacagggaaggagauugucgaccugaugugccacgcgaccuucacgaugcggcugcucagcccugugagaguucccaauuauaacaugaucauuauggaugaagcccauuuuacagacccuucuuccaucgcugcccggggcuacauuagcacccgcgugggaaugggcgaggcugccgccaucuucaugaccgcuacacccccugggucugucgaagcguuuccgcagagcaaugccgugauccaggaugaggaaagagacauucccgagcgguccuggaacucuggauaugaguggaucaccgauuucccuggcaaaacagugugguuuguccccagcauuaaguccgggaaugacaucgcuaacugucuucgcaaaaauggaaagagaguuauucagcugucucggaagaccuucgauacggaauaccagaagaccaagaacaacgacugggacuacguggugaccacagauaucagcgagaugggcgccaauuucagagccgaccgcgucauugauccucggagaugccugaaacccgugauccucaaggacgggccggaacgcguuauccuggcuggcccuaugcccgugaccgucgccuccgcggcucagcggagaggacgcauuggccggaaccacaauaaagagggggaucaguauaucuacaugggacagccccuuaacaaugacgaggaucaugcccacuggacggaagccaagaugcugcucgacaacauuaauaccccugagggcaucauucccgcucuguuugaaccugagagagaaaagagcgccgcgaucgauggggaguaucgccugagaggagaggcccggaaaacauucguggaacucaugcgcagaggcgaccuuccgguuuggcugucuuacaagguggcuuccgagggguuucaauauagcgaucggcgcuggugcuucgacggcgaaagaaacaaucagguccuggaggaaaacauggauguggagaucuggaccaaagagggagaacggaagaaacucagaccccgcuggcuggacgcccggacauacuccgacccucuugcucugagagaguuuaaggaguucgccgcuggccgccggucugucagcggggaucucauucuggagaucggaaaacugccccagcaccucacccagaaggcccaaaaugcgcuugacaaccuggugaugcugcauaauuccgaacagggcgggagagccuaucggcacgcuauggaggagcucccugauacaauugaaacccugaugcuucuggcccucaucgcuguucugacgggaggcgugacacuguuuuuccucucuggccgcgggcuuggaaagaccagcauuggccugcugugugugauggccuccagcguccuccuguggauggccucuguugagccccauuggaucgcugcguccaucauucuugaauuuuuccugauggugcuccugaucccggagccugacagacagcggacaccccaggauaaccaacuggccuacguggucauugggcuccuuuuuaugauccugacaguggcugccaaugagaugggacugcucgaaaccaccaagaaggaccugggcauugggcacguugccguggagaaccaccaucacgcugccaugcuugaugucgaccugcauccugcgagcgccuggacgcucuacgcuguggccaccacaaucauuacccccaugaugcgccacacaaucgaaaacaccacggcuaauaucucucugaccgccauugcgaaccaggccgcuauccugaugggacucgauaaaggcuggccuauuuccaagauggacaucggcgucccccuucuggcccuggggugcuauagccaggugaauccgcucacacugaccgcugccguucuuaugcugguggcucauuacgccauuaucggaccuggccuccaagcgaaagccacaagagaggcucagaagcggaccgccgcugggaucaugaagaaccccacggucgauggaauuguggccaucgaccuggaucccguuguguaugacgccaaauucgaaaagcagcugggccagauuaugcuccuuauccuguguacaucucaaauucugcucaugcgcaccacaugggcgcugugcgagagcaucacccuugcuaccgggccucugacaacgcucugggagggauccccgggcaaauuuuggaauaccacaaucgccgucucuauggcuaacauuuucagaggcagcuaccuggccggggccggacuggcuuucucccucaugaaaagccuuggcgggggacggcgcggcaccggggcccagggagaaacacugggcgagaaauggaagagacagcugaaucagcucuccaagucugaauuuaacaccuauaaacggagcggcaucauggagguggacagauccgaagcgaaggaggggcugaaacgcggagagacgacaaagcacgccgugucucggggcaccgcuaaacuuagaugguucguugaacgcaaucuggucaagcccgaggggaaggugauugaucucggauguggcagagggggauggagcuacuauugcgccggccugaaaaaggugaccgaagucaaaggcuacacaaaagggggaccuggccacgaggaacccaucccuauggcuaccuacggguggaaccugguuaaacuccauuccggaaaggacguguuuuucauucccccugagaaaugugauacacuucugugcgacaucggcgagucuagcccgaaucccacgauugaagaggggagaacccugcgcgugcucaagauggucgaaccuuggcugcggggaaaccaauuuuguaucaagauccuuaaucccuauaugccuuccgugguugagacacuggagcagaugcagagaaaacacggcggcaugcucgugcgcaacccccugagcagaaauucuacccaugaaauguacugggucuccugcgggacaggaaacauugugagcgccguuaauaugaccucuagaaugcugcucaaccgcuucacgauggcgcaccggaagccgaccuaugagagagauguggaccugggcgccgggacacgccacgucgcuguggaaccugagguggccaaccuugauaucauuggacagagaaucgaaaauauuaaacaugagcacaaguccaccuggcauuacgacgaggauaaccccuauaaaacaugggcuuaccacggcagcuaugaagucaagcccucuggguccgccagcuccaugguuaauggaguggugaagcugcucaccaaaccuugggacgucauccccauggugacacaaaucgcuaugaccgauacgacaccuuuuggccagcagcggguuuucaaggagaaaguggacacccgcaccccgaaggccaaaagaggcacagcgcaaauuauggaagucacggccaaguggcuguggggguuucuuagccggaacaagaaacccagaaucuguacccgggaggaguucacacgcaaggugagaucuaaugcugccauuggagcuguuuuuguggacgagaaccaguggaauagcgccaaagaggccgucgaagaugagcgguucugggaccuggugcaucgcgaaagagagcuccacaagcagggcaaaugcgcgaccugcguuuacaacaugauggggaagcgggaaaagaaacugggagaguuuggcaaggcuaaagggucccgcgccaucugguacauguggcugggcgccagauuccucgaguucgaagcucugggauuuaugaaugaggaucacugguucucucgggaaaacagccuuuccggcguggagggggagggacugcauaagcucggcuauauucugcgcgacaucucuaaaaucccugggggaaauauguacgccgaugacacagcuggcugggauaccagaauuacagaagacgaucuucagaacgaggcccggaucaccgacauuauggaacccgagcacgcgcugcucgccaagagcaucuuuaaacugacguaucaaaauaaggucgugcgcguccagagaccugcuaagaacgggaccgugauggauguuauuucccggcgcgaccagagaggcucuggacaggugggcacauacgggcugaauaccuucacaaacauggaagcccaacucauccggcagauggagagcgagggaaucuuuucccccagcgaacuggagaccccgaaccuugcugaaagaguccuggauuggcucgagaaauauggcguggaacgccugaagcggauggccauuucuggggacgacugugugguuaaaccuaucgaugacagauucgcgacggcccuuacagcucugaaugauaugggaaaggugcgcaaagacauuccccagugggagccuuccaagggcuggaacgauuggcagcaaguccccuuuugcagccaucacuuccaccagcucaucaugaaggacgggcgggagauugugguuccuuguagaaaucaggaugaacuggugggccgcgcccgggucucucagggagcuggcuggucccugagagagaccgccugccucgggaaaagcuacgcucaaauguggcagcugauguauuuucaucgccgggaccuuagacuggccgcgaacgccaucuguuccgcugugcccgucgauuggauuccgacaucucgcaccacguggagcauccacgcccaucaccaguggaugaccacagaagacaugcucuccguguggaaucggguuuggaucgaggaaaacccuuggauggaggauaagacccauauuagcucuuggggagacgugcccuaccugggcaaaagagaggaccaauggugcgggucccuuaucggacugacagcccgggcuaccugggccacaaauauucaggucgcgaucaaccaggugagacgccucauuggcaaugaaaacuaccuggauuauaugaccagcaugaagcgguucaaaaaugagucugaccccgaaggggcucugugguga

SEQ ID NO: 19189 - RNA, 9879 nt, Artificial Sequence
  derived and/or modified CDS sequence (opt5) from DENV-1__JF937609__SS-prME
agcgugaccaugcugcucaugcugaugcccacagcccuugcuuuccaccugacgaccagaggaggggaaccucauaugaucguguccaagcaggaacggggaaaaucucuccuguuuaagaccagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuauucugcgcaaacuuugcaucgaagccaagauuuccaauacgacaaccgauagcagauguccgacccaaggagaggcgacacugguugaagaacaagacgccaacuucgugugccggcgcaccuuuguggauagaggcuggggcaauggguguggacucuucggcaaagggucucugaucacaugcgcuaaguuuaagugcgucacgaaacuugagggaaagaucgugcaguacgaaaaccugaaauauuccguuauugugaccguccacacaggcgaccagcaucaaguggggaaugagagcaccgaacacggaacaaccgccacgaucacaccccaagcuccuaccaccgagauucagcucacagacuacggcgcccugacccuggauuguucuccccggacgggccucgacuucaacgaaaugguucugcuuacaaugaaggagaaauccuggcuggugcauaagcagugguuucucgaucugccucuucccuggaccagcggggccuccacaucucaagagaccuggaaucgccaggaccugcucgucaccuucaaaacagcucacgcgaagaagcaggaaguggucgugcugggaagccaagagggcgccaugcacacggcucugaccggggccacagaaauccagaccuccggaacaaccacgauuuuugccggccaucucaaaugcagacugaagauggauaaacuuacacugaaggggaugagcuauguuauguguaccggcucuuucaaacucgagaaggaaguggcugagacccagcacggaacaguccuggugcagaucaaguacgagggcaccgacgccccgugcaaaaucccuuucuccacacaagaugaaaaggggguuacgcagaacggacggcugauuaccgcgaaucccaucgugacagacaaagagaagccugucaacauugaagcugagccgcccuuuggcgagagcuauaucgugauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauuccuauacccaggucugcgaccaccggcuuaugagcgcggccaucaaagauucuaaggcuguucacgccgacaugggcuacuggaucgaauccgagaaaaaugaaacauggaagcucgccagagcuagcuucauugaggugaagaccuguaucuggcccaaaucucauacacugugguccaacggggugcuggaaagcgagaugauuaucccgaagauuuauggaggcccuaucucucaacacaauuaccgccccggguacuucacccagacggccggaccuuggcaucucggcaaacuggagcuugauuuugaccugugcgaagggaccacagucgugguugaugagcacugcggaaaccggggccccagccucagaaccacaaccgugacgggcaagaucauucacgaaugguguugccgguccuguacacugccuccccugcgcuucagaggggaggacggaugcugguauggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugaccgggacacuggcuguguuccuucugcucaucaugggacagcugaccuggaacgaucugauuagacuuugcaucaugguuggcgccaaugccucugaccgcaugggcauggggaccacauaccuggcucucauggccacguuuaagaugagaccuauguucgcggugggacugcucuuucggcgccugaccagcagagagguccuucugcucacaaucggccugucccugguggcuucuguggaacuucccaacagccuggaggaacucggggauggacuggccaugggcauuaugauccucaaacugcuuaccgacuuccaaucccaucagcugugggccacacuccugagccugaccuuuauuaagacgacauucucucuucacuaugcuuggaaaaccauggccaugguccuguccaucguuagccucuuuccccugugucucucuaccacaucccagaagaccacauggcugccugugcuucuggggagccugggaugcaagccgcucacgauguuccugauugcugagaauaaaaucuggggccggcgcucuuggccccuuaacgaaggcaucauggccguggggauugucuccauccugcucagcucccugcucaagaacgaugugccucuggcgggaccccuuauugccggcgggaugcugaucgcuuguuacguuauuagcggaucuagcgccgaccugucccucgagaaagcugccgaggugucuugggaagaggaagccgagcauagcggcgcuucccacaauauccuggucgaagugcaggaugacgggaccaugaagaucaaagaugaggagagagacgauacacuuaccauucugcucaaggcgacacugcucgccguuucuggaguguauccucugagcauccccgcuacccuuuuugucugguacuucuggcagaagaagaagcagcgguccggcgugcugugggacacgccuucucccccggaagucgagcgcgccgugcuggaugacggcauuuauagaaucaugcagcgggggcuccugggacgcagccagguuggcgugggggucuuccaagaaaacguguuucauaccauguggcacguuacaagaggagccgugcuuauguaccagggcaaacggcuggagccuuccugggcuagcgucaagaaagaccucauuucuuacgggggaggcuggagacugcagggcuccuggaauaccggggaggaaguccaggugaucgccguugagcccggaaagaacccuaaaaauguccaaacaacccccggcacauucaagacgccggaaggggaggugggagcgauugcucucgauuuuaagccuggcaccagcgggucucccaucgugaaccgcgaaggaaaaaucgucggccuguauggcaauggggugguuacaaccuccggaaccuacgugagcgccauugcccaggcuaaggccucccaggagggcccucuucccgagaucgaagacgaggucuuccggaaaagaaaccugacaauuauggaucugcaccccgggucuggaaagacgcgccgguaucucccugcgaucgugagagaagcuauuaaacgcaagcugcggacccuuauccuggccccgacaagaguuguggccagcgagauggcugaagcccucaagggcaugcccauccgcuaccaaaccacagcugucaaauccgagcauaccgggaaggagauuguggaccugaugugccacgccacguuuacaaugcggcugcucagcccuguuagagugcccaauuauaacaugaucauuauggaugaagcgcauuucaccgacccuucuuccaucgccgcucggggcuacauuagcacccgcgucggaaugggcgaggccgcugccaucuuuaugacagccacacccccugggucuguggaggcuuucccgcagagcaaugcggugauccaggaugaggaaagagacauucccgagcgguccuggaacucuggauaugaguggaucacagauuuuccuggcaaaaccgucugguucguucccagcauuaaguccgggaaugacaucgccaacugucuucgcaaaaauggaaagagagugauucagcugucucggaagacguuugauacagaauaccagaaaaccaagaacaacgacugggacuacguggucacaaccgauaucagcgagaugggcgcuaauuucagagccgaccgcgugauugauccucggagaugccugaaacccguuauccucaaggacgggccggaacgcgugauccuggccggcccuaugcccgucacgguggcuuccgccgcgcagcggagaggacgcauuggccggaaccacaauaaagagggggaucaguauaucuacaugggacagccccuuaacaaugacgaggaucaugcucacuggaccgaagccaagaugcugcucgacaacauuaauacaccugagggcaucauucccgcccuguucgaaccugagagagaaaagagcgcugccaucgauggggaguaucgccugagaggagaggcgcggaaaaccuuuguugaacucaugcgcagaggcgaccuuccgguguggcugucuuacaaggucgccuccgagggguuccaauauagcgaucggcgcuggugcuuugacggcgaaagaaacaaucaggugcuggaggaaaacauggaugucgagaucuggacaaaagagggagaacggaagaaacucagaccccgcuggcuggacgcucggaccuacuccgacccucuugcccugagagaguucaaggaauuugcugccggccgccggucugugagcggggaucucauucuggagaucggaaaacugccccagcaccucacacagagagcucaaaaugcccuugacaaccugguuaugcugcauaauuccgaacagggcgggcgggcguaucgccacgccauggaggagcucccugauaccauugaaacgcugaugcuucuggcucucaucgccgugcugacaggaggcgugacccuguucuuucucucuggcagagggcuuggaaagaccagcauuggccugcugugugucauggcuuccagcguucuccuguggauggccucuguggagccccauuggaucgccgcuuccaucauucuugaguucuuucugauggugcuccugaucccggagccugaccggcagcgcacaccccaggauaaccaacuggcguacgucgugauugggcuccuuuucaugauccugaccguugccgcuaaugagaugggacugcucgaaacaacgaagaaagaccugggcauugggcacguggccgucggaaaccaccaucacgccgcuaugcuugauguggaccugcauccugccagcgcguggacccucuacgccgucgcuacaaccaucauuacacccaugaugagacacaccaucgagaacacgaccgccaauaucucucugacagcuauugccaaccaggcggccauccugaugggccucgauaagggcuggccuauuuccaaaauggacaucggggugccccuucuggcucugggaugcuauagccagguuaauccgcucacccugacagccgcugugcuuaugcuggucgcccauuacgcuauuaucggcccugggcuccaagccaaggcgacccgggaagcccagaaacgcacggcugccggaaucaugaagaaccccacaguggauggcauuguugcuaucgaccuggaucccguggucuaugacgccaaguuugagaaacagcuggggcagauuaugcuccuuauccuguguaccucucaaauucugcucaugagaacaaccugggcccugugcgaaagcaucacccuugcgacaggaccucugacgacccucugggagggcuccccgggcaaguucuggaauacaaccaucgcugugucuauggccaacauuuuucgggggagcuaccuggcuggagccggccuggccuucucccucaugaaaagccuugggggaggccgcagagggacaggagcucagggcgagacccugggcgaaaaguggaaacggcagcugaaucagcucuccaagucugaguucaacacguauaagagaagcgggaucauggaaguggaccgcuccgaggccaaagaaggacugaagcggggcgagacaaccaaacacgcgguuucuagagggaccgccaaacuucgcugguuugucgagcggaaucuggugaaacccgaaggaaaggugauugaucucggcugugggagaggaggcuggagcuacuauugcgcuggccugaagaaagucacagagguuaagggguacaccaaaggaggcccugggcacgaagaacccaucccuauggccacauacggauggaaccuggugaagcuccauuccggcaaagacguguucuuuauucccccugaaaagugugauacgcuucugugcgacaucggggagucuagcccgaaucccaccauugaggaaggacgcacacugcggguccucaaaaugguggagccuuggcugagaggcaaccaauucuguaucaagauccuuaaucccuauaugccuuccguuguggaaacccuggagcagaugcagcgcaagcacggcgggaugcucguccggaacccccugagcagaaauucuacacaugagauguacuggguguccugcggaaccggcaacauuguuagcgcugugaauaugacgucucgcaugcugcucaaccgguuuaccauggcccacagaaaaccgacauaugaacgcgaugucgaccugggggcgggaaccagacacguggccguggagccugaagucgcuaaccuugauaucauuggccagcggaucgagaauauuaagcaugaacacaaauccacauggcauuacgacgaggauaaccccuauaagaccugggccuaccacgggagcuaugagguuaaacccucuggauccgcuagcuccauggugaauggcguggucaagcugcucacaaagccuugggacgugauccccaugguuacccaaaucgccaugacggauacaaccccuuucggccagcagcgcguguuuaaagaaaaggucgacaccagaacaccgaaagcuaagcgggggacggcccaaauuauggaggugaccgcgaaauggcuguggggauuccuuagcagaaacaagaagccccggaucuguacacgcgaagaguuuaccagaaaaguucggucuaaugccgcuauuggcgccguguucgucgacgaaaaccaguggaauagcgcuaaggaggccguggaggaugaacgcuuuugggaccugguucauagagagcgggaacuccacaaacaggggaagugcgccacaugcguguacaacaugaugggaaaacgcgagaagaagcugggcgaguucgggaaagcgaagggcuccagagcuaucugguacauguggcugggagcccgguuucucgaguucgaggcccugggcuucaugaaugaagaucacugguuuucucgcgagaacagccuuuccggggucgaaggagagggccugcauaaacucggguauauucugagagacaucucuaagaucccuggaggcaauauguacgcugaugacaccgccgggugggauacacggauuaccgaggacgaucuucagaacgaagcucgcaucacggacauuauggagcccgaacacgcccugcucgcgagaagcaucuucaaacugaccuaucaaaauaaggugguccgggugcagcgcccugccaaaaacggcacaguuauggaugugauuuccagacgggaccagagaggaucuggccaggucgggaccuacggacugaauacauuuaccaacauggaggcucaacucauccgccagauggaaagcgagggcaucuucucccccagcgagcuggaaacgccgaaccuugccgagcgggugcuggauuggcucgaaaaguaugggguggagagacugaagcgcauggcuauuucuggagacgacuguguugugaaaccuaucgaugaccgguuugccacagcgcuuaccgcccugaaugauaugggcaaggucagaaaagacauuccccagugggaaccuuccaagggguggaacgauuggcagcaagugcccuucugcagccaucacuuucaccagcucaucaugaaagacggccgcgagauuguugugccuugucggaaucaggaugagcuggucggcagagcucgcgugucucagggcgccggguggucccugcgggaaacagcuugccucggaaagagcuacgcccaaauguggcagcugauguauuuccauagacgcgaccuucggcuggcugccaacgcgaucuguuccgccguccccguggauuggauuccgaccucuagaacgaccuggagcauccacgcucaucaccaguggaugacaaccgaggacaugcucuccguuuggaaucggguguggaucgaagagaacccuuggauggaagauaagacacauauuagcucuuggggcgacguccccuaccuggggaaaagagaggaccaauggugcggaucccuuaucggccugaccgcccgcgccacaugggcuaccaauauucagguggccaucaaccagguucggagacucauugggaaugagaacuaccuggauuauaugacgagcaugaagcgcuuuaaaaaugaaucugaccccgagggcgcgcugugguga

SEQ ID NO: 19190 - RNA, 9879 nt, Artificial Sequence
  derived and/or modified CDS sequence (opt5) from DENV-1__KF921949__SS-prME
agcgugaccaugcugcucaugcugaugcccaccgcccuugcuuuccaccugacgacccggggaggggaaccucauaugaucgucuccaagcaggaacggggaaaaucucuccuguuuaagacaagcgccggcguuaacaugugcacccuuaucgcgauggaccugggggagcucugugaagauaccaugaccuacaaaugccccagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucagaaagggcagcuccauugggaaaauguuugaggcuaccgcccgcggcgcucggagaauggccauccugggagauacagcgugggacuucggcucuaucgggggaguuuuuaccagcgucggcaagcuggugcaucagauuuucgggacggccuacggagugcucuuuuccggcgucagcuggaccaugaaaaucgggauuggcgugcugcuuacauggcugggacucaauucucgcuccaccagccugucuaugacauguaucgcuguuggccuggugacccuuuaccucggggucauggugcaggccgauuccggaugcguuauuaacuggaagggccgggaacugaaaugugggagcggaaucuucgugacaaaugagguccacaccuggacggaacaauauaaguuucaggcugacuccccuaagagacugucugccgcgauuggcaaagccugggaggagggggugugcggcauccgcagcgcuacacggcucgaaaacaucauguggaagcagauuuccaacgagcugaaucauauccuucuggaaaacgacaugaaauucaccguuguggucggagaugugaccggcauucucgcccaggggaagaaaaugaucagaccgcaacccauggaguacaaguauucuuggaaaagcuggggaaaggcuaagauuaucggcgccgacgugcagaauacaaccuuuaucauugaugggccuaacacgcccgaauguccugacgaucagcgcgccuggaauaucugggaggucgaggacuacggauucggcauuuuuacaaccaacaucuggcugaaacugcgggauuccuauacacagguuugcgaccacagacuuaugagcgcugcgauuaaggauucuaaagccgugcacgcugacaugggcuacuggaucgaauccgagaagaaugaaaccuggaaacucgcccgcgccagcuucaucgaggugaagacauguauuuggcccaagucucauacccugugguccaacgggguccuggaaagcgagaugaucauuccgaaaaucuauggaggcccuauuucucaacacaauuaccggcccggguacuucacgcagaccgcuggaccuuggcaucucggcaagcuggagcuugauuuugaccugugcgaagggacaaccgugguuguggaugagcacugcggaaacagaggccccagccuccggacaaccacggucacaggcaaaaucauccacgaaugguguugccgcuccuguacccugccuccccugagauucagaggggaagacggaugcugguauggcauggagauuagaccggugaaggaaaaagaggaaaaucuuguuaagagcauggugucugccggguccggagaggucgacagcuuuucccucggccugcuguguaucucuauuaugaucgaagaggugaugcgcagccggugguccagaaagaugcucaugacagggacccuggcgguuuuccuucugcucauuaugggacagcugaccuggaacgaucugauccgccuuugcauuauggugggcgcuaaugccucugacagaaugggcauggggacaacguaccuggcccucauggcuaccuuuaaaaugcggccuauguucgccgucggacugcucuuucgcagacugacaagccgggaggugcuucugcucaccaucggccugucccugguggcgucugucgaacuucccaacagccuggaggaacucggggauggacuggcuaugggcaucaugauucucaagcugcuuacagacuuccaaucccaucagcugugggccacccuccugagccugacguuuaucaaaacaaccuucucucuucacuaugccuggaagaccauggcuaugguucuguccauugugagccucuuuccccugugucucucuacaaccucccagaaaacaacguggcugccugugcuucuggggagccugggaugcaagccgcucaccauguuccugaucgccgagaauaagauuuggggccgcagaucuuggccccuuaacgaaggcaucauggcugucgggaucguguccauucugcucagcucccugcucaaaaacgauguuccucuggccggaccccuuaucgcgggcgggaugcugauugccuguuacgugaucagcggaucuagcgcugaccugucccucgagaaggccgcugaggucucuugggaagaggaagccgagcauagcggcgccucccacaauauucugguggaaguucaggaugacgggacaaugaaaaucaaggaugaggagcgggacgauacccuuacaauccugcucaaagcuacccugcucgcggugucuggagucuauccucugagcauucccgccacgcuuuuugugugguacuucuggcaaaagaaaaagcagcgcuccggcguccugugggacaccccuucucccccggaaguggagagagcuguucuggaugacggcaucuaucggauuaugcagcgcgggcuccugggaagaagccaggugggcgucgggguguuccaagaaaacguuuuucauacaauguggcacgugacccggggagccguccuuauguaccagggcaagagacuggagccuuccugggccagcgugaaaaaggaccucaucucuuacgggggaggcuggcgccugcagggcuccuggaauacaggggaggaagugcagguuauugcugucgagcccggcaagaacccuaagaaugugcaaaccgcccccggcacauucaaaacgccggaaggggaggugggagcgaucgcucucgauuuuaagccuggcaccagcgggucucccauugucaaccgggaaggaaagaucgugggccuguauggcaaugggguugugacaaccuccggaaccuacgucagcgccaucgcccaggcuaaagccucccaggagggcccucuucccgagauugaagacgagguguucagaaagcgcaaccugacaaucauggaucugcaccccgggucuggaaaaacgcggagauaucucccugcgauuguucgcgaagcuaucaagcggaaacugagaacccuuauucuggccccgacacgcguggucgccagcgagauggcugaagcccucaagggcaugcccauccgguaccaaaccacagcugugaaguccgagcauaccgggaaagagaucguugaccugaugugccacgccacguuuacaaugagacugcucagcccugugcggguccccaauuauaacaugauuaucauggaugaagcgcauuucaccgacccuucuuccauugccgcucgcggcuacaucagcaccagagugggaaugggcgaggccgcugccauuuuuaugacagccacacccccugggucuguggaggcuuucccgcagagcaaugcggucauccaggaugaggaacgggacauccccgagcgcuccuggaacucuggauaugaguggauuacagauuuuccuggcaagaccguuugguucgugcccagcaucaaauccgggaaugacauugccaacugucuuagaaagaauggaaaacgggugauccagcugucuagaaagacguuugauacagaauaccaaaagaccaaaaacaacgacugggacuacgucgugacaaccgauauuagcgagaugggcgcuaauuuccgcgccgaccggguuaucgauccuagacgcugccugaagcccgugauucucaaagacgggccggaacgggucauccuggccggcccuaugcccgugacgguugcuuccgccgcgcagagacgcggacggaucggcagaaaccacaauaaggagggggaucaguauauuuacaugggacagccccuuaacaaugacgaggaucaugcucacuggaccgaagccaaaaugcugcucgacaacaucaauacaccugagggcauuauccccgcccuguucgaaccugagcgcgaaaagagcgcugccauugauggggaguauagacugcggggagaggcgcgcaagaccuuuguggaacucaugagacggggcgaccuuccggucuggcugucuuacaaaguggccuccgagggguuccaauauagcgaucgcagauggugcuuugacggcgaacggaacaaucagguccuggaggaaaacauggauguggagaucuggacaaaggagggagaacgcaagaagcuccgcccccgguggcuggacgcuagaaccuacuccgacccucuugcccugcgcgaguucaaagaauuugcugccggccggagaucuguuagcggggaucucauccuggagauuggaaagcugccccagcaccucacacagcgggcucaaaaugcccuugacaaccuggugaugcugcauaauuccgaacagggcgggcgcgcguauagacacgccauggaggagcucccugauaccaucgaaacgcugaugcuucuggcucucauugccgugcugacaggaggcgucacccuguucuuucucucuggccgggggcuuggaaaaaccagcaucggccugcuguguguuauggcuuccagcgugcuccuguggauggccucuguggagccccauuggauugccgcuuccaucauccuugaguucuuucugaugguccuccugauuccggagccugaccgccagagaacaccccaggauaaccaacuggcguacgugguuaucgggcuccuuuucaugauucugaccguggccgcuaaugagaugggacugcucgaaacaacgaagaaggaccugggcaucgggcacgucgccguggagaaccaccaucacgccgcuaugcuugaugucgaccugcauccugccagcgcguggacccucuacgccguggcuacaaccauuaucacacccaugaugcggcacaccauugaaaacacgaccgccaauaucucucugacagcuaucgccaaccaggcggccauucugaugggacucgauaaaggcuggccuaucuccaagauggacauuggcguuccccuucuggcucuggggugcuauagccaggugaauccgcucacccugacagccgcuguccuuaugcugguggcccauuacgcuaucauuggaccuggccuccaagccaaagcgacccgcgaggcccagaagagaacggcugccgggaucaugaaaaaccccacaguugauggaaucguggcuauugaccuggaucccgucguguaugacgccaaguuugaaaagcagcugggccagaucaugcuccuuauucuguguaccucucaaauccugcucaugcggacaaccugggcccugugcgagagcauuacccuugcgacagggccucugacgacccucugggagggauccccgggcaaauucuggaauacaaccaucgcugugucuauggccaacaucuuucgcggcagcuaccuggcuggggccggacuggccuucucccucaugaaaagccuuggcgggggaagacggggcacaggggcucagggagaaacccugggcgagaaauggaagagacagcugaaucagcucuccaaaucugaguucaacacguauaagcgcagcggcauuauggagguugaccgguccgaagccaaggaggggcugaaaagaggagagacaaccaagcacgcggucucucgcggcaccgccaaacuucggugguuuguggaaagaaaucuggugaagcccgaggggaaagucaucgaucucggauguggccgcgggggauggagcuacuauugcgcuggccugaagaagguuacagaagugaaaggcuacaccaaaggcgggccugggcacgaggaacccauuccuauggccacauacggguggaaccuggugaaacuccauuccggaaaggacgucuucuuuauucccccugagaaaugugauacgcuucugugcgacauuggcgagucuagcccgaaucccaccaucgaagaggggcggacacugagagugcucaagaugguugaaccuuggcugcgcggaaaccaauucuguauuaaaauccuuaaucccuauaugccuuccguggucgagacccuggagcagaugcagcggaagcacggcggcaugcucgugagaaacccccugagccgcaauucuacacaugaaauguacuggguuuccugcgggaccggaaacaucgugagcgcugucaauaugacgucucggaugcugcucaacagauuuaccauggcccaccgcaagccgacauaugagagagauguggaccugggcgcggggacccggcacguggccgucgaaccugagguugcuaaccuugauauuaucggacagcgcauugaaaauaucaaacaugagcacaaguccacauggcauuacgacgaggauaaccccuauaaaaccugggccuaccacggcagcuaugaagugaagcccucuggguccgcuagcuccauggugaauggagucgugaaacugcucacaaagccuugggacguuauucccauggugacccaaaucgccaugacggauacaaccccuuucggccagcagagagucuuuaaggagaaaguggacacccggacaccgaaggcuaaaagaggcacggcccaaaucauggaaguuaccgcgaaguggcuguggggguuccuuagccggaacaaaaagccccgcauuuguacaagagaggaauuuaccaagaaagugcggucuaaugccgcuaucggagccgucuucguggacgagaaccaguggaauagcgcuaaggaggccguugaagaugagcgcuuuugggaccuggugcauagagaacgggagcuccacaaacagggcaagugcgccacaugcgucuacaacaugauggggaaacgcgaaaagaagcugggagaguucggcaaagcgaagggguccagagcuauuugguacauguggcugggcgcccgguuucucgaguucgaagcccugggauucaugaaugaggaucacugguuuucucgcgaaaacagccuuuccggcguggagggggagggacugcauaaacucggcuauauccugagagacauuucuaagaucccugggggaaauauguacgcugaugacaccgccggcugggauacacggaucaccgaagacgaucuucagaacgaggcucgcauuacggacaucauggaacccgagcacgcccugcucgcgaaaagcauuuucaagcugaccuaucaaaauaaagucgugagaguucagcggccugccaagaacgggacagugauggaugucaucucccgcagagaccagcggggcucuggacaggugggcaccuacgggcugaauacauuuaccaacauggaagcucaacucauuagacagauggagagcgagggaaucuucucccccagcgaacuggagacgccgaaccuugccgaacgcgugcuggauuggcucgagaaguauggcguugaacggcugaaaagaauggcuaucucuggggacgacuguguggucaagccuauugaugaccgcuuugccacagcgcuuaccgcccugaaugauaugggaaaagugcggaaggacaucccccagugggagccuuccaaaggcuggaacgauuggcagcaaguucccuucugcagccaucacuuucaccagcucauuaugaaggacgggagagagaucguggucccuugucgcaaucaggaugaacuggugggccgggcuagagucucucagggagccggcuggucccugcgcgagacagcuugccucggaaagagcuacgcccaaauguggcagcugauguauuuccaucggagagaccuucgccuggcugccaacgcgauuuguuccgccgugcccguugauuggaucccgaccucucggacgaccuggagcauucacgcucaucaccaguggaugacaaccgaagacaugcucuccguguggaauagagucuggaucgaggaaaacccuuggauggaggauaaaacacauaucagcucuuggggagacgugcccuaccugggcaagcgggaggaccaauggugcgggucccuuauuggacugaccgccagagccacaugggcuaccaauauccagguugccauuaaccaggugcgccggcucaucggcaaugaaaacuaccuggauuauaugacgagcaugaaaagauuuaagaaugagucugaccccgaaggggcgcugugguga

SEQ ID NO: 19191 - RNA, 9879 nt, Artificial Sequence
  derived and/or modified CDS sequence (opt5) from DENV-1__GU131747__SS-prME
agcgugaccaugcugcucaugcugaugcccaccgcccuugcuuuccaccugacgaccagaggaggggaaccucauaugaucguguccaagcaggaacggggaaaaucucuccuguuuaagacaagcgccggcguuaacaugugcacccuuauugcgauggaccugggggagcucugugaagauacaaugaccuacaaaugccccagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcgccggcaaacucguucaucagauuuucgggacggcuuacggaguccuguuuuccggcgugagcuggaccaugaagaucgggauuggcgugcuucugacauggcucggacucaauucuagauccaccagccugucuaugacauguaucgccgucggccuugugacccucuaccuggggguuauggugcaggcugauuccggaugcgucauuaacuggaaaggccgcgaacugaagugugggagcggaaucuucgugacaaaugagguucacaccuggacggaacaauauaaguuucaggccgacuccccuaaacggcucucugcggccauuggcaaggcuugggaggagggggugugcggcaucagaagcgccacacgccuggaaaacaucauguggaaacagauuuccaacgagcuuaaucauauccugcucgaaaacgacaugaaguucaccgucgugguuggagauguggcuggcauucuggcccaggggaaaaagaugauccggccgcaacccauggaguacaaauauucuuggaaaagcuggggaaaggccaagauuaucggcgcugacguccagaauaccacauuuaucauugaugggccuaacacccccgaauguccugacgaucagagagcguggaauaucugggagguggaggacuacggauucggcauuuuuacgacaaacaucuggcugaaacuucgcgauuccuauacccaggugugcgaccaccggcucaugagcgccgcuauuaaagauucuagagccguccacgccgacaugggcuacuggaucgaauccgagaagaaugaaacauggaaacuggcucgcgccagcuucaucgagguuaagaccuguauuuggcccaagucucauacacugugguccaacggggugcucgaaagcgagaugaucauuccgaaaaucuauggaggcccuauuucucaacacaauuaccggcccggguacuucacccagacggcgggaccuuggcaucugggcaaacuugagcuggauuuugaccucugcgaagggaccacaguggucguggaugagcacugcggaaacagaggccccagccugcggaccacaaccguuacgggcaaaaucauccacgaaugguguugccgcuccuguacacugccuccccuuagauucagaggggaagacggaugcugguauggcauggagauucggccggugaaggaaaaagaggaaaaucucgucaagagcauggugucugcuggguccggagagguugacagcuuuucccugggccugcucuguaucucuauuaugaucgaagaggugaugcgcagccggugguccagaaagaugcugaugaccgggacacuugccgucuucuuucugcucauuaugggacagcugaccuggaacgaucugauccgccuuugcauuauggugggcgccaaugcuucugacagaaugggcauggggaccacauaccuggcccucauggcgacguucaaaaugcggccuauguuugcuguuggacugcuguuccgcagacugaccagccgggaggugcuucugcucacaaucggccugucccuggucgccucuguggaacuucccaacagccuggaggaacucggggauggacuggccaugggcaucaugauucucaagcugcuuaccgacuuucaaucccaucagcugugggcuacacuccugagccugaccuucaucaaaacgacauuuucucuucacuaugccuggaagaccauggcuauggugcuguccauugucagccucuucccccugugucucucuaccacaucccagaaaaccacauggcugccuguuuuucuugggagccugggaugcaagccgcugacgauguuccucaucgccgagaauaagauuuggggccgcagaucuuggccccugaacgaaggcaucauggcgguggggaucguguccauucuucugagcucccuccugaaaaacgaugucccucucgccggaccccugaucgcuggcgggaugcuuauugccuguuacgugaucagcggaucuagcgcugaccugucccuggagaaggccgccgagguuucuugggaagaggaagcugagcauagcggcgcgucccacaauauucucguggaaguccaggaugacgggaccaugaaaaucaaggaugaggagcgggacgauacacugaccgugcuucugaaagccacacuccuggcuguuucuggaguguauccucucagcauccccgccacccuguucgucugguacuuuuggcaaaagaaaaagcagcgcuccggcgugcuuugggacacgccuucucccccggaagucgagagagccgugcuggaugacggcauuuaucggaucaugcagcgcgggcugcucggaagaagccagguuggcgugggggucuuccaagaaaacguguuucauaccauguggcacguuacacggggagcugugcugauguaccagggcaagagacuugagccuuccugggccagcgucaaaaaggaccugauuucuuacgggggaggcuggcgccuccagggcuccuggaauaccggggaggaaguccaggugaucgcgguugagcccggcaagaacccuaagaauguccaaacagcucccggcaccuucaaaacaccggaaggggaggugggagccauugcccuggauuuuaagccuggcacgagcgggucucccaucgugaaccgggaaggaaagauugucggccucuauggcaauggggugguuaccacauccggaaccuacgugagcgcuaucgcccaggcgaaggcuucccaggagggcccucugcccgagaucgaagacgaggucuucagaaagcgcaaccuuaccauuauggaucugcaccccgggucuggaaaaacacggagauaucugccugccaucgugcgcgaagccauuaagcggaaacucagaacgcugauccuugcuccgacccgcguuguggccagcgagauggcugaagcccugaagggcaugcccauucgguaccaaacaaccgcggucaaguccgagcauacagggaaagagaucguggaccucaugugccacgccaccuuuacgaugagacugcugagcccuguucgggugcccaauuauaacaugaucauuauggaugaagcucauuucacagacccuucuuccaucgccgcucgcggcuacauuagcaccagagucggaaugggcgaggccgccgcuaucuuuaugaccgcgacacccccugggucuguggaagccuucccgcagagcaaugcugugauucaggaugaggaacgggacauccccgagcgcuccuggaacucuggauaugaguggaucaccgauuuuccuggcaagacagucugguucguucccagcauuaaauccgggaaugacaucgccaacugucucagaaagaauggaaaacgggugauucagcuuucuagaaagaccuucgauacggaauaccaaaagaccaagaacaacgacugggacuacguggucaccacagauaucagcgagaugggcgccaauuuucgcgcugaccgggugauugauccuagacgcugccugaagcccguuauccugaaagacgggccggaacgggugauucucgccggcccuaugcccgucaccguggcguccgcugcccagagacgcggacggaucggcagaaaccacaauaaggagggggaucaguauaucuacaugggacagccccugaacaaugacgaggaucaugcccacuggacggaagcuaaaaugcuucuggacaacauuaauaccccugagggcaucauucccgcccucuucgaaccugagcgcgaaaagagcgcggccaucgauggggaguauagacugcggggagaggcucgcaagacauuuguugaacugaugagacggggcgaccucccgguguggcuuucuuacaaagucgccuccgagggguuccaauauagcgaucgcagauggugcuuugacggcgaacggaacaaucaggugcuggaggaaaacauggaugucgagauuuggaccaaggagggagaacgcaagaagcugcgcccccgguggcucgacgcuagaacauacuccgacccucuggcccuucgcgaguucaaagaauuugcugccggccggagaucugugagcggggaucugauccucgagaucggaaagcugccccagcaccugacccagcgggcgcaaaaugcccucgacaaccuuguuaugcugcauaauuccgaacagggcgggcgcgcuuauagacacgccauggaggagcugccugauacaauugaaacccucaugcugcuugcucugaucgccgugcucacgggaggcgugacacuguucuuucugucuggccgggggcucggaaaaaccagcauuggccuucugugugucauggccuccagcguucugcucuggauggcuucuguggagccccauuggaucgcggccuccauuauccuggaguucuuucuuauggugcugcucaucccggagccugaccgccagagaacaccccaggauaaccaacuggcuuacgucgugauugggcuccuguucaugauccuuacaguugccgccaaugagaugggacugcuggaaaccacaaagaaggaccucggcauugggcacguggcugucgagaaccaccaucacgccgcgaugcuggauguggaccuucauccugccagcgcuuggacgcuguacgccgucgcuaccacaaucauuacccccaugaugcggcacacaaucgaaaacaccacggccaauauuucucucaccgcgaucgccaaccaggcugccauccugaugggacuggauaaaggcuggccuauuuccaagauggacaucggcgugccccuccuugcucuggggugcuauagccagguuaauccgcugacacucaccgccgcugugcugaugcuugucgcccauuacgcgauuaucggaccuggccugcaagccaaagcuacacgcgaggcccagaagagaaccgcugccgggauuaugaaaaaccccacgguggauggaaucguugccaucgaccucgaucccguggucuaugacgcgaaguuugaaaagcagcugggccagauuaugcugcucauccuuuguacaucucaaauucugcugaugcggaccacaugggcucucugcgagagcaucacccuggccaccgggccucuuacaacgcugugggagggauccccgggcaaauucuggaauaccacaauugcugugucuauggccaacaucuuccgcggcagcuaccucgccggggcuggacuggccuuuucccugaugaaaagccucggcgggggaagacggggcaccggggcgcagggagaaacacuuggcgagaaauggaagagacagcugaaucagcuguccaaaucugaguucaacaccuauaagcgcagcggcaucauggagguggaccgguccgaagccaaggaggggcucaaaagaggagagacgacaaagcacgcuguuucucgcggcaccgccaaacugcggugguuugucgaaagaaaucuugugaagcccgaggggaaagugauugaucugggauguggccgcgggggauggagcuacuauugcgcuggccucaagaaggucaccgaaguuaaaggcuacacaaaaggcgggccugggcacgaggaacccaucccuauggccaccuacggguggaaccuggugaaacugcauuccggaaaggacguguucuuuauucccccugagaaaugugauacacuccuuugcgacaucggcgagucuagcccgaaucccacgauugaagaggggcggacccugagaguccugaagaugguggaaccuuggcuccgcggaaaccaauucuguaucaaaauucugaaucccuauaugccuuccguuguggagacacuugagcagaugcagcggaagcacggcggcaugcuggucagaaacccccucagccgcaauucuacccaugaaauguacuggguguccugcgggacaggaaacaucguuagcgcggugaauaugaccucucggaugcugcugaacagauuuacgauggcccaccgcaagccgaccuaugagagagaugucgaccucggcgcugggacacggcacguggccguggaaccugaggucgcuaaccuggauaucauuggacagcgcaucgaaaauauuaaacaugagcacaaguccaccuggcauuacgacgaggauaaccccuauaaaacaugggccuaccacggcagcuaugaaguuaagcccucuggguccgcuagcuccauggugaauggaguggucaaacuucugaccaagccuugggacgugauccccaugguuacacaaauugccaugaccgauacgacaccuuucggccagcagagaguguuuaaggagaaagucgacacccggaccccgaaggcgaaaagaggcacagcccaaaucauggaagugacggcuaaguggcucuggggguuccugagccggaacaaaaagccccgcaucuguaccagagaggaauuuacacggaagguucgcucuaaugccgcuauuggagccguguucgucgacgagaaccaguggaauagcgccaaagaggcgguggaagaugagagauuuugggaccuuguucaucgggaacgcgagcugcacaagcagggcaaaugcgcuaccugcguguacaacaugauggggaagagagagaaaaagcucggagaguucggcaaggccaaagggucccgggccaucugguacauguggcugggcgcucgcuuccuggaguuugaagcccucggauucaugaaugaggaucacugguuuucuagagaaaacagccuguccggcgucgagggggagggacuucauaagcugggcuauauucuccgggacaucucuaaaauuccugggggaaauauguacgcugaugacacagccggcugggauacccgcaucacagaagacgaucugcagaacgaggcgagaaucaccgacauuauggaacccgagcacgcccuucuggcuaagagcaucuucaaacucacguaucaaaauaaggugguccgggugcagcgcccugccaaaaacgggaccguuauggaugugauuuccagacgggaccagagaggcucuggacaggucggcacauacgggcugaauaccuuuacaaacauggaagcucaacugauccgccagauggagagcgagggaauuuucucccccagcgaacucgagaccccgaaccuggccgaacgggugcuugauuggcuggagaagcauggcguggaaagacucaagcgcauggcgaucucuggggacgacuguguugugaaaccuaucgaugaccgguuugccacggcucugacagcccuuaaugauaugggaaaggucagaaaagacauuccccagugggagccuuccaagggcuggaacgauuggcagcaagugcccuucugcagccaccacuuucaucagcugaucaugaaagacgggcgcgagauuguugugccuugucggaaucaggaugaacucgucggcagagcucgcgugucucagggagccggcuggucccugcgggagaccgcuugccugggaaagagcuaugcccaaauguggcagcucauguacuuccacagacgcgaccugcggcuugcggccaacgcuaucuguuccgccguccccguggauuggauuccgacaucuagaaccacguggagcauccaugcccaccaucaguggaugaccacagaagacaugcuguccguuuggaaucggguguggauugaggaaaacccuuggauggaggauaagacccacaucagcucuuggggagacguccccuaucucggcaaaagagaggaccaauggugcgggucccugaucggacuuacagcucgcgccaccugggcgacaaauauucagguggcuaucaaccagguucggagacugauuggcaaugaaaacuaccucgauuacaugaccagcaugaagcgcuuuaaaaaugagucugaccccgaaggggcccugugguga

SEQ ID NO: 19192 - RNA, 9879 nt, Artificial Sequence
  derived and/or modified CDS sequence (opt5) from DENV-1__GU131748__SS-prME
agcgugaccaugcuguucaugcucgugcccacagcccuggcuuuucaccuuacgaccagaggcggggaaccucauaugaucguuuccaagcaggaacggggaaaaucucugcuguucaagacaagcgccggcgugaacaugugcacccugaucgcgauggaccuuggggagcugugugaagauacaaugaccuacaaaugcccccgcaucacagagaccgaacccgacgauguggacuguuggugcaaugcuacggauaccugggucacauauggaaccuguucccaaacaggcgagcacagacgggacaagcgcucuguggcccucgccccucauguugggcugggacuggagaccagaacggaaacauggaugagcuccgagggcgcuuggaaacagauucagcggguggaaaccugggcccuccgccaccccggcuuuacagucaucgcucuguuccuugcccaugcgauugggaccucuaucacccagaagggaaucauuuuuauccugcucaugcuggugacaccuagcauggccaugagaugcguuggcauugggucccgggauuucguggagggacuuagcggcgcuacgugggucgacguggugcuggagcacgggucuugugucaccacaauggccaaggauaaacccacccucgacaucgaacugcugaagacagagguuaccaacccugcugugcuccgcaaacugugcauugaagccaagaucuccaauacgacaaccgauagcagauguccgacccaaggagaggcgacacuuguggaagaacaagacgccaacuuugucugccggcgcaccuucguggauagaggcuggggcaauggguguggacuguuuggcaaagggucucucauuacaugcgcuaaguucaagugcguuacgaaacuggagggaaagaucgugcaguacgaaaaccuuaaauauuccgucaucgugaccguucacacaggcgaccagcaucaaguggggaaugagagcaccgaacacggaacaaccgccacgauuacaccccaagcuccuaccaccgagauccagcugacagacuacggcgcccucacccuggauuguucuccccggacgggccuggacuuuaacgaaaugguccuccugacaaugaaggagaaauccuggcuugugcauaagcagugguuccuggaucucccucugcccuggaccagcggggccuccacaucucaagagaccuggaaucgccaggaccuucuggucaccuuuaaaacagcucacgcgaagaagcaggaagugguugugcucggaagccaagagggcgccaugcacacggcucugaccggggccacagaaauucagaccuccggaacaaccacgaucuucgccggccaucugaaaugcagacucaagauggauaaacugacacuuaaggggaugagcuaugucauguguaccggcucuuucaaacuggagaaggaaguggcugagacccagcacggaacaguucucgugcagauuaaguacgagggcaccgacgccccgugcaaaaucccuuuuuccacacaagaugaaaagggggucacgcagaacggacggcugaucaccgcgaaucccauugugacagacaaagagaagccugugaacaucgaagcugagccgcccuucggcgagagcuauauuguuaucggggccggagaaaaagcccugaaacuuucuugguuuaagaaaggcagcuccauugggaagauguucgaggcuaccgccagaggcgcucgccggauggccauccucggagauacagcgugggacuuuggcucuaucgggggagucuucaccagcgugggcaaacuggugcaucagauuuuugggacggccuacggaguccuguucuccggcgugagcuggaccaugaagaucgggauuggcguucuccugacauggcuuggacucaauucuagauccaccagccucucuaugacauguaucgcugugggccuggucacccuguaccuuggggugaugguucaggccgauuccggaugcgugauuaacuggaaaggccgcgaacucaagugugggagcggaaucuuugucacaaaugaggugcacaccuggacggaacaauauaaguuccaggcugacuccccuaaacggcugucugccgcgauuggcaaggccugggaggaggggguuugcggcaucagaagcgcuacacgccuggaaaacaucauguggaaacagauuuccaacgagcucaaucauauccugcuugaaaacgacaugaaguuuaccguggucgugggagauguggccggcauucuggcucaggggaaaaagaugauccggccgcaacccauggaguacaaauauucuuggaaaagcuggggaaaggccaagauuaucggcgccgacguccagaauaccacauucaucauugaugggccuaacacccccgaauguccugacgaucagagagcuuggaauaucugggagguugaggacuacggauuuggcauuuucacgacaaacaucuggcucaagcugcgcgauuccuauacccaggugugcgaccaccggcugaugagcgcggccauuaaagauucuaaggcugugcacgccgacaugggcuacuggaucgaauccgagaaaaaugaaacauggaaacuugccagagcuagcuucaucgaggucaagaccuguauuuggcccaaaucucauacacucugguccaacggggugcuggaaagcgagaugaucauuccgaagaucuauggaggcccuauuucucaacacaauuaccgccccggguacuuuacccagacggccggaccuuggcaucugggcaaacucgagcuggauuucgaccuuugcgaagggaccacaguuguggucgaugagcacugcggaaaccggggccccagccugagaaccacaaccgugacgggcaagaucauccacgaaugguguugccgguccuguacacucccuccccugcgcuuuagaggggaggacggaugcugguauggcauggagauucggccgguuaaagaaaaggaggaaaaucuggucaagagcauggucucugcgggguccggagagguggacagcuucucccuuggccuccuguguaucucuauuaugaucgaagagguuaugagaagccgcuggucccggaaaaugcugaugaccgggacacucgcuguguuuuuccugcuuauuaugggacagcugaccuggaacgaucucaucagacugugcauuauggucggcgccaaugccucugaccgcaugggcauggggaccacauaccuggcucuuauggccacguuuaagaugagaccuauguucgcggugggacugcucuuucggcgccugaccagcagagaggugcuccugcuuacaaucggccugucccucgucgcuucuguugaacugcccaacagccuggaggaacuuggggauggacuggccaugggcaucaugauucucaaacugcucaccgacuuccaaucccaucagcugugggccacacuucugagccucaccuuuaucaagacgacauucucucugcacuaugcuuggaaaaccauggccauggugcuguccauugugagccuuuuuccccugugucucucuaccacaucccagaagaccacauggcugccuguccuccuggggagccuuggaugcaagccgcugacgauguuccugaucgcugagaauaaaauuuggggccggcgcucuuggccccucaacgaaggcaucauggccguggggaucguuuccauucugcuuagcucccugcucaagaacgaugugccucuggcgggaccccucaucgccggcgggaugcugauugcuuguuacgucaucagcggaucuagcgccgaccuuucccuggagaaagcugccgaggugucuugggaagaggaagccgagcauagcggcgcuucccacaauauucugguugaagugcaggaugacgggaccaugaagaucaaagaugaggagagagacgauacacucaccauccugcuuaaggcgacacugcucgccgucucuggaguguauccucugagcauucccgcuacccucuucgucuggcauuuuuggcagaagaagaagcagcgguccggcgugcugugggacacgccuucucccccggaaguugagcgcgccgugcuugaugacggcaucuacagaauuaugcagcgggggcugcugggacgcagccaggucggcguggggguuuuccaagaaaacguguuucacaccauguggcacgucacaagaggagccgugcucauguaucagggcaaacggcuggagccuuccugggcuagcgugaagaaagaccuuaucucuuacgggggaggcuggagacugcagggcuccuggaauaccggggaggaaguucaggucauugccguggagcccggaaagaacccuaaaaaugugcaaacagcgcccggcaccuucaagacaccggaaggggaggucggagcuaucgcccucgauuuuaagccuggcacgagcgggucucccauugugaaccgcgaaggaaaaaucguuggccuguacggcaaugggguggucaccacauccggaaccuaugugagcgccaucgcucaggccaaggcgucccaggagggcccucuccccgagauugaagacgagguuuuccggaaaagaaaccugaccaucauggaucuucaucccgggucuggaaagacacgccgguaccugccugcuauugugagagaagccaucaaacgcaagcugcggacgcucauucuggccccgaccagagucguggcuagcgagauggccgaagcucuuaagggcaugcccauccgcuaucaaacaaccgccguuaaauccgagcacacagggaaggagaucguggaccugaugugccaugcgaccuuuacgaugcggcuccugagcccugucagagugcccaauuacaacaugauuaucauggaugaagcccacuucacagacccuucuuccauugcugcccggggcuauaucagcacccgcgugggaaugggcgaggcugccgccauuuuuaugaccgcuacacccccugggucugucgaagcguucccgcagagcaaugccguuauccaggaugaggaaagagacauccccgagcgguccuggaacucuggauacgaguggauuaccgauuuuccuggcaaaacagugugguucgugcccagcaucaaguccgggaaugacauugcuaacugucugcgcaaaaauggaaagagagucauccagcucucucggaagaccuucgauacggaauaucagaagaccaagaacaacgacugggacuacgugguuaccacagauauuagcgagaugggcgccaauuuuagagccgaccgcgugaucgauccucggagaugccuuaaacccgucauucugaaggacgggccggaacgcgugauccuggcuggcccuaugcccguuaccguggccuccgcggcucagcggagaggacgcaucggccggaaccauaauaaagagggggaucaguacauuuauaugggacagccccucaacaaugacgaggaucacgcccacuggacggaagccaagaugcugcuugacaacaucaauaccccugagggcauuauccccgcucuguucgaaccugagagagaaaagagcgccgcgauugauggggaguaccgccucagaggagaggcccggaaaacauuugucgaacugaugcgcagaggcgaccugccgguguggcucucuuauaaggucgcuuccgagggguuccaauacagcgaucggcgcuggugcuuugacggcgaaagaaacaaucaggugcuugaggaaaacauggauguugagaucuggaccaaagagggagaacggaagaaacugagaccccgcuggcuggacgcccggacauauuccgacccucucgcucugagagaguucaaggaauuugccgcuggccgccggucugugagcggggaucuuauccuggagauuggaaaacucccccagcaucugacccagagagcccaaaaugcgcuggacaaccucgugaugcuucacaauuccgaacagggcgggcgggccuaccgccaugcuauggaggagcugccugauacaaucgaaacccugaugcuccuggcccuuauugcuguccugacgggaggcguuacacucuucuuucugucuggcagagggcugggaaagaccagcaucggccuccuuugugugauggccuccagcgugcugcuguggauggccucugucgagccccacuggauugcugcguccaucauccucgaguucuuucugauggugcuucugauuccggagccugaccggcagcgcacaccccaggauaaccaacucgccuauguugugaucgggcugcuguucaugauucucacagucgcugccaaugagaugggacuucuggaaaccacaaagaaagaccugggcaucgggcacguggccgucgagaaccaucaccaugcugccaugcucgauguggaccugcacccugcgagcgccuggacgcuuuacgcuguugccaccacaauuaucacccccaugaugagacauacaauugaaaacaccacggcuaauaucucucugaccgccaucgcgaaccaggccgcuauucucaugggacuggauaagggcuggccuaucuccaaaauggacauuggcgugccccugcucgcccuugggugcuacagccaggucaauccgcugacacugaccgcugccgugcucaugcugguugcucacuaugccaucauuggaccuggccuucaagcgaaggccacacgggaggcucagaaacgcaccgccgcugggaucaugaagaaccccacgguggauggaaucgucgccauugaccuggaucccgugguguacgacgccaaguuugaaaaacagcucggccagaucaugcugcugauucucuguacaucucaaauccuucugaugagaaccacaugggcgcugugcgagagcauuacccucgcuaccgggccucugacaacgcuuugggagggauccccgggcaaguucuggaauaccacaaucgccguuucuauggcuaacaucuuccggggcagcuaucuggccggggccggacucgcuuuuucccugaugaaaagccugggcgggggacgcagaggcaccggggcccagggagaaacacucggcgagaaguggaaacggcagcuuaaucagcuguccaagucugaguucaacaccuacaagagaagcggcauuauggaggucgaccgcuccgaagcgaaagaggggcugaagcggggagagacgacaaaacacgccgugucuagaggcaccgcuaagcuccgcugguuuguggaacggaaucuggucaaacccgaggggaagguuaucgaucuuggauguggcagagggggauggagcuauuacugcgccggccugaagaaagugaccgaagugaagggcuauacaaaagggggaccuggccaugaggaacccauuccuauggcuaccuacggguggaaccucgucaagcugcacuccggaaaagacguguucuuuauucccccugagaagugugauacacugcucugcgacauuggcgagucuagcccgaaucccacgaucgaagaggggcgcacccuucggguucugaaaaugguggaaccuuggcugagaggaaaccaauucuguauuaagauccucaaucccuacaugccuuccgucguggagacacuggagcagaugcagcgcaagcauggcggcaugcuuguucggaacccccugagcagaaauucuacccacgaaauguauuggguguccugcgggacaggaaacaucgucagcgccgugaauaugaccucucgcaugcuccugaaccgguuuacgauggcgcacagaaaaccgaccuacgagcgcgauguggaccugggcgccgggacaagacaugucgcuguugaaccugagguggccaaccucgauauuaucggacagcggauugaaaauaucaagcacgagcauaaauccaccuggcacuaugacgaggauaaccccuacaagacaugggcuuaucauggcagcuacgaagugaaacccucuggguccgccagcuccauggucaauggagugguuaagcugcuuaccaagccuugggacgugauucccauggucacacaaaucgcuaugaccgauacgacaccuuucggccagcagcgcguguuuaaagagaagguugacaccagaaccccgaaagccaagcggggcacagcgcaaaucauggaagugacggccaaauggcuguggggguuccucagcagaaacaagaagccccggauuuguacccgcgaggaauuuacaagaaaaguccggucuaaugcugccaucggagcuguguucguugacgagaaccaguggaauagcgccaaggaggccguggaagaugagcgcuuuugggaccugguccacagagaacgggagcuucacaaacagggcaagugcgcgaccugcguguauaacaugauggggaaacgcgaaaagaagcugggagaguucggcaaagcuaagggguccagagccauuugguacauguggcucggcgcccgguuccuggaguuugaagcucugggauucaugaaugaggaucauugguuuucucgcgaaaacagccucuccggcgucgagggggagggacugcacaaacuuggcuacauccugagagacauuucuaagaucccugggggaaauauguaugccgaugacacagcuggcugggauacccggaucacagaagacgaucuccagaacgaggcccgcauuaccgacaucauggaacccgagcaugcgcugcuugccaaaagcauuuucaagcugacguaccaaaauaaagugguuagagugcagcggccugcuaagaacgggaccgucauggaugugaucucccgcagagaccagcggggcucuggacaggugggcacauaugggcucaauaccuuuacaaacauggaagcccaacugauuagacagauggagagcgagggaaucuucucccccagcgaacuggagaccccgaaccucgcugaacgcguucuggauuggcuugagaaguacggcgugaaacggcugaagagaauggccaucucuggggacgacugugucgugaaaccuauugaugaccgcuuugcgacggcccucacagcucugaaugauaugggaaagguucggaaagacaucccccagugggaaccuuccaagggcuggaacgauuggcagcaagugcccuucugcagccaccacuuucaucagcuuauuaugaaggacgggagagagaucgucgugccuugucgcaaucaggaugagcuggucggccgggccagagugucucagggagcuggcuggucccuccgcgaaaccgccugccuggggaaaagcuaugcucaaauguggcagcugauguacuuccaccggagagaccuccgccuggccgcgaacgccauuuguuccgcuguucccguggauuggaucccgacaucucggaccacguggagcauucaugcccaccaucaguggaugaccacagaggacaugcuuuccgucuggaauagaguguggaucgaagagaacccuuggauggaagauaagacccacaucagcucuuggggagacguucccuaucugggcaaacgggaggaccaauggugcgggucccucauuggacugacagccagagcuaccugggccacaaauauccagguggcgauuaaccagguccgccggcuuaucggcaaugagaacuaccuggauuacaugaccagcaugaagagauuuaaaaaugaaucugaccccgagggggcucucugguga

SEQ ID NO: 19193 - RNA, 9879 nt, Artificial Sequence
  derived and/or modified CDS sequence (opt5) from DENV-1__GQ868615__SS-prME
agcgugaccaugcugcucaugcugaugcccacagcccuugcuuuccaccugacgaccagaggcggggaaccucauaugaucguguccaagcaggaacgggggaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggagguggaggacuacggauucggcauuuuuacgacaaacaucuggcugaaacuucgcgauuccuauacccaggucugcgaccaccggcucaugagcgcggccauuaaagauucuaaggcuguucacgccgacaugggcuacuggaucgaauccgagaaaaaugaaacauggaagcuggccagagcuagcuucaucgaggugaagaccuguauuuggcccaaaucucauacacugugguccaacggggugcucgaaagcgagaugaucauuccgaagaucuauggaggcccuauuucucaacacaauuaccgccccggguacuucacccagacggccggaccuuggcaucugggcaaacuugagcuggauuuugaccucugcgaagggaccacagucgugguugaugagcacugcggaaaccggggccccagccugagaaccacaaccgugacgggcaagaucauccacgaaugguguugccgguccuguacacugccuccccuucgcuucagaggggaggacggaugcugguauggcauggagauucggccggucaaagaaaaggaggaaaaucucgucaagagcaugguuucugcgggguccggagagguggacagcuuuucccugggccugcucuguaucucuauuaugaucgaagaggucaugagaagccgcuggucccggaaaaugcugaugaccgggacacuugcuguguucuuucugcucauuaugggacagcugaccuggaacgaucugaucagacuuugcauuaugguuggcgccaaugccucugaccgcaugggcauggggaccacauaccuggcucucauggccacguucaagaugagaccuauguuugcggugggacugcuguuccggcgccugaccagcagagagguccuucugcucacaaucggccugucccugguggcuucuguggaacuucccaacagccuggaggaacucggggauggacuggccaugggcaucaugauucucaaacugcuuaccgacuuucaaucccaucagcugugggccacacuccugagccugaccuucaucaagacgacauuuucucuucacuaugcuuggaaaaccauggccaugauucuguccaucgucagccucuucccccugugucucucuaccacaucccagaagaccacauggcugccuguucuucuggggagccugggaugcaagccgcucacgauguuucugauugcugagaauaaaaucuggggccggcgcucuuggccccuuaacgaaggcaucauggccguggggauuguguccauccugcucagcucccugcucaagaacgaugucccucuggcgggaccccuuauugccggcgggaugcugaucgcuuguuacgugauuagcggaucuagcgccgaccugucccucgagaaagcugccgagguuucuugggaagaggaagccgagcauagcggcgcuucccacaauauccugguggaaguccaggaugacgggaccaugaagaucaaagaugaggagagagacgauacacuuaccauucugcucaaggcgacacugcucgccgugucuggaguuuauccucugagcauccccgcuacccuuuucgugugguacuucuggcagaagaagaagcagcgguccggcguccugugggacacgccuucucccccggaaguggagcgcgccguccuggaugacggcauuuauagaaucaugcagcgggggcuccugggacgcagccaggugggcguugggguguuucaagaaaacgucuuccauaccauguggcacgugacaagaggagccguucuuauguaccagggcaaacggcuggagccuuccugggcuagcgugaagaaagaccucauuucuuacgggggaggcuggagacugcagggcuccuggaauaccggggaggaaguccaggugaucgccguggagcccggaaagaacccuaaaaauguucaaacagcgcccggcaccuuuaagacaccggaaggggaggucggagcuauugcccucgauuucaagccuggcacgagcgggucucccaucgugaaccgcgaaggaaaaaucgugggccuguauggcaauggggucgugaccacauccggaaccuacguuagcgccauugcucaggccaaggcgucccaggagggcccucuucccgagaucgaagacgagguguuucggaaaagaaaccugaccauuauggaucugcaccccgggucuggaaagacacgccgguaucucccugcuaucgucagagaagccauuaaacgcaagcugcggacgcuuauccuggccccgaccagagugguugcuagcgagauggccgaagcucucaagggcaugcccauccgcuaccaaacaaccgccgugaaauccgagcauacagggaaggagauugucgaccugaugugccacgcgaccuucacgaugcggcugcucagcccugugagaguucccaauuauaacaugaucauuauggaugaagcccauuuuacagacccuucuuccaucgcugcccggggcuacauuagcacccgcgugggaaugggcgaggcugccgccaucuucaugaccgcuacacccccugggucugucgaagcguuuccgcagagcaaugccgugauccaggaugaggaaagagacauucccgagcgguccuggaacucuggauaugaguggaucaccgauuucccuggcaaaacagugugguuuguccccagcauuaaguccgggaaugacaucgcuaacugucuucgcaaaaauggaaagagaguuauucagcugucucggaagaccuucgauacggaauaccagaagaccaagaacaacgacugggacuacguggugaccacagauaucagcgagaugggcgccaauuucagagccgaccgcgucauugauccucggagaugccugaaacccgugauccucaaggacgggccggaacgcguuauccuggcuggcccuaugcccgugaccgucgccuccgcggcucagcggagaggacgcauuggccggaaccacaauaaagagggggaucaguauaucuacaugggacagccccuuaacaaugacgaggaucaugcccacuggacggaagccaagaugcugcucgacaacauuaauaccccugagggcaucauucccgcucuguuugaaccugagagagaaaagagcgccgcgaucgauggggaguaucgccugagaggagaggcccggaaaacauucguggaacucaugcgcagaggcgaccuuccgguuuggcugucuuacaagguggcuuccgagggguuucaauauagcgaucggcgcuggugcuucgacggcgaaagaaacaaucagguccuggaggaaaacauggauguggagaucuggaccaaagagggagaacggaagaaacucagaccccgcuggcuggacgcccggacauacuccgacccucuugcucugagagaguuuaaggaguucgccgcuggccgccggucugucagcggggaucucauucuggagaucggaaaacugccccagcaccucacccagagagcccaaaaugcgcuugacaaccuggugaugcugcauaauuccgaacagggcgggcgggccuaucgccacgcuauggaggagcucccugauacaauugaaacccugaugcuucuggcccucaucgcuguucugacgggaggcgugacacuguuuuuccucucuggcagagggcuuggaaagaccagcauuggccugcugugugugauggccuccagcguccuccuguggauggccucuguugagccccauuggaucgcugcguccaucauucuugaauuuuuccugauggugcuccugaucccggagccugaccggcagcgcacaccccaggauaaccaacuggccuacguggucauugggcuccuuuuuaugauccugacaguggcugccaaugagaugggacugcucgaaaccacaaagaaagaccugggcauugggcacguugccguggagaaccaccaucacgcugccaugcuugaugucgaccugcauccugcgagcgccuggacgcucuacgcuguggccaccacaaucauuacccccaugaugagacacacaaucgaaaacaccacggcuaauaucucucugaccgccauugcgaaccaggccgcuauccugaugggacucgauaagggcuggccuauuuccaaaauggacaucggcgucccccuucuggcccuggggugcuauagccaggugaauccgcucacacugaccgcugccguucuuaugcugguggcucauuacgccauuaucggaccuggccuccaagcgaaggccacacgggaggcucagaaacgcaccgccgcugggaucaugaagaaccccacggucgauggaauuguggccaucgaccuggaucccguuguguaugacgccaaguucgaaaaacagcugggccagauuaugcuccuuauccuguguacaucucaaauucugcucaugagaaccacaugggcgcugugcgagagcaucacccuugcuaccgggccucugacaacgcucugggagggauccccgggcaaguuuuggaauaccacaaucgccgucucuauggcuaacauuuuccggggcagcuaccuggccggggccggacuggcuuucucccucaugaaaagccuuggcgggggacgcagaggcaccggggcccagggagaaacacugggcgagaaguggaaacggcagcugaaucagcucuccaagucugaauuuaacaccuauaagagaagcggcaucauggagguggaccgcuccgaagcgaaagaggggcugaagcggggagagacgacaaaacacgccgugucuagaggcaccgcuaaacuucgcugguucguugaacggaaucuggucaaacccgaggggaaggugauugaucucggauguggcagagggggauggagcuacuauugcgccggccugaagaaagugaccgaagucaagggcuacacaaaagggggaccuggccacgaggaacccaucccuauggcuaccuacggguggaaccugguuaagcuccauuccggaaaagacguguuuuucauucccccugagaagugugauacacuucugugcgacaucggcgagucuagcccgaaucccacgauugaagaggggcgcacccugcgggugcucaaaauggucgaaccuuggcugagaggaaaccaauuuuguaucaagauccuuaaucccuauaugccuuccgugguugagacacuggagcagaugcagcgcaagcacggcggcaugcucgugcggaacccccugagcagaaauucuacccaugaaauguacugggucuccugcgggacaggaaacauugugagcgccguuaauaugaccucucgcaugcugcucaaccgguucacgauggcgcacagaaaaccgaccuaugagcgcgauguggaccugggcgccgggacaagacacgucgcuguggaaccugagguggccaaccuugauaucauuggacagcggaucgaaaauauuaagcaugagcacaaauccaccuggcauuacgacgaggauaaccccuauaagacaugggcuuaccacggcagcuaugaagucaaacccucuggguccgccagcuccaugguuaauggaguggugaagcugcucaccaagccuugggacgucauccccauggugacacaaaucgcuaugaccgauacgacaccuuuuggccagcagcgcguuuucaaagagaagguggacaccagaaccccgaaagccaagcggggcacagcgcaaauuauggaagucacggccaaauggcuguggggguuucuuagcagaaacaagaagccccggaucuguacccgcgaggaguucacaagaaaagugcggucuaaugcugccauuggagcuguuuuuguggacgagaaccaguggaauagcgccaaggaggccgucgaagaugagcgcuucugggaccuggugcauagagaacgggagcuccacaaacagggcaagugcgcgaccugcguuuacaacaugauggggaaacgcgaaaagaagcugggagaguuuggcaaagcuaagggguccagagccaucugguacauguggcugggcgcccgguuccucgaguucgaagcucugggauuuaugaaugaggaucacugguucucucgcgaaaacagccuuuccggcguggagggggagggacugcauaaacucggcuauauucugagagacaucucuaagaucccugggggaaauauguacgccgaugacacagcuggcugggauacccggauuacagaagacgaucuucagaacgaggcccgcaucaccgacauuauggaacccgagcacgcgcugcucgccaaaagcaucuuuaagcugacguaucaaaauaaagucgugagaguccagcggccugcuaagaacgggaccgugauggauguuauuucccgcagagaccagcggggcucuggacaggugggcacauacgggcugaauaccuucacaaacauggaagcccaacucaucagacagauggagagcgagggaaucuuuucccccagcgaacuggagaccccgaaccuugcugaacgcguccuggauuggcucgagaaguauggcguggaacggcugaaaagaauggccauuucuggggacgacugugugguuaagccuaucgaugaccgcuucgcgacggcccuuacagcucugaaugauaugggaaaagugcggaaggacauuccccagugggagccuuccaaaggcuggaacgauuggcagcaaguccccuuuugcagccaucacuuccaccagcucaucaugaaggacgggagagagauugugguuccuugucgcaaucaggaugaacuggugggccgggccagagucucucagggagcuggcuggucccugcgcgagaccgccugccucggaaagagcuacgcucaaauguggcagcugauguauuuucaucggagagaccuucgccuggccgcgaacgccaucuguuccgcugugcccgucgauuggauuccgacaucucggaccacguggagcauccacgcccaucaccaguggaugaccacagaagacaugcucuccguguggaauagaguuuggaucgaggaaaacccuuggauggaggauaaaacccauauuagcucuuggggagacgugcccuaccugggcaagcgggaggaccaauggugcgggucccuuaucggacugacagccagagcuaccugggccacaaauauucaggucgcgaucaaccaggugcgccggcucauuggcaaugaaaacuaccuggauuauaugaccagcaugaaaagauucaagaaugagucugaccccgaaggggcucugugguga

SEQ ID NO: 19194 - RNA, 9879 nt, Artificial Sequence
  derived and/or modified CDS sequence (opt5) from DENV-1__GU131749__SS-prME
agcgugaccaugcugcucaugcugaugcccacggcccuugcuuuccaccugacgacccggggcggggagccucauaugaucgucuccaagcaggaacggggaaagucucuccuguuuaagaccagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccagaccggcgagcacagacgggagaagcgcucugucgcccuggcuccucauguggggcugggacucgaaacaagaaccgagacguggaugagcuccgaaggcgccuggaaacagauucagcggguugagacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggacuuuguugagggacugagcggcgccacauggguggaugucgugcucgaacacgggucuugugugacgaccauggcuaaggacaaacccacacuggauaucgagcugcucaagaccgaagucacaaacccugccguucugcgcaaacuuugcauugaggcgaagaucuccaauaccacgacagacagcagauguccgacccaaggagaagccacccugguggaggagcaggaugcuaacuucgugugccggcgcacauuugucgacagaggcuggggcaauggguguggacucuucggcaaagggucucugcuuaccugcgccaaguuuaagugcgugacaaaacuggaaggaaagauuguucaguacgagaaccucaaauauuccgugaucgucacggugcacaccggcgaucagcaucaaguugggaaugaaagcacagagcacggaaccacagcuaccaucacgccccaggccccuaccacagaaauucagcugaccgacuacggcgcccugacacucgacuguucuccccggaccggccuggauuucaacgagauggugcuucugacgaugaaggagaaauccuggcucguccauaagcagugguuucuggaccuuccucugcccuggacaagcggggcuuccaccucucaagaaacauggaaucgccaggaucuccuggugaccuucaaaaccgcgcacgccaagaagcaggaggucgugguucugggaagccaagaaggcgcuaugcacacagcccucacgggggccaccgagauccagacauccggaaccacaaccauuuuugcuggccaucugaaaugcagacuuaagauggacaaacugacgcucaaggggaugagcuaugugauguguacaggcucuuucaaacuggaaaaggaggucgccgagacccagcacggaaccgugcugguucagaucaaguacgaaggcacagaugcgccgugcaaaauuccuuucuccacccaagacgagaagggggugacacagaacggacggcuuaucacggcuaaucccaucgucaccgauaaagaaaagccugugaacauugaggccgagccgcccuuuggcgaaagcuauaucgugauuggggccggagagaaagcucucaagcugucuugguucaagaaaggcagcuccaucgggaagauguuugaagccacagcuagaggcgcccgccggauggcgauucugggagacaccgccugggauuucggcucuaucgggggaguuuuuacaagcgucggcaaacucgugcaucagaucuucgggaccgcuuacagagugcuguuuuccggagucagcuggacgaugaagauuggcaucggggugcuucugaccuggcucggccucaauucucgcuccacaagccugucuaugaccuguauugccguuggacuugugacacucuaccugggcgucauggugcaggcugacuccgggugcguuaucaacuggaaaggacgggagcugaaguguggcagcgggauuuucgugaccaaugaaguccacacauggaccgagcaauauaaguuucaggccgauuccccuaaaagacucucugcggccaucggaaaggcuugggaggaaggcgugugcgggauucgcagcgccacgcggcuggagaacaucauguggaaacagaucuccaacgaacuuaaucauauucugcucgagaacgacaugaaguucacaguuguggucggcgacguggcuggaauccuggugcagggcaaaaagaugauuagaccgcaacccauggaauacaaauauucuuggaaaagcugggggaaggccaaaaucauuggagccgauguccaaaauuccaccuuuaucaucgacggcccuaacacccccgaguguccugaugaccagcgcgcuuggaauauuugggagguugaagauuacggguucggaaucuuuacaaccaacauuuggcugaaacuucgggacagcuauacacaggugugcgaucacagacucaugucugcggccaucaaagacuccaaggcugugcacgccgauaugggcuacuggauugagagcgagaagaaugagacauggaagcuggcccgcgcuucuuucaucgaagucaagaccuguaucuggcccaaaucccauacacuguggagcaacggcgugcucgagucugagaugauuaucccgaagauucacgggggaccuaucagccaacauaauuaucggcccggcuacuucacccagacagccgggccuuggcaccugggaaaacuugaacuggacuuugaucucugcgagggcaccacgguuguggucgacgaacacugcgggaacagaggacccucccugcggaccacaaccgugacaggcaagauuauccaugagugguguugccgcagcuguacccugccuccccuuagauuccggggcgaggaugggugcugguacggaauggaaaucagaccgguuaaagagaaggaagagaaucucgugaagucuauggucuccgcgggcagcggggaaguggacuccuuuucucugggacugcucuguauuagcaucaugauugaggagguuaugcgcucccgguggucuagaaaaaugcugaugacgggcacacuugcuguguucuuucugcucaucauggggcagcugaccuggaacgaccugauucgccuuugcaucauggucggagccaaugccagcgauagaaugggcaugggcacaaccuaucuggcucucauggccaccuucaagaugcggccuauguuugcgguggggcugcuguuccgcagacugacaucccgggaagugcuucugcucacgauuggacugucucuggucgcuagcguugagcuucccaacucccuggaagaacugggcgacgggcuggccaugggaaucaugauccucaaacugcuuaccgauuuucaaagcuaccagcugugggccacacuccugucucugaccuucauuaagacaaccuuuucccuucacuaugcuuggaaaacgauggccauggugcugagcaucgugucucucuucccccugugucucuccacaaccagccagaagaccacauggcugccuguccuucugggcucucuggggugcaagccgcucaccauguuucugauugcugaaaauaaaaucuggggacgcaaguccuggccccuuaacgagggcauuauggccgugggcaucguuagcauccugcucuccagccugcucaaaaacgacgugccucuggcggggccccuuauugccggaggcaugcugaucgcuuguuacgucauuucugggagcuccgccgaucugucucucgagaaggcugccgaagugagcugggaggaagaggccgaacauuccggagcuucucacaauauccugguugaggugcaggacgauggcacaaugaaaauuaaggacgaggaaagagaugacacgcuuaccauccugcucaaagcgacacugcucgccgucagcgggguguauccucuguccauccccgcuacccuuuucgucuggcauuucuggcaaaagaagaaacagcggucuggagugcugugggauacaccuagcccucccgagguugaacgcgccgugcuggacgauggcauuuacagaaucaugcagcggggccuccuggggcgcucccaggucggagugggcguuuuucaagagaacguguuccacaccauguggcacgucacgagaggggccgugcuuauguaucagggaaagcggcuggagcccagcugggcuucugugaaaaaggaccucauuuccuacggcgggggauggagauuucagggcagcuggaauaccggcgaagagguucaggucaucgccguggaacccgggaaaaacccuaagaaugugcaaacagcgcccggaaccuucaagacaccggagggcgaagucggggcuauugcccuggacuuuaaaccuggaaccucuggcucccccaucgugaaccgcgaggggaagauuguuggacucuacggcaauggcguggucacaacgagcgggaccuauguguccgccaucgcucaggccaaagcgucucaggagggaccucugcccgaaaucgaggaugaaguuuuccggaagagaaaccuuacaauuauggaccugcaucccggcagcgggaaaacccgccgguaccugccugcuaucgugagagaggccauuaagcgcaagcuccggacccugauccuugccccgacaagagucguggcuuccgaaauggccgaggcucugaaaggaaugcccauucgcuaucaaacgaccgccguuaagagcgagcacacaggcaaagaaaucguggaucucaugugccaugcgaccuuuacaaugcggcugcugucuccugucagagugcccaauuacaacaugaucauuauggacgaggcccacuucaccgauccuuccagcaucgcugcccggggguauauuucuacgcgcgugggcaugggagaagcugccgccaucuuuaugacagcuacacccccuggcagcauggaggcguucccgcaguccaaugccgucauucaggacgaagagagagauauccccgagcggucuuggaacagcggguacgaauggaucaccgacuuuccuggaaagacaguuugguucgugcccuccauuaaagcuggcaaugauaucgccaacugucuccgcaagaaugggaagagagugauucagcuuucucggaaaaccuucgacacagaguaucaaaagaccaaaaacaacgauugggacuacgucgugacgacagacaucagcgaaaugggagccaauuuuagagcugaucgcguuauugacccucggagaugccugaagcccgugauccugaaagauggcccggagcgcgucauucucgccgggccuaugcccgugaccguugcguccgcugcccagcggagaggccgcaucggacggaaccauaauaaggagggcgaccaguacaucuauauggggcagccccugaacaaugaugaagaccacgcccacuggacagaggcuaagaugcuucuggauaacauuaauaccccugaaggaaucauucccgcccucuucgagccugaaagagagaaaagcgcggccaucgacggcgaguaccgccugagaggggaagcucggaagacguuuguggagcugaugcgcagaggagaucucccggucuggcuuucuuauaaaguggccuccgaaggcuuccaauacagcgaccggcgcuggugcuuugauggggagagaaacaaucagguccuggaagagaacauggacguggagauuuggaccaaggaaggcgagcggaaaaagcugagaccccgcuggcucgaugcucggacauauuccgacccucuggcccuuagagaguucaaagaguuugcugccggacgccggucuguuagcggcgaccugauccucgaaaucgggaagcugccccagcaucugacccagagagcgcaaaaugcccucgauaaccuugugaugcugcacaauuccgagcagggaggccgggcuuaccgccaugccauggaggaacugccugacacaauugagacccucaugcugcuugcucugaucgccgugcucacagggggagucacccuguucuuucugucuggcaagggccucgggaaaacgagcauuggacuucuguguguuauggccuccagcgugcugcucuggauggcuucuguggaaccccacuggaucgcggccuccauuauccuggaguucuuucuuaugguccugcucaucccggagccugauagacagcggacaccccaggacaaccaacuggcuuaugugguuauuggccuccucuucaugauccuuaccguggccgccaaugaaauggggcugcuggagaccacaaagaaagaucucggaauuggccacgucgcuguggaaaaccaucaccaugccgcgaugcuggacgucgaucuucacccugccagcgcuuggacccuguacgccguggcuacaacgaucauuacccccaugaugcgccauacaaucgagaacaccacagccaauauuucucucaccgcgaucgccaaccaggcugccauccugauggggcuggacaagggauggccuauuuccaaaauggauaucggcguuccccuccuugcucugggcugcuacagccaggugaauccgcugacgcucaccgccgcuguccugaugcuuguggcccacuaugcgauuaucgggccuggacugcaagccaaggcuacaagagaagcccagaagcggaccgcugccggcauuaugaaaaaccccacaaucgacgggaucguugccauugaucucgaccccguggucuacgaugcgaaguuugagaaacagcugggacagaucaugcugcucauucuuuguaccucucaaauccugcugaugcgcacgacaugggcucucugcgagagcauuacccuggccacaggcccucuuaccacccugugggaaggguccccgggaaaguucuggaauacaacgaucgcugugucuauggccaacaucuucagaggcagcuaucucgccggcgcugggcuggccuuuucccugaugaaaagccucggaggcgggcggcgcggaaccggcgcgcagggggagacacuuggagaaaaguggaagagacagcugaaucagcuguccaaaucugaguucaacaccuacaagcggagcggcauuauggaaguggacagauccgaggccaaagagggccucaagcgcggggaaacaaccaaacacgcuguuucucggggaacggccaagcugagaugguuugucgagcgcaaucuugugaagcccgaaggcaaagugaucgaccugggguguggacggggcggguggagcuauuacugcgcuggacucaagaaagucacagagguuaagggcuauaccaaaggcgggccuggacaugaagaacccauuccuauggccaccuacggcuggaaccuggugaagcugcacuccgggaaagauguguucuuuauucccccugagaagugugacacacuccuuugcgauaucggagaaucuagcccgaaucccaccaucgaggaaggcagaacacugcgcguccugaagaugguggagccuuggcuccgggggaaccaauucuguauuaaaauccugaaucccuacaugccuuccguuguggagacgcuugaacagaugcagagaaagcauggaggcaugcugguccgcaacccccucagcagaaauucuacccacgagauguauuggguguccugcggcacagggaacaucguuagcgcgauuaauaugaccucuagaaugcugcugaaccgcuuuacaauggcccaccggaaaccgaccuacgaaagagacguggaucucggagcuggcacgcgccaugucgccguggagccugaaguggcuaaccuggacaucauugggcagagaaucgagaauauuaagcacgagcauaaauccaccuggcacuaugaugaagacaaccccuacaagacaugggccuaucauggaagcuacgaggucaagcccucuggcuccgcuagcuccaugguuaaugggguggugaaacuucugaccaagccuugggaugucauccccauggugacacaaaucgccaugaccgacacaaccccuuucggacagcagcggguuuuuaaagaaaagguggauacgcgcacaccgaaagcgaagagaggcaccgcccaaauuauggaggucaccgcucgguggcucuggggcuuccugagcagaaacaagaaaccccggaucuguacacgcgaagaguuuacgagaaaggugcggucuaaugccgcuauuggggccguuuucguggacgagaaccaguggaauagcgccaaagaagcggucgaggacgaucgcuuuugggaccuugugcacagagaacgggagcugcacaagcagggaaaaugcgcuaccugcguuuauaacaugaugggcaagcgcgaaaagaaacucggggaguucggaaaggccaaaggcuccagagccaucugguacauguggcugggggcucgguuccuggaguuugaagcccucggcuucaugaaugaggaucauugguuuucucgcgaaaacagccuguccggaguggagggcgaggggcuucacaagcugggauacauucucagagacaucucuaaaaucccuggcgggaauauguaugcugaugacacagccggaugggauacccggauuacagaagacgaucugcagaacgaggcgaagaucaccgacauuauggaacccgagcaugcccuucuggcuaaaagcaucuucaagcucacauaccaaaauaaggucgugcgcguccagagaccugccaaaaacggcaccgugauggauguuauuucccggcgcgaccagagagggucuggccaggugggaacguauggccugaauaccuuuacaaacauggaagcucaacugauccggcagauggagagcgaggggaucuuccuccccaacgaacuggagaccccgaaucuugccggaagaguccuggauuggcucgaaaaguacggcguggagcgccugaaacggauggcgauuuccggggacgacugugugguuaagccuaucgaugacagauuugccacagcucuuaccgcccugaacgauaugggaaaagugcgcaaggacauuccccagugggaaccuagcaagggcuggaaugauuggcagcaaguccccuucugcucucaccacuuucaucagcucaucaugaaagacgggcgggagauugugguuccuuguagaaaccaggaugagcuggugggccgcgcucgggucucccagggagccggcuggagccugagagaaacggcuugccucgggaagucuuaugcccaaauguggcagcugauguacuuccaccgccgggaccuuagacuggcggccaaugcuaucuguuccgccgugcccgucgauugggugccgacaagccgcaccacaugguccauucaugcccaccaucaguggaugaccacggaggacaugcucucuguuuggaaccggguguggaucgaagagaauccuuggauggaagauaaaaccagaaucagcuccugggaggacguccccuaucugggaaagcgggaggaccaauggugcggcagccuuauugggcugacagcuagagccaccugggcgacaaacauccagguggcuauuaaucagguucgccggcucaucggaaacgaaaauuacucugauuacaugaccuccaugaaaagauuuaagaacgagagcgaacccgagggcgcccugugguga

SEQ ID NO: 19195 - RNA, 9879 nt, Artificial Sequence
  derived and/or modified CDS sequence (opt5) from DENV-1__GU131750__SS-prME
agcgugaccaugcugcugaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaggaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuugggagccugggaugcaagccgcugacgauguuucucaucgcugagaauaaaauuuggggccggcgcucuuggccccugaacgaaggcaucauggccgucgggaucguguccauucuucugagcucccuccugaagaacgauguuccucucgcgggaccccugaucgccggcgggaugcuuauugcuuguuacgugaucagcggaucuagcgccgaccuguccauugagaaagcugccgaggucucuugggaagaggaagccgagcauagcggcgcuucccacaauauccugguggaaguucaggaugacgggaccaugaagaucaaagaugaggagagagacgauacacucaccauucugcuuaaggcgacacugcucgccgugucuggagucuauccucugagcauccccgcuacccucuucgugugguacuucuggcagaaaaagaagcagcgguccggcguccugugggacacgccuucucccccggaagugggccgcgccguucuugaugacgggauuuauagaaucaugcagcggggacugcugggccgcagccaggugggggucggaguguuucaagagaacguuuuccauaccauguggcacgugacaagaggcgccguccucauguaccaggggaaacggcuggaaccuuccugggcuagcgugaagaaagaccuuauuucuuacggaggcggcuggagacugcagggguccuggaauaccggagaggaggugcagguuaucgccgucgaacccggcaagaacccuaaaaaugugcaaacagcgcccgggaccuuuaagacaccggagggagaagugggcgcuauugcccucgauuucaagccugggacgagcggaucucccaucgucaaccgcgagggcaaaaucgugggccuguaugggaauggaguugugaccacauccggcaccuacgucagcgccauugcucaggccaaggcgucccaggaagggccucuccccgagaucgaggacgaaguguuucggaaaagaaaccugaccauuauggaucuucaccccggaucuggcaagacacgccgguaucugccugcuaucguuagagaggccauuaaacgcaagcugcggacgcucauccuggccccgaccagaguggucgcuagcgaaauggccgaggcucuuaaggggaugcccauccgcuaccaaacaaccgccgugaaauccgaacauacaggcaaggagauuguugaccugaugugccacgcgaccuucacgaugcggcuccugagcccugugagaguccccaauuauaacaugaucauuauggaugaggcccauuuuacagacccuucuuccaucgcugcccggggauacauuagcacccgcgugggcaugggggaagcugccgccaucuucaugaccgcuacacccccuggaucuguggaggcguuuccgcagagcaaugccgucauccaggaugaagagagagacauucccgaacgguccuggaacucuggcuaugaguggaucaccgauuucccugggaaaacaguuugguuugugcccagcauuaaguccggaaaugacaucgcuaacugucugcgcaaaaauggcaagagagugauucagcucucucggaagaccuucgauacggaguaccagaaaaccaagaacaacgacugggacuacgucgugaccacagauaucagcgaaaugggggccaauuucagagccgaccgcguuauugauccucggagaugccuuaaacccgugauccugaaggacggcccggagcgcgucauccuggcuggaccuaugcccgugaccguugccuccgcggcucagcggagaggccgcauugggcggaaccacaauaaagaaggagaucaguauaucuacaugggccagccccucaacaaugacgaggaucaugcccacuggacggaggccaagaugcugcuugacaacauuaauaccccugaagggaucauucccgcucuguuugagccugaaagagaaaagagcgccgcgaucgauggagaauaucgccucagaggcgaggcccggaaaacauucguggagcugaugcgcagaggggaccugccggucuggcucucuuacaagguggcuuccgaaggcuuucaauauagcgaucggcgcuggugcuucgacggagagagaaacaaucagguccuugaagagaacauggauguggaaaucuggaccaaagagggcgagcggaagaaacugagaccccgcuggcuggacgcccggacauacuccgacccucucgcucugagagaauuuaaggaguucgccgcugggcgccggucuguuagcggagaucuuauucuggaaaucggcaaacucccccagcaccugaugcagagagcccaaaaugcgcuggacaaccucgugaugcuucauaauuccgagcaagggggacgggccuaucgccacgcuauggaggaacugccugauaccauugagacacugaugcuccuggcccuuaucgcugugcugaccggcggcgucacgcucuuuuuccugucugggagaggacugggcaagacaagcauugggcuccuuuguguuauggccuccagcgugcugcuguggauggccucuguggaaccccauuggaucgcugcguccaucauucucgaguuuuuccugaugguccuucugaucccggaaccugaccggcagcgcacaccccaggauaaccaacucgccuacgugguuauuggacugcuguuuaugauccucaccguggcugccaaugagaugggccuucuggagacaaccaagaaagaccuggggauuggacacgucgccguggaaaaccaccaucacgcugccaugcucgaugucgaccugcauccugcgagcgccuggacacuuuacgcuguggccacgaccaucauuacacccaugaugagacacaccaucgagaacacaaccgcuaauaucucucugacggccauugcgaaccaggccgcuauccucaugggccuggauaagggcuggccuauuuccaaaauggacaucgggguuccccugcucgcccuuggaugcuauagccaggugaauccgcugacccugacagcugccguccucaugcugguggcucauuacgccauuaucggcccugggcuucaagcgaaggccacccgggaagcucagaaacgcacagccgcuggaaucaugaagaaccccaccguugauggcauuguggccaucgaccuggaucccgucguguaugacgccaaguucgagaaacagcucgggcagauuaugcugcugauccucuguacgucucaaauucuucugaugagaacaaccugggcgcugugcgaaagcaucacacucgcuaccggaccucugaccacacuuugggagggcuccccgggcaaguuuuggaauacgaccaucgccgugucuauggcuaacauuuuccgggggagcuaccuggccggagccggccucgcuuucucccugaugaaaagccucgggggaggccgcagagggacaggagcccagggcgagacccucggcgaaaaguggaaacggcagcuuaaucagcuguccaagucugaguuuaacacauauaagagaagcgggaucauggaaguugaccgcuccgaggcgaaagaaggacugaagcggggcgagaccacgaaacacgccgucucuagagggacagcuaagcuccgcugguucguggagcggaaucuggugaaacccgaaggaaaggucauugaucuuggcugugggagaggaggcuggagcuacuauugcgccggccugaagaaaguuaccgaggugaagggguacaccaaaggaggcccugggcacgaggagcccaucccuauggcuacauacggauggaaccucgugaagcugcauuccggcaaagacgucuuuuucauucccccugaaaagugugauacccugcucugcgacaucggggagucuagcccgaaucccacaauugaggaaggacgcacgcuucgggugcugaaaaugguugagccuuggcugagaggcaaccaauuuuguaucaagauccucaaucccuauaugccuuccguggucgaaacccuggagcagaugcagcgcaagcacggcgggaugcuugugcggaacccccugagcagaaauucuacacaugagauguacuggguuuccugcggaaccggcaacauugugagcgccgucaauaugacaucucgcaugcuccugaaccgguucaccauggcgcacagaaaaccgacguaugaacgcgauguggaccugggggccggaaccagacacguggcugucgagccugaaguugccaaccucgauaucauuggccagcggaucgagaauauuaagcaugaacacaaauccacauggcauuacgacgaggauaaccccuauaagaccugggcuuaccacgggagcuaugaggugaaacccucuggauccgccagcuccauggugaauggcgucgugaagcugcuuacaaagccuugggacguuauccccauggugacccaaaucgcuaugacagauaccacgccuuuuggccagcagcgcgucuucaaagaaaagguggacacaagaaccccgaaagccaagcgggggaccgcgcaaauuauggagguuacagccaaauggcuguggggauuucucagcagaaacaagaagccccggaucuguacgcgcgaagaguucaccagaaaagugcggucuaaugcugccauuggcgcugucuuuguggacgaaaaccaguggaauagcgccaaggaggccguugaggaugaacgcuucugggaccuggugcauagagagcgggaacuucacaaacaggggaagugcgcgacaugcgucuacaacaugaugggaaaacgcgagaagaagcugggcgaauuugggaaagcuaagggcuccagagccaucugguacauguggcucggagcccgguuccuggaguucgaggcucugggcuuuaugaaugaagaucacugguucucucgcgagaacagccucuccgggguggaaggagagggccugcauaaacuuggguauauucugagagacaucucuaagaucccuggaggcaauauguacgccgaugacaccgcugggugggauacacggauuaccgaggacgaucuccagaacgaagcccgcaucacagacaccauggagcccgaacacgcgcugcuugccaaaagcauuuuuaagcugacguaucaaaauaaagucgugagaguucagcggccugcuaagaacggcaccgugauggaugucaucucccgcagagaccagcggggaucuggccagguggggacauacggacucaauaccuucacaaacauggaggcccaacugauuagacagauggaaagcgagggcaucuuuucccccagcgagcuggaaaccccgaaccucgcugagcgcgugcuggauuggcuugaaaaguaugggguugagcggcugaaaagaauggccaucucuggagacgacuguguggucaagccuauugaugaccgcuucgcgacggcccucacagcucugaaugauaugggcaaagugcggaaggacaucccccagugggaaccuuccaaaggguggaacgauuggcagcaaguucccuuuugcagccaucacuuccaccagcuuauuaugaaggacggcagagagaucguggucccuugucgcaaucaggaugagcuggugggacgggccagagucucucagggcgcuggguggucccuccgcgaaaccgccugccugggaaagagcuacgcucaaauguggcagcugauguauuuucaucggagagaccuccgccuggccgcgaacgccauuuguuccgcugugcccguugauuggaucccgacaucucggaccacguggagcauucacgcccaucaccaguggaugaccacagaggacaugcuuuccguguggaauagagucuggaucgaagagaacccuuggauggaagauaaaacccauaucagcucuuggggcgacgugcccuaccuggggaagcgggaggaccaauggugcggaucccucauuggccugacagccagagcuaccugggccacaaauauccagguugcgauuaaccaggugcgccggcuuaucgggaaugagaacuaccuggauuauaugaccagcaugaaaagauucaagaaugaaucugaccccgagggcgcucucugguga

SEQ ID NO: 19196 - RNA, 9879 nt, Artificial Sequence
  derived and/or modified CDS sequence (opt5) from DENV-1__GU131751__SS-prME
agcgugaccaugcugcugaugcugaugcccaccgcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaagugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaagcagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccauugcuacaaucacaccccaggccccuucuacggagauucagcugaccgacuacggcgcccucacacuggauuguagcccccggaccggccuggacuuuaacgaaauggugcuccugacaaugaaggagaaaagcuggcuuguccauaagcagugguuccuggaucucccucugcccuggaccuccggggcuucuacgagccaagagacauggaaucgccaggaccuucuggugaccuuuaaaacagcgcacgccaagaagcaggaagucgugguucucggaucccaagagggcgcuaugcacaccgcccugaccggggccacagaaauccagacgagcggaaccacaaccauuuucgcuggccaucugaaaugcagacucaagauggauaaacugacacuuaaggggaugucuuaugugauguguaccggcuccuucaaacuggagaaggaagucgccgagacgcagcacggaacagugcucguucagaucaaguacgagggcaccgacgcgccgugcaaaaucccuuuuagcacccaagaugaaaagggggugacacagaacggacggcugauuaccgcuaaucccaucgucacagacaaagagaagccugugaacauugaagccgagccgcccuucggcgagucuuauaucgugauuggggccggagaaaaagcucugaaacuuagcugguuuaagaaaggcuccucuaucgggaagauguucgaggccacggcuagaggcgcccgccggauggcgauccucggagauaccgccugggacuuuggcagcauugggggaguuuucacauccgucggcaaacuggugcaucagaucuuugggaccgcuuacggagugcuguucagcggcgucucuuggacaaugaagauugggaucggcgugcuccugaccuggcuuggacucaauuccagaagcacgucucucuccaugaccuguauugccguuggccuggugacacuguaccuuggggucauggugcaggcugauagcggaugcguuaucaacuggaaaggccgcgaacucaaguguggguccggaauuuuugugaccaaugagguccacacauggaccgaacaauauaaguuccaggccgacucuccuaaacggcugagcgcggccaucggcaaggcuugggaggagggggugugcggcaucagauccgccacacgccuggaaaacauuauguggaaacagaucucuaacgagcucaaucauauucugcuugaaaacgacaugaaguuuaccguuguggucggagauguggcuggcauccuggcccaggggaaaaaggugauucggccgcaacccauggagcacaaauacagcuggaaguccuggggaaaggccaaaaucaucggcgcugacguccagaauacgacauucauuaucgaugggccuaacacccccgaauguccugacgaucagagagcguggaauauuugggagguugaggacuauggauuuggcaucuucaccacaaacauuuggcucaagcugcgcgauagcuacacccaggugugcgaccaccggcugaugucugccgcuaucagagauuccaaagccgugcaugccgacaugggcuauuggaucgaaagcgagaagaaugaaacguggaaacuugcucgcgccucuuucauugaggucaagacauguaucuggcccaagucccacacccucuggagcaacggggugcuggaaucugagaugauuaucccgaaaauuuacggaggcccuaucagccaacauaauuaucggcccggguacuuuacacagaccgcgggaccuuggcaccugggcaagcucgagcuggauuucgaccuuugcgaagggacaaccguuguggucgaugagcacugcggaaacagaggccccucccugcggacgaccacagugaccggcaaaaucauucaugaaugguguugccgcagcuguacacucccuccccugagauuuaagggggaggacggaugcugguacggcauggagauccggccgguuaaagaaaaggaggaaaaucuggugaagucuauggucuccgcugggagcggagagguggacuccuucucucuuggccuccuguguauuagcaucaugauugaagagguuaugagauccaaauggucucgcaagaugcugaugaccgggacgcucgccguguuuuuccugcuuaucaugggacagcugacauggaacgaucucauucggcugugcaucauggucggcgccaaugcuagcgacagaaugggcauggggaccacauaucuggcccuuauggcgaccuuuaaaaugcgcccuauguucgcugugggacugcucuuuagacggcugaccucccgcgaggugcuccugcuuacaaucggccugucucucgucgccagcguugaacugcccaacucccuggaggaacuuggggauggacuggccaugggcauuaugauccucaagcugcucacggacuuccaaagccaccagcugugggcuacccuucugucucucacauuuauuaaaaccacauucucccugcauuacgccuggaagaccauggcuauggugcugagcaucgugucucuuuuuccccugugucucuccacgacaagccagaagaccaccuggcugccuguccuccuggggucucuuggaugcaaaccgcugacaauguuccugauugccgagaauaagaucuggggcagaaaauccuggccccucaacgaaggcaucauggcgguggggauuguuagcauccugcuuuccagccugcucaagaacgaugugccucuggccggaccccucauugcuggcgggaugcugaucgccuguuaugucauuucuggaagcuccgcugaccuuucucuggagaaagccgccgaggugagcugggaagaggaagcugagcacuccggcgcgucucauaauauccugguugaagugcaggaugacgggaccaugaagaucaaagaugaggagcgggacgauacacucacgauucugcuuaaggccacccugcucgcugucagcggaguguacccucuguccauccccgccacacucuucgucugguauuuuuggcaaaagaaaaagcagcgcucuggcgugcugugggacauuccuuccccucccgaaguugagagagccgugcuugaugacggcaucuaccggauuaugcagcgcgggcugcugggaagaucccaggucggcguggggguuuuccaagaaaacguguuucacaccauguggcacgucacacggggagcugugcucauguaucagggcaaacgccuggagcccagcugggccucugugaagaaagaccuuaucuccuacgggggaggcuggagacugcagggcagcuggaauaccggggaggaaguucaggucauugcgguggagcccggaaagaacccuaagaaugugcaaacggcucccggcaccuucaaaacaucugaaggggaggucggagccaucgcccucgauuuuaagccgggcaccuccgggagcccuaucgugaaccgggaaggaaaaauuguuggccuguacggcaaugggguggucacaaccuccggaacauaugugucugcuaucgcccaggcgaaggcuagccaggagggcccccucccugagauugaagacgagguuuucaaaaagagaaaccugacgaucauggaucuucaucccggguccggaaagacccgccgguaccugcccgccauugugagagaagccaucaaacgcaagcugcggacacucauccuggcuccuaccagagucguggccagcgagauggcugaagcccuuaaaggcaugccgauucgcuaucaaaccacagcgguuaagucugagcacacggggaaagagaucguggaccugaugugccaugccaccuuuacaaugcggcuccugucccccgucagagugccuaauuacaacaugauuaucauggaugaagcucacuucaccgaccccagcucuauugccgcucgcggcuauaucagcacacgggugggaaugggcgaggccgccgcuaucuuuaugaccgcgacgccucccggguccgucgaagccuucccucagucuaaugcuguuauucaggaugaggaaagagacaucccggagcggagcuggaacuccggauacgaguggauuacagauuuucccggcaagaccgugugguucgugccuucuaucaagagcgggaaugacauugccaacugucugcgcaaaaauggaaagagagucauccagcucucccggaaaaccuucgauacagaauaucaaaagaccaaaaacaacgacugggacuacgugguuacaaccgauauuagcgagaugggcgccaauuuucgcgcugacagagugaucgauccccggagaugccuuaagccugucauccugaaggacgggcccgaacgcgugauucuggccggcccgaugccuguuacgguggcgucugcugcccagcggagaggacgcaucggccggaaccauaauaaagagggggaucaguacauuuauaugggacagccccucaacaaugacgaggaucacgcccacuggacagaagcuaagaugcugcuugacaacaucaauacccccgagggcauuaucccugcccuguucgaacccgagagagaaaaauccgcggccaucgauggggaguaccgccuccggggagaggcuagaaagacauuugucgaacugaugcgcagaggcgaccugccuguguggcucagcuauaaagucgccuccgagggguuccaauacucugaucggcgcuggugcuuugacggcgaaagaaacaaucaggugcuugaggaaaacauggauguugagauuuggaccaaggagggagaacggaaaaagcugcgcccgagauggcuggacgcucggacguauagcgacccccucgcccugagagaguucaaggaauuugcugccggccgccgguccgugucuggggaucuuauccuggagauuggaaaacucccucagcaucugacccagagagcgcaaaaugcccuggacaaccucgugaugcuucacaauagcgaacagggcgggcgcgcuuaccggcaugccauggaggagcugcccgauacaaucgaaacccugaugcuccuggcucuuauugccguccugacaggaggcguuacccucuucuuucuguccggcagagggcugggaaagacaagcaucggccuccuuugugugauggccucuuccgugcugcuguggauggcuagcgucgagccucacuggaucgcggccucuauuauccucgaguucuuucugauggugcuucugauucccgagccggaccggcagcgcaccccucaggauaaccaacucgcuuauguugugaucgggcugcuguucaugauucucacggucgccgccaaugagaugggacuucuggaaacaaccaaaaaggaccugggcaucgggcacguggcugucgagaaccaucaccaugccgcgaugcucgauguggaccugcaccccgccuccgcuuggacccuuuacgccguugcuacaaccauuaucacaccuaugaugagacauacgaucgaaaacaccacagccaauauuagccugaccgcgaucgccaaccaggcugccauucucaugggacuggauaaaggcuggcccaucucuaagauggacauuggcgugccucugcucgcucuugggugcuacagccaggucaauccccugacacugaccgccacggugcucaugcugguugcucacuaugccaucaucggaccgggccuucaagcgaaggccacccgggaggcucagaaacgcacagccgcugggauuaugaagaacccuaccguggauggaaucgucgccauugaccuggaucccgugguguacgacgccaaauuugaaaagcagcucggccagaucaugcugcugauucucuguacaucccaaauccuucugaugagaaccacgugggcgcugugcgagucuaucacacucgcuaccgggccccugacaacccuuugggagggaagcccuggcaaauucuggaauaccacaauugccguuuccauggcuaacaucuuccggggcagcuaucuggccggggccggacucgcuuuuucccugaugaagucucugggcgggggacgcagaggcacgggggcccagggagaaacccucggcgagaaguggaaacggcagcuuaaucagcugagcaaguccgaguucaacacauacaaacgcucuggcauuauggaggucgacagaagcgaagcgaaggaggggcugaaacggggagagaccacaaagcacgccguguccagaggcaccgcuaagcuccgcugguuuguggaacggaaucuggucaaaccggaggggaagguuaucgaucuuggauguggcagagggggauggucuuauuacugcgccggccugaaaaaggugacggaagugaaaggcuauacaaaagggggacccggccaugaggaaccuauucccauggcuaccuacggguggaaccucgucaaacugcacagcggaaaggacguguucuuuaucccucccgagaagugugauacccugcucugcgacauuggcgaguccagcccuaauccgacaaucgaagaggggcgcacccuucggguucugaaaaugguggaacccuggcugagaggaaaccaauucuguaucaagauucucaauccuuacaugcccucugucguggagacacuggagcagaugcagcgcaaacauggcggcaugcuuguucggaacccucuguccagaaauagcacgcacgaaauguauugggugucuugcgggaccggaaacaucgucuccgccgugaauaugacaagccgcaugcuccugaaccgguuuaccauggcgcacagaaagcccacauacgagcgcgauguggaccugggcgccgggacccggcaugucgcuguugaaccggagguggccaaccucgauauuaucggacagagaauugaaaauaucaaacacgagcauaagucuacguggcacuaugacgaggauaacccuuacaagaccugggcuuaucauggcuccuacgaagugaaacccagcggguccgccagcucuauggucaauggagugguuaagcugcuuacaaaacccugggacgugaucccuauggucacccaaauugcuaugacagauaccacacccuucggccagcagcgcguguuuaaggagaaaguugacaccagaacgccuaaggccaagcggggcacagcgcaaaucauggaagugaccgccaaauggcuguggggguuccucagccgcaacaagaaaccgagaauuuguacccgggaggaauuuacaagaaagguccgguccaaugcugccaucggagcuguguucguugacgagaaccaguggaacucugccaaagaggccguggaagaugagcgcuuuugggaccugguccacagagaacgggagcuucacaagcagggcaagugcgcgacgugcguguauaacaugauggggaaacgcgaaaagaaacugggagaguucggcaaggcuaaagggagcagagccauuugguacauguggcucggcgcccgguuccuggaguuugaagcucugggauucaugaaugaggaucauugguuuucccgcgaaaacucucucagcggcgucgagggggagggacugcacaaacuuggcuacauccugagagacaucuccaaaauucccgggggaaauauguaugccgaugacaccgcuggcugggauacacggaucaccgaagacgaucuccagaacgaggccaagauuacagacaucauggaaccugagcaugcgcugcuugccaagucuauuuucaaacugaccuaccaaaauaaggugguucgcgugcagagacccgcuaaaaacgggacagucauggaugugaucagccggcgcgaccagagaggcuccggacaggugggcaccuaugggcucaauacguuuaccaacauggaagcccaacugauccggcagauggagagcgagggaauuuucucuccuuccgaacuggagacacccaaccucgcuggccgcguucuggauuggcuugaaaaguacgggguggagagacugaaacggauggccaucagcggagacgacugugucgugaagccgauugaugacagauuugcgaccgcccucacagcucugaaugauaugggcaagguucgcaaagacaucccucagugggaacccucuaagggguggaacgauuggcagcaagugccuuucugcucccaccacuuucaucagcuuauuaugaaagacggccgggagaucgucgugcccuguagaaaucaggaugagcuggucggacgcgcccgggugagccagggcgcuggguggucccucagagaaaccgccugccugggaaagucuuaugcucaaauguggcagcugauguacuuccaccgccgggaccucagacuggccgcgaacgccauuuguagcgcuguuccuguggauuggguccccacgucccgcacaaccuggagcauccaugcccaccaucaguggaugacaaccgaggacaugcuuucuguguggaaucggguuuggaucgaagagaacccguggauggaagauaaaacgcacauuuccagcuggggcgacgugccuuaucuggggaagagagaggaccaauggugcggaucucucaucggccugaccgcccgcgcuacaugggccaccaauauucaggucgcgaucaaccaggugcggagacuuauugggaaugagaacuaccuggauuacaugacaagcaugaagcgguuuaaaaaugaauccgaccccgagggcgcucucugguga

SEQ ID NO: 19197 - RNA, 9879 nt, Artificial Sequence
  derived and/or modified CDS sequence (opt5) from DENV-1__GU131753__SS-prME
agcgugaccaugcugcucaugcugaugcccacagcccuugcuuuccaccugacgaccagaggcggggaaccucauaugaucgugacaaagcaggaacggggaaaaucccuccuguuuaagaccucugccggcguuaacaugugcacacuuauugccauggaccugggggagcucugugaagauaccaugacauacaaaugcccccgcaucaccgaggcugaacccgacgauguggacuguuggugcaaugccacggauaccugggugacauauggaaccuguagccaaacaggcgagcacagacgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaccgcccuuuuucuggcgcaugccaucgggaccuccauuacacagaagggaaucaucuucauucuccugaugcuugucacgccuucuauggcuaugagaugcgugggcaucgggagccgggauuuuguugagggacuguccggcgccaccuggguggacgucgugcucgagcacgggagcugugugacaaccauggcuaaggauaaacccacacuggacauugaacugcucaagaccgaggucacgaacccugccguucugcgcaaacuuugcaucgaagcgaagauuucuaauacaaccaccgauuccagauguccgacacaaggagaggccacccugauggaagaacaagacgcuaacuucgugugccggcgcacauuuguggauagaggcuggggcaauggguguggacucuucggcaaagggagccugaucacgugcgccaaguuuaagugcgucaccaaacuugagggaaagauugugcaguacgaaaaccugaaauauucuguuaucgugacaguccacaccggcgaccagcaucaaguggggaaugaguccacagaacacggaaccacggcuaccaucacaccccaggccccuaccagcgagauucagcucacagacuacggcgcccugacccuggauuguucuccccggacgggccucgacuucaacgaaaugguucugcuuacaaugaaggagaaauccuggcuggugcauaagcagugguuucucgaucugccucuucccuggaccagcggggcuuccacaucucaagagaccuggaaucgccaggaccugcucgucaccuucaaaacagcgcacgccaagaagcaggaaguggucgugcugggaagccaagagggcgcuaugcacacggcccugaccggggccacagaaauccagaccuccggaacaaccacgauuuuugcuggccaucucaaaugcagacugaagauggauaaacuuacacugaaggggaugagcuauguuauguguaccggcucuuucaaacucgagaaggaaguggccgagacccagcacggaacaguccuggugcagaucaaguacgagggcaccgacgcgccgugcaaaauuccuuucuccacacaagaugaaaaggggguuacgcagaacggacggcugaucaccgcuaaucccaucauuacagacaaagagaagccugugaacaucgaagccgagccgcccuuuggcgagagcuauauugucaucggggccggagaaaaagcucuuaagcucucuugguucaagaaaggcagcuccauugggaagauguuugaggccaccgcuagaggcgcccgccggauggcgauccugggagauacagccugggacuucggcucuaucgggggaguguuuaccagcauuggcaaacuggugcaucagaucuucgggacggcuuacggaguucucuuuuccggcgucagcuggaccaugaagauugggaucggcgugcugcuuacauggcugggacucaauucuagauccaccagccugucuaugacauguauugccgugggccuggucacccuuuaccucggggugaugguucaggcugauuccggaugcgugaucaacuggaaaggccgcgaacugaagugugggagcggaauuuucgucacaaaugaggugcacaccuggacggaacaauauaaguuucaggccgacuccccuaaacggcugucugcggccaucggcaaggcuugggaggaggggguuugcggcaucagaagcgccacacgccucgaaaacauuauguggaaacagaucuccaacgagcugaaucauauucuucuggaaaacgacaugaaguucaccguggucgugggagauguugugggcauccucgcucaggggaaaaagaugauucggccgcaacccauggagcacaaauacucuuggaaaagcuggggaaaggccaagaucaucggcgccgacguccagaauaccacauuuauuaucgaugggccuaacacccccgaauguccugacgaucagagagcuuggaauauuugggagguggaggacuauggauucggcaucuuuacgacaaacauuuggcugaagaugcgcgauuccuacacccaggugugcgaccaccggcugaugagcgcggccaucaaagauucuaaggcuguccaugccgacaugggcuauuggaucgaauccgagaaaaaugaaacauggaaacuugccagagcuagcuucauugagguuaagaccuguaucuggcccaaaucucacacacucugguccaacggggugcuggaaagcgagaugauuaucccgaagauuuacggaggcccuaucucucaacauaauuaucgccccggguacuucacccagacggccggaccuuggcaccugggcaaacucgagcuggauuuugaccuuugcgaagggaccacaguggucguggaugagcacugcggaaaccggggccccagccugagaaccacaaccguuacgggcaagaucauucaugaaugguguugccgguccuguacacucccuccccugcgcuucaaaggggaggacggaugcugguacggcauggagaucagaccggugaaggaaaaggaggaaaaucuggucaaaagcauggugucugcgggguccggagagguugacagcuuuucccuuggccuccuguguauuucuaucaugauugaagaggugaugcggagcagauggucccgcaagaugcugaugaccgggacacucgcugucuuccugcuucugaucaugggacagcucaccuggaacgaucugauucggcugugcaucauggugggcgccaaugccucugacagaaugggcauggggaccacauaucuugcucugauggccacguuuaaaaugcgcccuauguucgcgguuggacuccuguuuagacggcucaccagccgcgaggugcugcuucugacaaucggccucucccuggucgcuucuguggaacugcccaacagccuugaggaacugggggauggacucgccaugggcauuaugauccugaagcuccugaccgacuuccaaucccaccagcuuugggccacacugcucagccugaccuuuauuaaaacgacacugucucuucauuacgcuuggaagaccauggccauggugcuguccaucgucagccucauuccccugugucucucuaccacaucccagaagaccacauggcugccuguucuucuggggagccugggaugcaaaccgcucacgauguuccugaucgcugagaauaagaucuggggcagaaaaucuuggccccuuaacgaaggcauuauggccguggggguggucuccauccugcucagcucccugcucaagaacgaugugccucuggcgggaccccuuauugccggcgggaugcugaucgcuuguuauguuauuagcggaucuagcgccgaccugucccucgagaaagcugccgaggugucuugggaagaggaagccgagcacagcggcgcuucccauaauauccuggucgaagugcaggaugacgggaccaugaagaucaaagaugaggagcgggacgauacacuuaccauucugcucaaggcgacacugcucgccguuucuggaguguacccucugagcauccccgcuacccuuuuugucugguauuucuggcaaaagaaaaagcagcgcuccggcgugcugugggacacgccuucucccccggaagucgagagagccgugcuggaugacggcauuuaccggaucaugcagcgcgggcuccugggaagaagccagguuggcgugggggucuuucaagaaaacguguuccacaccauguggcacguuacacggggagccgugcuuauguaucagggcaaacgccuggagccuuccugggcuagcgucaagaaagaccucauuucuuacgggggaggcuggagacugcagggcuccuggaauaccggggaggaaguccaggugaucgccguugagcccggaaagaacccuaagaauguccaaacagcgcccggcaccuucaaaacaccggaaggggaggugggagcuauugcccucgauuuuaagccuggcacgagcgggucucccaucgugaaccgggaaggaaaaaucgucggccuguacggcaauggggugguuaccacauccggaaccuaugugagcgccauugcucaggccaaggcgucccaggagggcccucuucccgagaucgaagacgaggucuucagaaaacgcaaccugaccauuauggaucugcaucccgggucuggaaagacacggagauaccucccugcuaucgugcgcgaagccaugaagcggaaacugagaacgcuuauucuggccccgacccgcguuguggcuagcgagauggccgaagcucucaagggcaugcccauccgguaucaaacaaccgccgucaaauccgagcacacagggaaggagaucguggaccugaugugccaugcgaccuuuacgaugagacugcucagcccuguucgcgugcccaauuacaacaugauuaucauggaugaagcccacuucacagacccuucuuccauugcugcccggggcuauaucagcaccagagucggaaugggcgaggcugccgccauuuuuaugaccgcuacacccccugggucuguggaagcguucccgcagagcaaugccgugauccaggaugaggaacgggacauccccgagcgcuccuggaacucuggauacgaguggauuaccgauuuuccuggcaaaacagucugguucguucccagcaucaaguccgggaaugacauugcuaacugucuuagaaagaauggaaaacgggugauccagcugucucgcaagaccuuugauacggaauaucagaagacaaagaacaacgacugggacuacguggucaccacagauauuagcgagaugggcgccaauuucagagccgaccgggugaucgauccuagacgcugccugaaacccguuauucucaaggacgggccggaacgggugauccuggcuggcccuaugcccgucaccguggccuccgcggcucagagacgcggacggaucggcagaaaccauaauaaggagggggaucaguacauuuauaugggacagccccuuaacaaugacgaggaucacgcccacuggacggaagccaaaaugcugcucgacaacaucaauaccccugagggcauuauccccgcucuguuugaaccugagcgcgaaaagagcgccgcgauugauggggaguaccggcugagaggagaggcccgcaaaacauucguugaacucaugagacggggcgaccuuccgguguggcugucuuauaaggucgcuuccgagggguuccaauacagcgaucgcagauggugcuuugacggcgaacggaacaaucaggugcuggaggaaaacauggaugucgagaucuggaccaaagagggagaacgcaagaaacucagaccccgguggcuggacgccagaacauauuccgacccucuugcucugcgcgaguucaaggaauuugccgcuggccggagaucugugagcggggaucucauccuggagauuggaaagcugccccagcaucucacccagcgcgcccaaaaugcgcuugacaaccugguuaugcugcacaauuccgaacagggcgggcgggccuacagacaugcuauggaggagcucccugauacaaucgaaacccugaugcuucuggcccucauugcugugcugacgggaggcgugacacuguucuuucucucuggccgggggcuuggaaaaaccagcaucggccugcugugugucaccgccuccagcguucuccuguggauggccucuguggagccccacuggauugcugcguccaucauccuugaguucuuucugauggugcuccugauuccggagccugaccgccagagaacaccccaggauaaccaacuggccuaugucgugaucgggcuccuuuucaugauucugaccguugcugccaaugagaugggacugcucgaaacaacgaagaaagaccugggcaucgggcacguggccgucgagaaccaucaccaugcuaccaugcuugauguggaccugcacccugccagcgcguggacacucuacgccgucgcuaccacaauuaucacccccaugaugcggcauacgauugaaaacaccacagccaauaucucucugaccgcuaucgccaaccaggcggccauucugaugggacucgauaagggcuggccuaucuccaaaauggacauuggcgugccccuucuggcucuggggugcuacagccagguuaauccgcucacacugaccgccgcugugcuuaugcuggucgcccacuaugcuaucauuggaccuggccuccaagccaaggcgacgcgcgaggcccagaagagaacagcugccgggaucaugaaaaaccccaccguggauggaaucguugcuauugaccuggaucccguggucuacgacgccaaguuugaaaaacagcugggccagaucaugcuccuuauucuguguacaucucaaauccugcucaugcggaccaccugggcccugugcgagagcauuacacuugcgacggggccucugaccacacucugggagggauccccgggcaaguucuggaauaccacaaucgcugugucuauggccaacaucuuucgcggcagcuaucuggcuggggccggacuggccuucucccucaugaaaagccuuggcgggggaagacggggcaccggggcucagggagaaacgcugggcgagaaguggaagcgccagcugaaucagcucuccaaaucugaauuuaacauuuacaagagaagcggcaucauggagguggaccgguccgaagccaaagaggggcugaagagaggagagacaaccaaacacgcgguuucucgcggcaccgccaaacuucggugguucgucgaaagaaaucuggugaagcccgaggggaaagugauugaucucggauguggccgcgggggauggagcuauuacugcgcuggccugaagaaagucacagaaguuaagggcuauaccaaagggggaccuggccaugaggaacccaucccuauggccacauacggguggaaccuggugaagcuccacuccggaaaagacguguucuuuacgcccccugagaagugugauacccuucugugcgacauuggcgagucuagcccgaaucccacaaucgaagaggggcggacccugagaguccucaagaugguggaaccuuggcugcgcggaaaccaauucuguauuaaaauccuuaaucccuacaugccuuccguuguggagacacuggagcagaugcagcggaagcauggcggcaugcucgucagaaacccccugagccgcaauucuacccacgaaauguauuggguguccugcgggacgggaaacaucguuagcgcugugaauaugaccucucggaugcugcucaacagauuuacaauggcccaccgcaaaccgaccuacgagaaggaugucgaccugggcgcggggacacggcauguggccguggaaccugaggucgcuaaccuugauauuaucggacagagaauugaaaauaucaaacacgagcauaaguccaccuggcacuaugacgaggauaaccccuacaagacaugggccuaucauggcagcuacgaaguuaaacccucuggguccgcuagcuccauggugaauggaguggucaagcugcucaccaaaccuugggacgugauucccaugguuacgcaaaucgccaugacagauaccaccccuuucggccagcagcgcguguuuaaggagaaagucgacacaagaacgccgaaggcuaagcggggcaccgugcaaaucauggaaguuacagcccgcuggcuguggggguuccuuagcagaaacaaaaagccccggauuuguaccagagaggaauuuacacggaaagugcgcucuaaugcggccaucggagcugucuucguggacgagaaccaguggaauagcgccaaggaggcuguugaagaugagagauuuugggaccuggugaaaaaggaacgggagcuccacaagcagggcaaaugcgcgaccugcgucuauaacaugauggggaagcgcgagaagaagcugggagaguucggcaaagccaagggguccagagcgauuugguacauguggcugggcgcucgguuucucgaguucgaagcccugggauuuaugaaugaggaucacugguucucucgcgaaaacagccuuuccggcguggagggggagggacugcauaaacucggcuacauccugagagacauuucuaagaucccugggggaaauauguaugccgaugacacagcuggcugggauacccggaucacggaagacgaucuucagaacgaggccaagauuaccgacaucauggaacccgagcacgcucugcucgccacaagcauuuucaaacugaccuaccaaaauaaggucgugcgcguucagagaccugcgaaaaacgggacagugauggaugucaucucccggcgcgaccagagaggcucuggacaggugggcaccuaugggcugaauacguuuacaaacauggaagcccaacucauucggcagauggagagcgagggaaucuuccugcccuccgaacuugagaccccgaaccuggcugaacgcguguuugauuggcucgagaaguacggcguugaaagacugaaacggauggccaucagcggggacgacuguguggucaagccuauugaugacagauucgcuacagcccuuaccgcgcugaaugauaugggaaaggugcgcaaagacaucccccagugggagccuucuaagggcuggaacgauuggcagcaaguucccuuuugcucccaucacuuccaccagcucauuaugaaagacgggcgggagaucguggucccuuguagaaaucaggaugaacuggugggccgcgcccgggucagccagggagcuggcuggucucugagagagacggccugccucgggaaguccuaugcucaaauguggcagcugauguacuuucaucgccgggaccuuagacuggccgcuaacgccauuuguagcgcggugcccguugauugggugccgaccucccgcacaaccuggucuauccacgcccaucaccaguggaugacaaccgaagacaugcucagcgucuggaaucggguguggauugaggaaaacccuuggauggaggauaaaacacauguuuccagcuggggagacgugcccuaucugggcaagagagaggaccaauggugcgggucucuuaucggacugaccgcucgcgccacgugggccuccaauauccaggucgcuauuaaccaggugcggagacucaucggcaaugaaaacuaccuggauuacaugacaagcaugaagcgguucaaaaaugagggggaccccgaaggcgcccugugguga

SEQ ID NO: 19198 - RNA, 9879 nt, Artificial Sequence
  derived and/or modified CDS sequence (opt5) from DENV-1__GU131754__SS-prME
agcgugaccaugcugcugaugcugaugcccacggcccuugcuuuccaccugacgaccagaggcggggagccucauaugaucgucuccaagcaggaacggggaaagucucuccuguuuaagacaagcgccggcguuaauaugugcacccuuauugcgauggaccugggggaguucugugaagauacaaugaccuacaagugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagauaagccugugaacaucgaggccgaaccgcccuucggcgagucuuauauugugaucggggccggagagaaagcucugaaacuuagcugguuuaagaaaggcuccucuauugggaagauguucgaagccaccgcuagaggcgcccgccggauggcgauccucggagacacagccugggauuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugacagcggaugcguugugaacuggaaaggccgcgagcucaaguguggguccggaauuuuugucacaaaugaagugcacaccuggacagagcaauauaaguuccaggccgacucuccuaaacggcugagcgcggccaucggcaaggcuugggaagaggggguuugcggcauuagauccgccacccgccuggagaacaucauguggaaacagaucucuaacgaacucaaucauauucugcuugagaacgauaugaaguuuacgguggucgugggagacguggcuggcauccuggcccaggggaaaaagaugauucggccgcaacccauggaauacaaauauagcuggaaguccuggggaaaggccaaaaucauuggcgcugauguccagaauacaaccuucaucaucgacgggccuaacacccccgaguguccugaugaccagagagcguggaauauuugggaaguugaggauuacggauuuggcaucuucacaaccaacauuuggcucaagcugcgcgacagcuauacacaggugugcgaucaccggcugaugucugccgcuaucaaagacuccaaggccgugcacgccgauaugggcuacuggauugagagcgagaagaaugagacauggaaacuugcuagagccucuuucaucgaagucaagaccuguaucuggcccaaaucccauacacucuggagcaacggggugcuggagucugaaaugauuaucccgaagauuuauggaggcccuaucagccaacacaauuaccgccccggguacuuuacccagacagcgggaccuuggcaucugggcaaacucgagcuggacuucgaucuuugcgaggggaccacgguuguggucgacgaacacugcggaaaccggggccccucccugagaaccacaaccgugacaggcaagauuauccacgagugguguugccggagcuguacccucccuccccugcgcuuuaaaggggaagacggaugcugguauggcauggagaucagaccgguuaaggagaaggaagagaaucuggugaaaucuauggucuccgcugggagcggagaaguggauuccuucucucuuggccuccuguguauuagcaucaugauugaggaaguuaugcgguccagauggucucgcaagaugcugaugacggggacacucgccguguuuuuccugcuuaucaugggacagcugaccuggaacgaccucauucggcugugcaucauggucggcgccaaugcuagcgauagaaugggcauggggacaaccuaccuggcccuuauggcgaccuuuaaaaugcgcccuauguucgcugugggacugcucuuuagacggcugacaucccgcgaggugcuccugcuuacgauuggccugucucucgucgccagcguugagcugcccaacucccuggaagaacuuggggacggacuggccaugggcaucaugauccucaagcugcucaccgauuuccaaagccaucagcugugggcuacacuucugucucucaccuuuauuaaaacaaccuucucccugcacuaugccuggaagacgauggcuauggugcugagcaucgugucucuuuuuccccuguguauguccacaaccagccagaagaccacauggcucccuguccugcucgggucucugggaugcaaaccgcuuaccauguuccugauugccgaaaauaagaucuggggcagaaaauccuggccccugaacgagggcauuauggcgguggggaucguuagcauccuccuguccagccuucugaagaacgacgugccucucgccggaccccugauugcuggcgggaugcucaucgccuguuacgucauuucuggaagcuccgcugaucugucucuugaaaaagccgccgaggugagcugggaggaagaggcugaacauuccggcgcgucucacaauauccugguugaggugcaggacgaugggacaaugaagauuaaagacgaagaacgggaugacacgcugaccauccuccugaaggccacacuucuggcugucagcggaguguauccucucuccauccccgccacccuguucgucugguacuuuuggcaaaagaaaaagcagcgcucuggcgugcucugggauacaccuuccccucccgagguugaaagagccgugcuggacgacggcauuuaucggaucaugcagcgcgggcuucugggaagaucccaggucggcguggggguuuuccaagagaacguguuucauaccauguggcacgucacgcggggagcugugcugauguaccagggcaaacgccucgaacccagcugggccucugugaagaaagaucugauuuccuacgggggaggcuggagacuucagggcagcuggaauaccggggaggagguucaggucaucgcgguggaacccggaaagaacccuaagaaugugcaaacagcucccggcaccuucaaaacaucugagggggaagucggagccauugcccuggacuuuaagccgggcaccuccgggagcccuaucgugaaccgggagggaaaaauuguuggccucuauggcaaugggguggucacaacguccggaaccuacgugucugcuaucgcccaggcgaaggcuagccaggaaggcccccugccugagaucgaggaugaaguuuucagaaaacgcaaccucacaauuauggaccugcaccccggguccggaaagacccggagauaucuucccgccaucgugcgcgaggccauuaagcggaaacugagaacccugauccucgcuccuacacgcgucguggccagcgaaauggcugaggcccugaagggcaugccgauucgguaccaaacgaccgcgguuaaaucugaacauacagggaaggagaucguggaucuuaugugccacgccaccuuuacaaugagacugcucucccccguccgcgugccuaauuauaacaugaucauuauggacgaggcucauuucaccgaucccagcucuaucgccgcucggggcuacauuagcacgagagugggaaugggcgaagccgccgcuaucuuuaugacagcgaccccucccggguccgucgaggccuucccucagucuaaugcuguuauucaggacgaggaacgggauaucccggaacgcagcuggaacuccggauaugaguggaucaccgacuuucccggcaaaacagugugguucgugccuucuauuaagagcgggaaugauaucgccaacugucugagaaagaauggaaaacgggucauucagcugucccgcaagaccuucgacacagaguaccagaagaccaagaacaacgacugggauuacgugguuacgacagacaucagcgaaaugggcgccaauuuuagagcugaucgggugauugaccccagacgcugccucaaaccugucauccuuaaggaugggcccgagcgggugauucuggccggcccgaugccuguuaccguggcgucugcugcccagagacgcggacggaucggcagaaaccacaauaaggaaggggaccaguaugucuacaugggacagccccugaacaaugaugaggaccaugcccacuggacagaggcuaaaaugcuccuggauaacaucaauacccccgaaggcauuaucccugcccuuuucgagcccgaacgcgagaaguccgcggccauugacggggaauaucggcugagaggagaggcucgcaaaacguuuguggagcucaugagacggggcgaucugccugucuggcugagcuacaagguggccuccgaaggguuccaauauucugaccgcagauggugcuuugauggcgagcggaacaaucagguucucgaagagaacauggacguggaaaucuggaccaaagagggagagcgcaagaaacuuagaccgcgguggcuggacgcuagaacauacagcgauccccuggcccuccgcgaguucaaggaguuugcugccggccggagauccgugucuggggaccugauucuugaaaucggaaagcugccucagcaccucacccagcgcgcgcaaaaugcccuggauaaccuggucaugcuccauaauagcgagcagggcgggcgggcuuauagacacgccauggaggaacuucccgacacaaucgagacccugaugcugcucgcucugauugccguucuuacaggaggcgugacccuguucuuucucuccggccgggggcugggaaaaacgagcaucggccugcucugugugauggccucuuccgcccuucuguggauggcgagcgucgaaccucauuggauugccgcuucuaucauucuggaguucuuucucauggugcugcuuauccccgaaccggaucgccagagaacaccucaggacaaccaacuggccuacguugugaucgggcuccuguucaugauucugaccgucgccgcuaaugagaugggacuccuugagaccacaaagaaagaucugggcaucgggcacguggccgucgaaaaccaccaucacgcggccaugcuggacguggaucuccaucccgcuuccgccuggacccuguacgcuguugccacaacgauuaucaccccuaugaugcggcacacaauugagaacaccacagcgaauaucagccuuaccgccauugcuaaccaggccgcuauccugaugggacucgacaagggcuggcccaucucuaaaauggauauuggcgugccucugcuggcccucgggugcuauagccaggucaauccccuuacgcugaccgcugccgugcugaugcucguugcgcauuacgccaucauuggaccgggccugcaagcuaaggccacacgcgaagcucagaagagaaccgccgccgggaucaugaaaaacccuacaguggacggaauugucgcgaucgaucuugaccccgugguguaugacgcuaaguuugagaaacagcugggccagaucaugcuccugauucuguguaccucccaaauccuccuuaugcggacgacaugggcccugugcgaaucuauuacccuggcuacagggccccucaccacccugugggagggaagcccuggcaaguucuggaauacaacgaucgccguuuccauggccaacauuuuccgcggcagcuaccuugcuggggccggacuggcguuuucccucaugaaaucucugggcgggggaagacggggcaccggggcccagggagagacacugggcgaaaaguggaagcgccagcucaaucagcuuagcaaauccgaguucaacaccuauaagagaucuggcaucauggaagucgaucggagcgaggcuaaagaagggcugaagagaggagagacaaccaaacacgccgugucccgcggcacggcuaagcugcggugguuuguggagagaaaucucgucaagccggaagggaaaguuaucgaccugggauguggccgcgggggauggucuuacuauugcgccggccuuaagaaagugacagaggugaagggcuacaccaaagggggacccggccacgaggaaccuauucccauggcgaccuacggguggaaccuggucaagcuccauagcggaaaagauguguucuuuaucccucccgaaaagugugacacacugcugugcgauauuggcgaguccagcccuaauccgaccaucgaggaagggcggacacucagaguucuuaagaugguggagcccuggcugcgcggaaaccaauucuguauuaaaauccugaauccuuauaugcccucugucguggaaacgcucgagcagaugcagcggaagcacggcggcaugcugguuagaaacccucuuucccgcaauagcacccaugagauguacugggugucuugcgggacaggaaacauugucuccgccgugaauaugaccagccggaugcugcucaacagauuuacaauggcucaccgcaaacccaccuaugaacgggacguggaucugggcgccgggacgagacacgucgcuguugagccggaaguggccaaccuggacaucaucggacagcgcauugagaauaucaagcaugaacacaaaucuaccuggcauuacgaugaggacaacccuuauaagacaugggcuuaccacggcuccuaugaggugaagcccagcggguccgccagcucuauggucaauggagugguuaaacuccugaccaagcccugggaugugauuccuauggucacacaaaucgcgaugaccgacacaacccccuucggccagcagagaguguuuaaagaaaagguugacacgcggacaccuaaagccaagcgcggcaccgcucaaauuauggaggugaccgccaaguggcuuuggggguuccugagcagaaacaaaaagccgcggaucuguacaagagaagaguuuacgcggaaaguccgcuccaaugcugccaucggagccguguucguugaugaaaaccaguggaacucugcgaaggaggcuguggaggacgaaagauuuugggaucucguccaucgggagcgcgaacugcacaaacagggcaagugcgcuaccugcguguacaacaugauggggaagagagagaagaaacuuggagaguucggcaaagccaaagggagccgggcuauuugguacauguggcugggcgcccgcuuccucgaguuugaggcucugggauucaugaaugaagaccacugguuuuccagagagaacucucugagcggcgucgaaggggagggacuccauaaacugggcuauauccuucgggauauuuccaagauccccgggggaaauauguacgccgacgauacagcgggcugggacacccgcauuacagaggaugaccugcagaacgaagccaaaaucaccgauaucauggagccugaacacgcucuccuggccaagucuauuuucaaacuuacauaucaaaauaaagugguuagagugcagcggcccgcuaagaacgggaccgucauggacgugaucagccgcagagaucagcggggcuccggacaggugggcacguacgggcugaauaccuuuacaaacauggaggcccaacucauucgccagauggaaagcgagggaaucuucucuccuuccgagcuggaaacccccaaccuggcgggcagaguucucgacuggcuggagaaacaugggguggaacggcuuaagagaauggccauuagcggagacgauugugucgugaaaccgaucgacgaucgcuuugcuacagcccugaccgcucucaaugacaugggcaagguucggaaggauaucccucagugggagcccucuaaaggguggaacgacuggcagcaagugccuuucugcucccaccacuuucaucagcugauuaugaaggauggcagagaaaucgucgugcccugucgcaaucaggacgagcuugucggacgggccagagugagccagggcgcuggguggucccugcgcgagacggccugccucggaaaaucuuaugcgcaaauguggcagcugauguacuuccaccggagagaucugcgccucgccgcuaacgccauuuguagcgccguuccuguggacuggguccccacaucccggaccacauggagcauccaugcucaccaucaguggaugaccacggaagauaugcugucuguguggaauagaguuuggauugaggaaaacccguggauggaggacaagacccacaucuccagcuggggcgacgugccuuaucuugggaaacgcgaagaucaauggugcggaucucugauuggccucacagcccgggcgaccugggcuacaaauauccaggucgccaucaaccaggugagacggcugauugggaaugagaacuaccuugacuacaugaccagcaugaagagauuuaagaaugaguccgaucccgaaggcgcccugugguga

SEQ ID NO: 19199 - RNA, 9879 nt, Artificial Sequence
  derived and/or modified CDS sequence (opt5) from DENV-1__GU131755__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagagcaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuaccccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugcgggggaugagcuaugugauguguaccggcucuuucaagcucgagaaagaagucgcugagacccagcacggaacagugcugguucagauuaaguacgagggcaccgacgccccgugcaagaucccuuucuccacacaagaugaaaaaggggugacgcagaacggaagacugaucaccgcgaaucccauugucacagacaaggagaaaccugugaacaucgaagcugagccccccuuuggcgagagcuauauugugaucggggccggagaaaaggcccuuaaacucucuugguucaagaagggcagcuccauugggaaaauguuugaggcuaccgcccgcggcgcucggagaauggccauccugggagauacagcgugggacuucggcucuaucgggggaguuuuuaccagcgucggcaagcuggugcaucagauuuucgggacggccuacggagugcucuuuuccggcgucagcuggaccaugaaaaucgggauuggcgugcugcuuacauggcugggacucaauucucgcuccaccagccugucuaugacauguaucgcuguuggccuggugacccuuuaccucggggucauggugcaggccgauuccggaugcguuauuaacuggaagggccgggaacugaaaugugggagcggaaucuucgugacaaaugagguccacaccuggacggaacaauauaaguuucaggcugacuccccuaagagacugucugccgcgauuggcaaagccugggaggagggggugugcggcauccgcagcgcuacacggcucgaaaacaucauguggaagcagauuuccaacgagcugaaucauauccuucuggaaaacgacaugaaauucaccguuguggucggagauguggccggcauucucgcucaggggaagaaaaugaucagaccgcaacccauggaguacaaguauucuuggaaaagcuggggaaaggccaagauuaucggcgccgacgugcagaauaccacauuuaucauugaugggccuaacacccccgaauguccugacgaucagcgcgcuuggaauaucugggaggucgaggacuacggauucggcauuuuuacgacaaacaucuggcugaaacugcgggauuccuauacccagguuugcgaccacagacuuaugagcgcggccauuaaggauucuaaagcugugcacgccgacaugggcuacuggaucgaauccgagaagaaugaaacauggaaacucgcccgcgcuagcuucaucgaggugaagaccuguauuuggcccaagucucauacacugugguccaacgggguccuggaaagcgagaugaucauuccgaaaaucuauggaggcccuauuucucaacacaauuaccggcccggguacuucacccagacggccggaccuuggcaucucggcaagcuggagcuugauuuugaccugugcgaagggaccacagugguuguggaugagcacugcggaaacagaggccccagccuccggaccacaaccgucacgggcaaaaucauccacgaaugguguugccgcuccuguacacugccuccccugagauuccggggggaggacggaugcugguauggcauggagauuagaccggugaaggaaaaagaggaaaaucuuguuaagagcauggugucugcgggguccggagaggucgacagcuuuucccucggccugcuguguaucucuauuaugaucgaagaggugaugcgcagccggugguccagaaagaugcucaugaccgggacacuggcuguuuucuuucuucugauuaugggacagcucaccuggaacgaucugauccgccugugcauuauggugggcgccaaugccucugacagaaugggcauggggaccacauaccuugcucugauggccacguucaaaauccggccuauguuugcggucggacuccuguuccgcagacucaccagccgggaggugcugcuucugacaaucggccucucccugguggcuucugucgaacugcccaacagccuugaggaacugggggauggacucgccaugggcauuaugauccugaagcuccugaccgacuuucaaucccaucagcuuugggccacacugcucagccugaccuucauuaaaacgacauuuucucugcacugugcuuggaagaccauggccaugguucuuuccaucgugagccuguucccccucugccugucuaccacaucccagaaaaccacauggcucccugugcugcuugggagccugggauguaagccgcugacgauguuucucauugcugagaauaagaucuggggccgcagaucuuggccccugaacgaaggcaucauggccgucgggauuguguccauccuucugagcucccuccugaaaaacgauguuccucucgcgggaccccugauugccggcgggaugcuuaucgcuugcuaugugauuagcggaucuagcgccgaccugucccuggagaaggcugccgaggucucuugggaagaggaagccgagcauagcggcgcuucccacaauauccucguggaaguucaggaugacgggaccaugaaaaucaaggaugaggagcgggacgauacacugaccauucuucugaaagcgacacuccuggccgugucuggagucuacccucucagcauccccgcuacccuguucgugugguauuucuggcaaaagaaaaagcagcgcuccggcguccuuugggacacgccuucucccccggaaguggagagagccguucuggaugacggcauuuaccggaucaugcagcgcgggcugcucggaagaagccaggugggcgucgggguguuucaagaaaacguuuuccauaccauguggcacgugacacggggagccguccugauguaucagggcaagagacuugagccuuccugggcuagcgugaaaaaggaccugauuucuuacgggggaggcuggcgccuccagggcuccuggaauaccggggaggaagugcagguuaucgccgucgagcccggaaaaaacccuaagaaugugcaaacagcgcccggcaccuuuaaaacaccggaaggggaggugggagcuauugcccuggauuucaagccuggcacgagcgggucucccaucgucaaccgggaaggaaagaucgugggccucuacggcaaugggguugugaccacauccggaaccuaugucagcgccauugcucaggccaaagcgucccaggagggcccucugcccgagaucgaagacgagguguuuagaaagcgcaaccuuaccauuauggaucugcaccccgggucuggaaaaacacggagauaccugccugcuaucguucgcgaagccauuaagcggaaacucagaacgcugauccuugccccgacccgcguggucgcuagcgagauggccgaagcucugaagggcaugcccauccgguaucaaacaaccgccgugaaguccgagcauacagggaaagagauuguugaccucaugugucacgcgaccuucacgaugagacugcugagcccugugcggguccccaauuacaacaugaucauuauggaugaagcccauuuuacagacccuucuuccaucgcugcccgcggcuauauuagcaccagagugggaaugggcgaggcugccgccaucuucaugaccgcuacacccccugggucuguggaagcguuuccgcagagcaaugccgucauccaggaugaggaacgggacauucccgagcgcuccuggaacucuggauacgaguggaucaccgauuucccuggcaagacaguuugguuugugcccagcauuaaauccgggaaugacaucgcuaacugccucagaaagaauggaaaacgggugauucagcuuucuagaaagaccuucgauacggaauaucaaaagacaaaaaacaacgacugggacuacgucgugaccacagauaucagcgagaugggcgccaauuuccgcgccgaccggguuauugauccuagacgcugccugaagcccgugauccugaaagacgggccggaacgggucauccucgcuggcccuaugcccgugaccguugccuccgcggcucagagacgcggacggauuggcagaaaccacaauaaggagggggaucaguacaucuauaugggacagccccugaacaaugacgaggaucaugcccacuggacggaagccaaaaugcuucuggacaacauuaauaccccugagggcaucauucccgcucucuuugaaccugagcgcgaaaagagcgccgcgaucgauggggaguacagacugcggggagaggcccgcaagacauucguggaacugaugagacggggcgaccucccggucuggcuuucuuauaaaguggcuuccgagggguuucaauacagcgaucgcagaugguguuucgacggcgaacggaacaaucagguccuggaggaaaacauggauguggagaucuggaccaaggagggagaaagaaaaaagcugcgcccccgguggcucgacgccagaacauauuccgacccucuggcucuucgcgaguuuaaagaauucgccgcuggccggagaucuguuagcggggaucugauucucgagaucggaaagcugccccagcaccugacccagcgggcccaaaaugcgcucgacaaccuugugaugcugcauaauuccgaacagggcgggcgcgccuacagacacgcuauggaggagcugccugauacaauugaaacccucaugcugcuugcccugaucgcugugcucacgggaggcgucacacuguuuuuccugucuggccgggggcucggaaaaaccagcauuggccuucugugcguuauggccuccagcgugcugcucuggauggccucuguggagccccauuggaucgcugcguccaucauucuggaauuuuuccuuaugguccugcucaucccggagccugacaagcagcgcaccccccaggauaaccaacuggccuaugugguuauugggcugcucuuuaugauccuuacaguggcugccaaugagaugggacugcuggaaaccacaaagaaagaccucggcauugggcacgucgccguggagaaccaccaucacgcugccaugcuggaugucgaccuucauccugcgagcgccuggacgcuguacgcuguggccaccacaaucauuacccccaugaugagacacacaaucgaaaacaccacggcuaauaucucucucaccgccauugcgaaccaggccgcuauccugaugggacuggauaagggcuggccuauuuccaaaauggacaucggcguuccccuccuugcccugggguguuacagccaggugaauccgcugacacucaccgcugccguccugaugcuuguggcucauuaugccauuaucggaccuggccugcaagcgaaggccacacgggaggcucagaaacgcaccgccgcugggaucaugaagaaccccacgguugauggaauuguggccaucgaccucgaucccgucguguacgacgccaaguucgaaaaacagcugggccagauuaugcugcucauccuuugcacaucucaaauucugcugaugagaaccacaugggcgcucugugagagcaucacccuggcuaccgggccucuuacaacgcugugggagggauccccgggcaaguuuuggaauaccacaaucgccgugucuauggcuaacauuuuccggggcagcuaucucgccggggccggacuggcuuucucccugaugaaaagccucggcgggggacgcagaggcaccggggcccagggagaaacacuuggcgagaaguggaaacggcagcugaaucagcuguccaagucugaauuuaacaccuacaagagaagcggcaucauggagguugaccgcuccgaagcgaaagaggggcucaagcggggagagacgacaaaacacgccgucucuagaggcaccgcuaagcugcgcugguucguggaacggaaucuugugaaacccgaggggaaggucauugaucugggaugcggcagagggggauggagcuauuacugugccggccucaagaaaguuaccgaagugaagggcuauacaaaagggggaccuggccacgaggaacccaucccuauggcuaccuacggguggaaccuggugaagcugcauuccggaaaagacgucuuuuucauucccccugagaagugcgauacacuccuuugugacaucggcgagucuagcccgaaucccacgauugaagaggggcgcacccugcgggugcugaaaaugguugaaccuuggcucagaggaaaccaauuuugcaucaagauccugaaucccuacaugccuuccguggucgagacacuugagcagaugcagcgcaagcacggcggcaugcuggugcggaacccccucagcagaaauucuacccaugaaauguauuggguuuccugugggacaggaaacauugugagcgccgucaauaugaccucucgcaugcugcugaaccgguucacgauggcgcacagaaaaccgaccuacgagcgcgauguggaccucggcgccgggacaagacacguggcugucgaaccugagguugccaaccuggauaucauuggacagcggaucgaaaauauuaagcaugagcacaaauccaccuggcauuaugacgaggauaaccccuacaagacaugggcuuaucacggcagcuacgaagugaaacccucuggguccgccagcuccauggugaauggagucgugaagcuucugaccaagccuugggacguuauccccauggugacacaaaucgcuaugaccgauacgacaccuuuuggccagcagcgcgucuucaaagagaagguggacaccagaaccccgaaagccaagcggggcacagcgcaaauuauggaaguuacggccaaauggcucuggggguuucugagcagaaacaagaagccccggaucugcacccgcgaggaauucacaagaaaagugcggucuaaugcugccauuggagcugucuuuaucgacgagaaccaguggaauagcgccaaggaggccguggaagaugagcgcuucugggaccuuguucauagagaacgggagcugcacaaacagggcaagugcgcgaccuguguguauaacaugauggggaaacgcgaaaagaagcucggagaguuuggcaaagcuaagggguccagagccauuugguacauguggcugggcgcccgguuccuggaguucgaagcucucggauuuaugaaugaggaucacugguucucucgcgaaaacagccuguccggcgucgagggggagggacuucauaaacugggcuacauccucagagacaucucuaagauuccugggggaaauauguaugccgaugacacagcuggcugggauacccggaucacagaagacgaucugcagaacgaggcccgcauuaccgacaucauggaacccgagcacgcgcuucuggccaaaagcauuuuuaagcucacguaccaaaauaaaguggucagagugcagcggccugcuaagaacgggaccguuauggaugugaucucccgcagagaccagcggggcucuggacaggucggcacauaugggcugaauaccuucacaaacauggaagcccaacugaucagacagauggagagcgagggaauuuuuucccccagcgaacucgagaccccgaaccuggcugaacgcgugcuugauuggcuggagaaguacggcguggaacggcucaaaagaauggccaucucuggggacgacugcguugugaagccuauugaugaccgcuucgcgacggcccugacagcucuuaaugauaugggaaaaguccggaaggacaucccccagugggagccuuccaaaggcuggaacgauuggcagcaagugcccuuuuguagccaucacuuccaccagcugauuaugaaggacgggagagagaucguugugccuugccgcaaucaggaugaacucgucggccgggccagagugucucagggagcuggcuggucccugcgcgagaccgccugucuggggaagagcuaugcucaaauguggcagcucauguacuuucaucggagagaccugcgccuugccgcgaacgccauuugcuccgcuguccccguggauuggaucccgacaucucggaccacguggagcauccacgcccaucaccaguggaugaccacagaagacaugcuguccguuuggaauagaguguggauugaggaaaacccuuggauggaggauaaaacccauaucagcucuuggggagacguccccuaucucggcaagcgggaggaccaauggugugggucccugauuggacuuacagccagagcuaccugggccacaaauauccagguggcgauuaaccagguucgccggcugaucggcaaugaaaacuaccucgauuacaugaccagcaugaaaagauucaagaaugagucugaccccgaaggggcucugugguga

SEQ ID NO: 19200 - RNA, 9879 nt, Artificial Sequence
  derived and/or modified CDS sequence (opt5) from DENV-1__GU131756__SS-prME
agcgugaccaugcugcugaugcugaugcccacagcccuugcuuuccaccugacgacccggggaggggagccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaggaacaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaagcugacgguuguggucggagauguggcuggcauucucgcccaggggaaaaagaugauccggccgcaacccauggaguacaaauauagcuggaaguccuggggaaaggccaaaauuaucggcgcugacgugcagaauacaaccuuuaucauugaugggccuaacacccccgaauguccugacgaucagagagcguggaauaucugggaggucgaggacuacggauucggcauuuuuacaaccaacaucuggcugaagcugcgcgauagcuauacgcagguuugcgaccaccggcuuaugucugccgcuauuaaagauuccaaggccgugcacgccgacaugggcuacuggaucgaaagcgagaaaaaugaaacauggaagcucgcuagagccucuuucaucgaggugaagaccuguauuuggcccaaaucccauacacuguggagcaacgggguccuggaaucugagaugaucauuccgaagaucuauggaggcccuauuagccaacacaauuaccgccccggguacuucacccagacagcgggaccuuggcaucucggcaaacuggagcuugauuuugaccugugcgaagggaccacggugguuguggaugagcacugcggaaaccggggccccucccucagaaccacaaccgucacaggcaagaucauccacgaaugguguugccggagcuguacccugccuccccugcgcuucaaaggggaggacggaugcugguauggcauggagauuagaccggugaaggaaaaggaggaaaaucuuguuaaaucuaugguguccgcugggagcggagaggucgacuccuuuucucucggccugcuguguaucagcauuaugaucgaagaggugaugcgguccagauggucucgcaagaugcucaugacggggacacuggccgccuucuuucuucugauuaugggacagcucaccuggaacgaucugauccggcugugcauuaugguuggcgcuaaugccagcgacagaaugggcauggggacaaccuaccuugcgcugauggcuaccuucaaaaugcgcccuauguuugccgugggacuccuguucagacggcucacaucccgcgagguccugcuucugacgaucggccucucucugguggccagcguggaacugcccaacucccuugaggaacugggggauggacucgcuaugggcaucaugauucugaagcuccugaccgacuuucaaagccaucagcuuugggccacacugcucucucugaccuucaucagaacaaccuuuucccugcacuaugcuuggaaaacgauggccaugguccuuagcauuguuucucuguucccccucugucuguccacaaccagccagaagaccacauggcucccugugcugcuugggucucugggaugcaagccgcugaccauguuucucaucgcggagaauaaaauuuggggccggaaguccuggccccugaacgaaggcaucauggccguggggaucgucagcauucuucuguccagccuccugaaaaacgaugugccucucgcuggaccccugaucgccggcgggaugcuuauugcuuguuacguuaucucuggaagcuccgccgaccugucucuggagaaggccgcuguggucagcugggaggaagaggcggaacauuccggcgccucucacaauauucucguggagguucaggaugacgggacaaugaaaaucaaggaugaagaaagagacgauacgcugaccauccuucugaaagcuacacuccuggccgugagcggagucuauccucucuccauucccgccacccuguucgugugguacuucuggcaaaagaagaaacagagaucuggcguccuuugggacacaccuuccccucccgagguggaacgggcuguucuggaugacggcaucuaucgcauuaugcagagagggcugcucggacggucccaggugggcgucgggguguuucaagagaacguuuuccauaccauguggcacgugacgcgcggagccguccugauguaccagggcaagagacuugaacccagcugggcgucugugaaaaaggaccugaucuccuacgggggaggcuggcggcuccagggcagcuggaauaccggggaggaggugcagguuauugcugucgaacccggcaagaauccuaagaaugugcaaacagcccccggcaccuuuaagacaucugagggggaagugggagccaucgcucuggauuucaaaccgggcaccuccgggagcccuauugucaacagagagggaaagaucgugggccucuauggcaaugggguugugacaacguccggaaccuacgucucugccaucgcgcaggcuaaagccagccaggaaggcccccugccugagauugaggacgaaguguuucgcaagcggaaccuuacaaucauggaucugcaccccggguccggaaaaaccagacgcuaucugcccgccauuguucgggaggcuaucaagagaaagcuccgcacccugauucuugccccuacacggguggucgcuagcgaaauggccgaggcgcugaaaggcaugccgaucagauaccaaacgaccgccgugaagucugaacauacagggaaagagaucguugaccucaugugccacgcuaccuucacaaugcgccugcugucccccgugcgggucccuaauuauaacaugauuaucauggaugaggcccauuuuaccgaccccagcucuauugcugccagaggcuacaucagcacgcgggugggaaugggcgaagccgcugcgauuuucaugacagccaccccucccggguccguggaggcuuuuccucagucuaaugccgucauccaggaugaggaacgcgacaucccggaaagaagcuggaacuccggauaugaguggauuaccgauuuccccggcaagacaguuugguuugugccuucuaucaaaagcgggaaugacauugccaacugucuccggaagaauggaaagcgcgugauccagcuuuccagaaaaaccuucgauacagaguaccaaaagaccaaaaacaacgacugggacuacgucgugacgacagauauuagcgaaaugggcgcuaauuuccgggccgacagaguuaucgauccccgccggugccugaagccugugauucugaaagacgggcccgagagagucauccucgcgggcccgaugccugugaccguugcuucugccgcccagcgccggggaagaaucggccgcaaccacaauaaggaaggggaucaguauauuuacaugggacagccccugaacaaugacgaggaucaugcucacuggacagaggccaagaugcuucuggacaacaucaauacccccgaaggcauuaucccugcgcucuuugagcccgaacgggagaaauccgccgcuauugauggggaauauagacugcgcggagaggccagaaagacguucguggagcugaugcggcgcggcgaccucccugucuggcuuagcuacaaaguggcuuccgaaggguuucaauauucugauagacgguggugcuucgacggcgagcgcaacaaucagguccuggaagagaacauggauguggaaaucuggaccaaggagggagagcgcaagaagcugcggccgagauggcucgacgcccgcacauacagcgacccccuggcccuucgggaauuuaaagaguucgccgcgggcagacgcuccguuucuggggaucugauccucgaaauuggaaagcugccucagcaccugacccagcgggcccaaaaugcucucgacaaccuugugaugcugcauaauagcgagcagggcgggagagccuaucggcacgcuauggaggaacugcccgauacaaucgagacccucaugcugcuugcccugauugccgugcucacaggaggcgucacccuguuuuuccuguccggccgcgggcucggaaagacgagcaucggccuucuguguguuauggcuucuuccgugcugcucuggauggcgagcguggaaccucauuggauugccgcuucuaucauccuggaguuuuuccuuaugguccugcucauucccgaaccggacagacagcggacaccucaggauaaccaacuggccuacgugguuaucgggcugcucuuuaugauucuuaccguggccgcuaaugagaugggacugcuggagaccaccaagaaggaccucggcaucgggcacgucgccguggaaaaccaccaucacgcggccaugcuggaugucgaccuucaucccgcuuccgccuggacccuguacgcuguggccacaacgauuaucaccccuaugaugcgccacacaauugagaacaccacagcgaauaucagccucaccgccaucgcuaaccaggccgcuauucugaugggacuggauaaaggcuggcccaucucuaagauggacauuggcguuccucuccuugcccuggggugcuauagccaggugaauccccugacgcucaccgcugccguccugaugcuuguggcgcauuacgccaucauuggaccgggccugcaagcuaaagccacaagagaagcucagaagcggaccgccgccgggaucaugaagaacccuacaguugauggaaucguggcgauugaccucgaucccgucguguaugacgcuaaauucgagaagcagcugggccagaucaugcugcucauucuuuguaccucccaaauccugcugaugcgcacgacaugggcccucugcgaaucuauuacccuggcuacagggccccuuaccacccugugggagggaagcccuggcaaauuuuggaauacaacgaucgccguguccauggccaacaucuucagaggcagcuaccucgcuggggccggacuggcguucucccugaugaagucucucggcgggggacggcgcggcaccggggcccagggagagacacuuggcgaaaaauggaagagacagcugaaucagcugagcaaguccgaguuuaacaccuauaaacggucuggcauuauggaaguugacagaagcgaggcuaaggaagggcucaaacgcggagagacaaccaagcacgccgucucccggggcacggcuaaacugagaugguucguggagcgcaaucuugugaagccggaagggaaggucaucgaucugggauguggcagagggggauggucuuacuauugcgccggccucaaaaagguuacagaggugaaaggcuacaccaaagggggacccggccacgaggagccuauucccauggcgaccuacggguggaaccuggugaaacugcauagcggaaaggacgucuuuuucaucccucccgaaaaaugugauacacuccuuugcgacauuggcgaguccagcccuaauccgaccaucgaggaagggagaacacugcgcgugcugaagaugguugagcccuggcuccggggaaaccaauuuuguauuaagauccugaauccuuauaugcccucuguggucgaaacgcuugagcagaugcagagaaaacacggcggcaugcuggugcgcaacccucucucccggaauagcacccaugagauguacuggguuucuugcgggacaggaaacaucguguccgccgucaauaugaccagcagaaugcugcugaaccgcuucacaauggcucaccggaagcccaccuaugaaagagauguggaccucggcgccgggacgcgccacguggcugucgagccggaaguugccaaccuggauauuaucggacagagaauugagaauaucaaacaugaacacaagucuaccuggcauuacgacgaggauaacccuuauaaaacaugggcuuaccacggcuccuaugaggugaagcccagcggguccgccagcucuauggugaauggagucgugaaacuucugaccaaacccugggacguuauuccuauggugacacaaaucgcgaugaccgauacaacccccuuuggccagcagcgggucuucaaggaaaaaguggacacgcgcacaccuaaggccaaaagaggcaccgcucaaaucauggagguuaccgccaaguggcucuggggguuucugagccggaacaagaaaccgagaauuuguacacgggaagaguucacgcgcaaggugagauccaaugcugccaucggagccgucuuuguggacgaaaaccaguggaacucugcgaaagaggcuguugaggaugaacgguucugggaccuugugcaucgcgagagagaacugcacaagcagggcaaaugcgcuacaugcgucuacaacaugauggggaagcgggagaagaaacucggagaauuuggcaaggccaaagggagccgcgcuauuugguacauguggcugggcgccagauuccuggaguucgaggcucucggauuuaugaaugaagaucacugguucucccgggagaacucucugagcggcguggaaggggagggacuucauaagcugggcuauauccuccgcgacauuuccaaaauccccgggggaaauauguacgccgaugacacagcgggcugggauaccagaaucacagaggacgaucugcagaacgaagccaagauuaccgacaucauggagccugaacacgcccuucuggccaaaucuauuuuuaagcucacauaucaaaauaaggucgugcggguucagcgccccgcuaaaaacgggaccgugauggaugucaucagcagacgggaccagcgcggcuccggacaggugggcacguacgggcugaauaccuucacaaacauggaggcccaacugauuagacagauggaaagcgagggaaucuuuucuccuuccgagcucgaaacccccaaccuggcgggccgggugcuugauuggcuggagaagcaugggguugaaagacucaaacgcauggccaucagcggagacgacuguguggucaagccgauugaugaccgguucgcuacagcccugaccgcucuuaaugauaugggcaaagugagaaaggacaucccucagugggagcccucuaagggguggaacgauuggcagcaaguuccuuuuugcucccaccacuuccaucagcugauuaugaaagacggccgcgaaaucgugguccccugucggaaucaggaugagcucgugggcagagcucgcgucagccagggagcuggguggucccugcgggagacggccugccugggaaagucuuaugcgcaaauguggcagcucauguacuuucacagacgcgaccugcggcuugccgcuaacgccauuuguagcgccgugccuguugauugggugcccacauccagaaccacauggagcauccaugcucaccaucaguggaugaccacggaagacaugcugucugucuggaaucgcguguggauugaggaaaacccguggauggaggauaaaacccacaucuccagcuggggcgacguuccuuaucucgggaagcgggaagaccaauggugcggaucucugaucggccuuacagccagagcgaccugggcuacaaauauucagguggccaucaaccagguccggagacugcucgggaaugagaacuaccuggauuacaugaccagcaugaaacgcuucaagaaugaguccgaccccgaaggcgcccugugguga

SEQ ID NO: 19201 - RNA, 9879 nt, Artificial Sequence
  derived and/or modified CDS sequence (opt5) from DENV-1__GU131758__SS-prME
agcgugaccaugcugcugaugcugaugcccaccgcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaagugcccgagaaucacagaggcugaacccgacgauguggacuguuggugcaaugccaccgauacgugggugaccuauggaacauguucccagaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgugccgugcaagauuccuuuuagcacccaggaugaaaaaggggucacacaaaacggacggcugaucacggcgaaucccaucgugaccgacaaggagaaaccugugaacauugaagcugagccgcccuucggcgagucuuauaucguuauuggggccggagaaaaggcccugaaacuuagcugguuuaaaaagggcuccucuaucgggaaaauguucgaggcuacagccagaggcgcucgccggauggccauucucggagauaccgcgugggacuuuggcagcaucgggggagucuucacauccgugggcaagcuggugcaucagaucuuugggaccgccuacggaguccuguucagcggcgugucuuggacgaugaaaauugggaucggcguucuccugaccuggcuuggacucaauuccagaagcacaucucucuccaugaccuguauugcugugggccuggucacacuguaccuuggggugaugguucaggccgauagcggaugcgugaucaacuggaagggccgcgaacucaaguguggguccggaauuuuugucaccaaugaggugcacacauggaccgaacaguauaaauuccaagcugacucuccuaagcggcugagcgccgcgaucggcaaagccugggaggaggggguuugcggcauuagauccgcuacgcgccuggaaaacaucauguggaagcagaucucuaacgagcucaaucauauucugcuugaaaacgacaugaaauuuacaguggucgugggagauguggccggcauccuggcucaggggaagaaaaugauucggccgcagcccauggaguacaaguauagcuggaaguccuggggaaaagccaagaucauuggcgccgacguccaaaauaccaccuucaucaucgaugggccuaacacacccgaauguccugacgaucagagagcuuggaauauuugggagguugaggacuacggauuuggcaucuucaccacgaacauuuggcucaaacugcgcgauagcuauacacaggugugcgaccaccggcugaugucugcggccaucaaggauuccaaagcugugcacgccgacaugggcuacuggauugaaagcgagaagaaugaaaccuggaaacuugccagagcuucuuucaucgaggucaaaacauguaucuggcccaagucccauacccucuggagcaacggggugcuggaaucugagaugauuaucccgaaaauuuauggaggcccuaucagccagcacaauuaccgccccggguacuuuacacaaaccgccggaccuuggcaucugggcaagcucgagcuggauuucgaccuuugcgaagggacgaccguuguggucgaugagcacugcggaaaccggggccccucccugagaacaaccacagugaccggcaaaauuauccacgaaugguguugccggagcuguacgcucccuccccugcgcuuuaagggggaggacggaugcugguauggcauggagaucagaccgguuaaggaaaaagaggaaaaucuggugaagucuauggucuccgcggggagcggagagguggacuccuucucucuuggccuccuguguauuagcaucaugauugaagagguuaugcgguccagauggucucgcaaaaugcugaugacagggacccucgcuguguuuuuccugcuuaucaugggacagcugacauggaacgaucucauucggcugugcaucauggucggcgccaaugccagcgacagaaugggcauggggaccaccuaccuggcucuuauggccacauuuaagaugcgcccuauguucgcggugggacugcucuuuagacggcugacgucccgcgaggugcuccugcuuaccauuggccugucucucgucgcuagcguugaacugcccaacucccuggaggaacuuggggauggacuggccaugggcaucaugauccucaaacugcucacagacuuccagagccaucaacugugggccacccuucugucuuuuacauucauuaagaccacguuuucccuccacuaugcuuggaagacaauggccauggugcugagcaucgugucucuguucccccuuugucuguccaccaccagccagaaaacaaccuggcucccuguccugcucgggucucugggaugcaagccgcuuacaauguuccugauugcugagaauaaaguguggggcagaaaguccuggccccugaacgaaggcaucauggccguugggauugugagcauccuccuguccagccuucugaaaaacgaugucccucucgcgggaccccugaucgccggcgggaugcucauugcuuguuacgugaucucuggaagcuccgccgaccugucucuugagaaggcugccgagguuagcugggaagaggaagccgagcauuccggcgcuucucacaauauucugguggaaguccaggaugacgggacgaugaaaaucaaggaugaggagcgggacgauacccugacaauucuccugaaggcgacccuucuggccgugagcggagucuauccucucuccauccccgcuacacuguuugugugguacuucuggcagaaaaagaaacaacgcucuggcguucucugggacaccccuuccccucccgaaguggagagagccguccuggaugacggcaucuaucggauuaugcagcgcgggcuucugggaagaucccaggugggcguugggguguuucaggaaaacgucuuccauacgauguggcacgugacccggggagccgugcugauguaccaaggcaagcgccucgagcccagcugggcuucuguuaaaaaggaccugaucuccuacgggggaggcuggagacuucagggcagcuggaauacaggggaggaaguccaggugauugccguggagcccggaaagaacccuaaaaauguccagaccgcgcccggcacauuuaagaccucugaaggggaggugggagcuaucgcccuggauuucaaaccgggcacauccgggagcccuauuguuaaccgggaaggaaagaucgugggccucuauggcaauggggucgugacgaccuccggaacauacguuucugccauugcucaagccaaagcgagccaggagggcccccugccugagaucgaagacgagguguuuagaaagcgcaaccucaccaucauggaucugcaccccggguccggaaagacccggagauaucuucccgcuauuguccgcgaagccaucaaacggaagcugagaacacugauucucgccccuacgcgcgugguugcuagcgagauggccgaagcucugaaaggcaugccgauccgguaccagaccacagccgugaagucugagcauaccgggaaagagauugucgaccuuaugugccacgcgacauucaccaugagacugcucucccccgugcgcgugccuaauuauaacaugaucaucauggaugaagcccauuuuacggaccccagcucuauugcugcccggggcuacaucagcacaagagucggaaugggcgaggcugccgccauuuucaugaccgcuaccccucccggguccguugaagcguuuccucaaucuaaugccgugauccaggaugaggaacgggacauuccggagcgcagcuggaacuccggauaugaguggaucacagauuuccccggcaagaccgugugguucgucccuucuaucaagagcgggaaugacauugcuaacugucugcgcaagaauggaaagcgggugauccagcugucccgcaaaacauuugauaccgaauaccagaagacgaaaaacaacgacugggacuacguugugacaaccgauauuagcgagaugggcgccaauuucagagccgaccgggucaucgaucccagacgcugccucaagccugugauucuuaaggacgggcccgaacggguuauccuggcuggcccgaugccugugacagucgccucugcggcucaaagacgcggacggauuggcagaaaccacaauaaagagggggaucaguauaucuacaugggacagccccugaacaaugacgaggaucaugcccacuggaccgaagccaagaugcuccuggacaacaucaauacgcccgagggcauuaucccugcucuuuuugaacccgagcgcgaaaaauccgccgcgauugauggggaguaucggcugagaggagaggcccgcaagaccuucguggaacucaugagacggggcgaccugccugucuggcugagcuacaaaguggcuuccgagggguuucaguauucugaucgcagauggugcuucgacggcgaacggaacaaucaaguucucgaggaaaacauggauguggagaucuggacaaaggagggagaacgcaagaaacuuagaccgcgguggcuggacgccagaaccuacagcgacccccuggcucuccgcgaguuuaaagaguucgccgcuggccggagauccgugucuggggaucugauucuugagaucggaaaacugccucagcaccucacacagcgcgcccagaaugcgcuggacaaccuggucaugcuccauaauagcgaacaaggcgggcgggccuauagacacgcuauggaggagcuucccgauaccaucgaaacacugaugcugcucgcccugauugcuguucuuaccggaggcgugacgcuguuuuuccucuccggccgggggcugggaaagacaagcaucggccugcucugugugauggccucuuccguccuucuguggauggccagcguggagccucauuggauugcugcgucuaucauucuggaauuuuuccucaugguucugcuuauccccgagccggaccgccagagaaccccucaggauaaccagcuggccuacguggucaucgggcuccuguuuaugauucugaccguggcugccaaugagaugggacuccuugaaacaaccaaaaaggaccugggcaucgggcacgccgcugucgagaaccaccaucacgccgcgaugcuggauguggaccuccaucccgccuccgcuuggacacuguacgccguugcuacgaccauuaucacaccuaugaugcggcacaccauugaaaacacaaccgccaauaucagccuuacggcgauugccaaccaagcugccauccugaugggacucgauaaaggcuggcccaucucuaagauggacauuggcgugccucugcuggcucucgggugcuauagccaggucaauccccuuacccugacagccgcugugcugaugcucguugcccauuacgcgaucauuggaccgggccugcaggccaaggcuacccgcgaggcccagaagagaacagcugccgggaucaugaagaacccuaccguggauggaauugucgccaucgaccuugaucccgugguguaugacgcgaaauucgaaaagcagcugggccagaucaugcuccugauucuguguacgucccagauccuccuuaugcggacaaccugggcucugugcgagucuauuacacuggccaccgggccccucaccacacugugggagggaagcccuggcaaauucuggaauacgaccaucgcuguuuccauggccaacauuuuucgcggcagcuaccuugccggggcuggacuggccuucucccucaugaagucucugggcgggggaagacggggcacaggggcgcaaggagaaacccugggcgagaaguggaaacgccagcucaaucagcuuagcaaguccgaauuuaacacauauaaaagaucuggcaucauggaggucgaccggagcgaagccaaggaggggcugaaaagaggagagaccacgaagcacgcugugucccgcggcacagccaagcugcggugguucguggaaagaaaucucgucaaaccggaggggaagguuaucgaucugggauguggccgcgggggauggucuuacuauugcgcuggccuuaaaaaggugaccgaagugaaaggcuacaccaaagggggacccggccacgaggaaccuauucccauggccacauacggguggaaccuggucaaacuccauagcggaaaggacguguuuuucaucccucccgagaagugugauacccugcugugcgacauuggcgaguccagcccuaauccgacaaucgaagaggggcggacgcucagaguucuuaaaaugguggaacccuggcugcgcggaaaccaguuuuguauuaagauccugaauccuuauaugcccucugucguggagacccucgagcaaaugcagcggaaacacggcggcaugcugguuagaaacccucuuucccgcaauagcacacaugaaauguacugggugucuugcgggaccggaaacauugucuccgcggugaauaugacaagccggaugcugcucaacagauucaccauggcccaccgcaagcccacguaugagcgggauguggaccugggcgcugggaccagacacgucgccguugaaccggagguggcuaaccuggauaucaucggacagcgcauugaaaauaucaaacaugagcacaagucuacauggcauuacgacgaggauaacccuuauaagaccugggccuaccacggcuccuaugaagugaaacccagcggguccgcuagcucuauggucaauggagugguuaagcuccugacaaaacccugggacgugauuccuauggucacccagaucgccaugacagauaccacgcccuuuggccaacagagaguguucaaggagaaaguugacacacggaccccuaaggcgaagcgcggcaccgcccagauuauggaagugacagcuaaauggcuuuggggguuucugagcagaaacaagaaaccgcggaucuguacgagagaggaguucacccggaagguccgcuccaaugccgcuaucggagccguguuuguugacgagaaccaauggaacucugccaaagaggcgguggaagaugagagauucugggaccucguccaucgggaacgcgagcugcacaagcagggcaagugcgcuacaugcguguacaacaugauggggaaaagagaaaagaaacuuggagaguucggcaaggccaaagggagccgggccauuugguacauguggcugggcgcucgcuuucucgaguucgaagcccugggauuuaugaaugaggaucacugguucuccagagaaaacucucugagcggcgucgagggggagggacuccauaagcugggcuauauccuucgggacauuuccaaaauccccgggggaaauauguacgcugaugacaccgccggcugggauacacgcauuaccgaagacgaucugcagaacgaggcgaagaucacagacaucauggaaccugagcacgcccuccuggcuaagucuauuuuuaaacuuaccuaucagaauaaggugguuagagugcaacggcccgccaaaaacgggacggucauggaugugaucagccgcagagaccagcggggcuccggacaggugggcaccuacgggcugaauacauucaccaacauggaagcucagcucauucgccaaauggagagcgagggaaucuuuucuccuuccgaacuggagacacccaaccuggccggcagaguucucgauuggcuggaaaagcaugggguggagcggcuuaaaagaauggcgauuagcggagacgacugugucgugaagccgaucgaugaccgcuucgccaccgcucugacggcccucaaugauaugggcaagguucggaaagacaucccucagugggaacccucuaagggguggaacgauuggcaacaggugccuuuuugcucccaccacuuccaucaacugauuaugaaagacggcagagagaucgucgugcccugucgcaaucaggaugagcuugucggacgggcuagagugagccagggcgccggguggucccugcgcgaaacagcuugccucggaaagucuuaugcccagauguggcaacugauguacuuucaccggagagaccugcgccucgcggccaacgcuauuuguagcgccguuccuguggauuggguccccaccucccggacaaccuggagcauccaugcccaccaucaguggaugacgaccgaggacaugcugucuguguggaauagaguuuggauugaagagaacccguggauggaagauaaaacacacaucuccagcuggggcgacgugccuuaucuugggaagcgcgaggaccaguggugcggaucucugauuggccucaccgcucgggccacaugggcgaccaauauccaagucgcuaucaaccaggugagacggcugauugggaaugagaacuaccuugauuacaugacaagcaugaagagauucaaaaaugaauccgaccccgagggcgcccugugguga

SEQ ID NO: 19202 - RNA, 9879 nt, Artificial Sequence
  derived and/or modified CDS sequence (opt5) from DENV-1__GU131759__SS-prME
agcgugaccaugcugcugaugcugaugcccaccgcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucuuuuacauucauuaagaccacguuuucccuccacuaugccuggaagacaauggcuaugguucugagcaucgugucucuguucccccuuugucuguccaccaccagccagaaaacaaccuggcucccugugcugcucgggucucugggaugcaagccgcuuacaauguuccugauugccgagaauaaagucuggggcagaaaguccuggccccugaacgaaggcaucauggcgguggggauuguuagcauccuccuguccagccuucugaaaaacgaugugccucucgccggaccccugaucgcuggcgggaugcucauugccuguuacgucaucucuggaagcuccgcugaccugucucuugagaaggccgccgaggugagcugggaagaggaagcugagcauuccggcgcgucucacaauauucugguugaagugcaggaugacgggacgaugaaaaucaaggaugaggagcgggacgauacccugacaauucuccugaaggccacccuucuggcugucagcggaguguauccucucuccauccccgccacacuguuugucugguacuucuggcagaaaaagaaacaacgcucuggcgugcucugggacaccccuuccccucccgaaguugagagagccgugcuggaugacggcaucuaucggauuaugcagcgcgggcuucugggaagaucccaggucggcguggggguuuuucaggaaaacguguuccauacgauguggcacgucacccggggagcugugcugauguaccaaggcaagcgccucgagcccagcugggccucugugaaaaaggaccugaucuccuacgggggaggcuggagacuucagggcagcuggaauacaggggaggaaguucaggucauugcgguggagcccggaaagaacccuaaaaaugugcagaccgcucccggcacauuuaagaccucugaaggggaggucggagccaucgcccuggauuucaaaccgggcacauccgggagcccuauugugaaccgggaaggaaagaucguuggccucuauggcaaugggguggucacgaccuccggaacauacgugucugcuauugcccaagcgaaagcuagccaggagggcccccugccugagaucgaagacgagguuuuuagaaagcgcaaccucaccaucauggaucugcaccccggguccggaaagacccggagauaucuucccgccauugugcgcgaagccaucaaacggaagcugagaacacugauucucgcuccuacgcgcgucguggccagcgagauggcugaagcccugaaaggcaugccgauccgguaccagaccacagcgguuaagucugagcauaccgggaaagagauuguggaccuuaugugccacgccacauucaccaugagacugcucucccccguccgcgugccuaauuauaacaugaucaucauggaugaagcucauuuuacggaccccagcucuauugccgcucggggcuacaucagcacaagagugggaaugggcgaggccgccgcuauuuucaugaccgcgaccccucccggguccgucgaagccuuuccucaaucuaaugcuguuauccaggaugaggaacgggacauuccggagcgcagcuggaacuccggauaugaguggaucacagauuuccccggcaagaccgugugguucgugccuucuaucaagagcgggaaugacauugccaacugucugcgcaagaauggaaagcgggucauccagcugucccgcaaaacauuugauaccgaauaccagaagacgaaaaacaacgacugggacuacgugguuacaaccgauauuagcgagaugggcgccaauuucagagcugaccgggugaucgaucccagacgcugccucaagccugucauucuuaaggacgggcccgaacgggugauccuggccggcccgaugccuguuacaguggcgucugcugcccaaagacgcggacggauuggcagaaaccacaauaaagagggggaucaguauaucuacaugggacagccccugaacaaugacgaggaucaugcccacuggaccgaagcuaagaugcuccuggacaacaucaauacgcccgagggcauuaucccugcccuuuuugaacccgagcgcgaaaaauccgcggccauugauggggaguaucggcugagaggagaggcucgcaagaccuucgucgaacucaugagacggggcgaccugccuguguggcugagccacaaagucgccuccgagggguuucaguacucugaucgcagauggugcuucgacggcgaacggaacaaucaagugcucgaggaaaacauggauguugagaucuggacaaaggagggagaacgcaagaaacuuagaccgcgguggcuggacgcuagaaccuauagcgacccccuggcccuccgcgaguuuaaagaguucgcugccggccggagauccgugucuggggaucugauucuugagaucggaaaacugccucagcaucucacacagcgcgcgcagaaugcccuggacaaccuggugaugcuccacaauagcgaacaaggcgggcgggcuuacagacaugccauggaggagcuucccgauaccaucgaaacacugaugcugcucgcucugauugccguccuuaccggaggcguuacgcuguuuuuccucuccggccgggggcugggaaagacaagcaucggccugcucugugugauggccucuuccgugcuucuguggauggcuagcgucgagccucacuggauugcggccucuaucauucuggaauuuuuccucauggugcugcuuauccccgagccggaccgccagagaaccccucaggauaaccagcuggcuuauguugugaucgggcuccuguuuaugauucugaccgucgccgccaaugagaugggacuccuugaaacaaccaaaaaggaccugggcaucgggcacgcugccguggagaaccaucaccaugcggccaugcuggaugucgaccuccaccccgcuuccgccuggacacuguacgcuguggccacgaccauuaucacaccuaugaugcggcauaccauugaaaacacaaccgcgaauaucagccuuacggccauugcuaaccaagccgcuauccugaugggacucgauaaaggcuggcccaucucuaagauggacauuggcguuccucugcuggcccucgggugcuacagccaggugaauccccuuacccugacagcugccguccugaugcucguggcgcacuaugccaucauuggaccgggccugcaggcuaaggccacccgcgaggcucagaagagaacagccgccgggaucaugaagaacccuaccguugauggaauuguggcgaucgaccuugaucccgucguguacgacgcuaaauucgaaaagcagcugggccagaucaugcuccugauucuguguacgucccagauccuccuuaugcggacaaccugggcccugugcgagucuauuacacuggcuaccgggccccucaccacacugugggagggaagcccuggcaaauucuggaauacgaccaucgccguguccauggccaacauuuuucgcggcagcuaucuugcuggggccggacuggcguucucccucaugaagucucugggcgggggaagacggggcacaggggcccaaggagaaacccugggcgagaaguggaaacgccagcucaaucagcuuagcaaguccgaauuuaacacauacaaaagaucuggcaucauggagguugaccggagcgaagcuaaggaggggcugaaaagaggagagaccacgaagcacgccgucucccgcggcacagcuaagcugcggugguucguggaaagaaaucucgugaaaccggaggggaaggucaucgaucugggauguggccgcgggggauggucuuauuacugcgccggccuuaaaaagguuaccgaagugaaaggcuauaccaaagggggacccggccaugaggaaccuauucccauggcgacauacggguggaaccuggugaaacuccacagcggaaaggacgucuuuuucaucccucccgagaagugugauacccugcugugcgacauuggcgaguccagcccuaauccgacaaucgaagaggggcggacgcucagagugcuuaaaaugguugaacccuggcugcgcggaaaccaguuuuguauuaagauccugaauccuuacaugcccucuguggucgagacccucgagcaaaugcagcggaaacauggcggcaugcuggugagaaacccucuuucccgcaauagcacacacgaaauguauuggguuucuugcgggaccggaaacauuguguccgccgucaauaugacaagccggaugcugcucaacagauucaccauggcucaccgcaagcccacguacgagcgggauguggaccugggcgccgggaccagacauguggcugucgaaccggagguugccaaccuggauaucaucggacagcgcauugaaaauaucaaacacgagcauaagucuacauggcacuaugacgaggauaacccuuacaagaccugggcuuaucauggcuccuacgaagugaaacccagcggguccgccagcucuauggugaauggagucgugaagcuccugacaaaacccugggacguuauuccuauggugacccagaucgcgaugacagauaccacgcccuuuggccaacagagagucuucaaggagaaaguggacacacggaccccuaaggccaagcgcggcaccgcucagauuauggaaguuacagccaaauggcuuuggggguuucugagcagaaacaagaaaccgcggaucuguacgagagaggaguucacccggaaggugcgcuccaaugcugccaucggagccgucuuuguggacgagaaccaauggaacucugcgaaagaggcuguugaagaugagagauucugggaccucgugcaccgggaacgcgagcugcacaagcagggcaagugcgccacaugcgucuauaacaugauggggaaaagagaaaagaaacuuggagaguucggcaaggccaaagggagccgggcuauuugguacauguggcugggcgcccgcuuucucgaguucgaagcucugggauuuaugaaugaggaucauugguucuccagagaaaacucucugagcggcguggagggggagggacuccacaagcugggcuacauccuucgggacauuuccaaaauccccgggggaaauauguaugccgaugacaccgcgggcugggauacacgcauuaccgaagacgaucugcagaacgaggccaagaucacagacaucauggaaccugagcaugcucuccuggccaagucuauuuuuaaacuuaccuaccagaauaaggucgugagaguucaacggcccgcuaaaaacgggacggugauggaugucaucagccgcagagaccagcggggcuccggacaggugggcaccuaugggcugaauacauucaccaacauggaagcccagcucauucgccaaauggagagcgagggaaucuuuucuccuuccgaacuggagacacccaaccuggcgggcagagugcucgauuggcuggaaaagcacgggguugagcggcuuaaaagaauggccauuagcggagacgacuguguggucaagccgaucgaugaccgcuucgcuaccgcccugacggcucucaaugauaugggcaaggugcggaaagacaucccucagugggaacccucuaagggguggaacgauuggcagcagguuccuuuuugcucccaccauuuccaccaacugauuaugaaagacggcagagagaucgugguccccugucgcaaucaggaugagcuugugggacgggccagagucagccagggcgcuggguggucccugcgcgaaacagccugccucggaaagucuuacgcgcagauguggcaacugauguauuuucaucggagagaccugcgccucgccgcuaacgccauuuguagcgccgugccuguugauugggugcccaccucccggacaaccuggagcauccacgcucaucaccaguggaugacgaccgaggacaugcugucugucuggaauagaguguggauugaagagaacccguggauggaagauaaaacacacaucuccagcuggggcgacguuccuuaccuugggaagcgcgaggaccaguggugcggaucucugauuggccucaccgcccgggcgacaugggcuaccaauauccaaguggccaucaaccaggucagacggcugauugggaaugagaacuaucuugauuacaugacaagcaugaagagauucaaaaaugaauccgaccccgagggcgcccugugguga

SEQ ID NO: 19203 - RNA, 9879 nt, Artificial Sequence
  derived and/or modified CDS sequence (opt5) from DENV-1__GU131761__SS-prME
agcgugaccaugcugcucaugcugaugcccaccgcccuugcuuuccaccugacgaccagaggaggggaaccucauaugaucguguccaagcaggaacggggaaaaucucuccuguuuaagacaagcgccggcguuaacaugugcacccuuauugcgauggaccugggggaacucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggagguggaggacuacggauucggcauuuuuacgacaaacaucuggcugaaacuucgcgauuccuauacccaggucugcgaccaccggcucaugagcgcggccauuaaagauucuaaggcuguucacgccgacaugggcuacuggaucgaauccgagaaaaaugaaacauggaagcuggccagagcuagcuucaucgaggugaagaccuguauuuggcccaaaucucauacacugugguccaacggggugcucgaaagcgagaugaucauuccgaagaucuauggaggcccuauuucucaacacaauuaccgccccggguacuucacccagacggccggaccuuggcaucugggcaaacuugagcuggauuuugaccucugcgaagggaccacagucgugguugaugagcacugcggaaaccggggccccagccugagaaccacaaccgugacgggcaagaucauccacgaaugguguugccgguccuguacacugccuccccuucgcuucagaggggaggacggaugcugguauggcauggagauucggccggucaaagaaaaggaggaaaaucucgucaagagcaugguuucugcgggguccggagagguggacagcuuuucccugggccugcucuguaucucuauuaugaucgaagaggucaugagaagccgcuggucccggaaaaugcugaugaccgggacacuugcuguguucuuucugcucauuaugggacagcugaccuggaacgaucugaucagacuuugcauuaugguuggcgccaaugccucugaccgcaugggcauggggaccacauaccuggcucucauggccacguucaagaugagaccuauguuugcggugggacugcuguuccggcgccugaccagcagagagguccuucugcucacaaucggccugucccugguggcuucuguggaacuucccaacagccuggaggaacucggggauggacuggccaugggcaucaugauucucaaacugcuuaccgacuuucaaucccaucagcugugggccacacuccugagccugaccuucaucaagacgacauuuucucuucacuaugcuuggaaaaccauggccaugauucuguccaucgucagccucuucccccugugucucucuaccacaucccagaagaccacauggcugccuguucuucuggggagccugggaugcaagccgcucacgauguuucugauugcugagaauaaaaucuggggccggcgcucuuggccccuuaacgaaggcaucauggccguggggauuguguccauccugcucagcucccugcucaagaacgaugucccucuggcgggaccccuuauugccggcgggaugcugaucgcuuguuacgugauuagcggaucuagcgccgaccugucccucgagaaagcugccgagguuucuugggaagaggaagccgagcauagcggcgcuucccacaauauccugguggaaguccaggaugacgggaccaugaagauccaagaugaggagagagacgauacacuuaccauucugcucaaagcgacacugcucgccgugucuggaguuuauccucugagcauccccgcuacccuuuucgugugguacuucuggcagaagaaaaagcagcgguccggcguccugugggacacgccuucucccccggaaguggagcgcgccguccuggaugacggcauuuauagaaucaugcagcgggggcuccugggacgcagccaagugggcguugggguguuucaggaaaacgucuuccauaccauguggcacgugacaagaggagccguucuuauguaccagggcaagcggcuggagccuuccugggcuagcgugaaaaaggaccucauuucuuacgggggaggcuggagacugcagggcuccuggaauaccggggaggaaguccaagugaucgccguggagcccggcaagaacccuaagaauguucagacagcgcccggcaccuuuaaaacaccggaaggggaggucggagcuauugcccucgauuucaagccuggcacgagcgggucucccaucgugaaccgcgaaggaaagaucgugggccuguauggcaauggggucgugaccacauccggaaccuacguuagcgccauugcucaggccaaagcgucccaagagggcccucuucccgagaucgaagacgagguguuucggaagagaaaccugaccauuauggaucugcaccccgggucuggaaaaacacgccgguaucucccugcuaucgucagagaagccauuaagcgcaaacugcggacgcuuauccuggccccgaccagagugguugcuagcgagauggccgaagcucucaagggcaugcccauccgcuaccagacaaccgccgugaaguccgagcauacagggaaagagauugucgaccugaugugccacgcgaccuucacgaugcggcugcucagcccugugagaguucccaauuauaacaugaucauuauggaugaagcccauuuuacagacccuucuuccaucgcugcccggggcuacauuagcacccgcgugggaaugggcgaggcugccgccaucuucaugaccgcuacacccccugggucugucgaagcguuuccgcagagcaaugccgugauccaggaugaggaaagagacauucccgagcgguccuggaacucuggauaugaguggaucaccgauuucccuggcaagacagugugguuuguccccagcauuaaauccgggaaugacaucgcuaacugucuucgcaagaauggaaaaagaguuauucaacugucucggaagaccuucgauacggaauaccagaagaccaagaacaacgacugggacuacguggugaccacagauaucagcgagaugggcgccaauuucagagccgaccgcgucauugauccucggagaugccugaagcccgugauccucaaagacgggccggaacgcguuauccuggcuggcccuaugcccgugaccgucgccuccgcggcucagcggagaggacgcauuggccggaaccacaauaaggagggggaucaguauaucuacaugggacaaccccuuaacaaugacgaggaucaugcccacuggacggaagccaaaaugcugcucgacaacauuaauaccccugagggcaucauucccgcucuguuugaaccugagagagaaaagagcgccgcgaucgauggggaguaucgccugagaggagaggcccggaagacauucguggaacucaugcgcagaggcgaccuuccgguuuggcugucuuacaaaguggcuuccgagggguuucaguauagcgaucggcgcuggugcuucgacggcgaaagaaacaaucagguccuggaggaaaacauggauguggagaucuggaccaaggagggagaacggaaaaagcucagaccccgcuggcuggacgcccggacauacuccgacccucuugcucugagagaguuuaaagaguucgccgcuggccgccggucugucagcggggaucucauucuggagaucggaaagcugccccagcaccucacccaaagagcccagaaugcgcuugacaaccuggugaugcugcauaauuccgaacagggcgggcgggccuaucgccacgcuauggaggagcucccugauacaauugaaacccugaugcuucuggcccucaucgcuguucugacgggaggcgugacacuguuuuuccucucuggcagagggcuuggaaaaaccagcauuggccugcugugugugauggccuccagcguccuccuguggauggccucuguugagccccauuggaucgcugcguccaucauucuugaauuuuuccugauggugcuccugaucccggagccugaccggcagcgcacaccccaagauaaccagcuggccuacguggucauugggcuccuuuuuaugauccugacaguggcugccaaugagaugggacugcucgaaaccacaaagaaggaccugggcauugggcacguugccguggagaaccaccaucacgcugccaugcuugaugucgaccugcauccugcgagcgccuggacgcucuacgcuguggccaccacaaucauuacccccaugaugagacacacaaucgaaaacaccacggcuaauaucucucugaccgccauugcgaaccaggccgcuauccugaugggacucgauaaaggcuggccuauuuccaagauggacaucggcgucccccuucuggcccuggggugcuauagccaagugaauccgcucacacugaccgcugccguucuuaugcugguggcucauuacgccauuaucggaccuggccuccaggcgaaagccacacgggaggcucagaagcgcaccgccgcugggaucaugaaaaaccccacggucgauggaauuguggccaucgaccuggaucccguuguguaugacgccaaguucgaaaagcagcugggccaaauuaugcuccuuauccuguguacaucucagauucugcucaugagaaccacaugggcgcugugcgagagcaucacccuugcuaccgggccucugacaacgcucugggagggauccccgggcaaauuuuggaauaccacaaucgccgucucuauggcuaacauuuuccggggcagcuaccuggccggggccggacuggcuuucucccucaugaaaagccuuggcgggggacgcagaggcaccggggcccagggagaaacacugggcgagaaauggaagcggcagcugaaucaacucuccaaaucugaauuuaacaccuauaagagaagcggcaucauggagguggaccgcuccgaagcgaaggaggggcugaaacggggagagacgacaaagcacgccgugucuagaggcaccgcuaaacuucgcugguucguugaacggaaucuggucaagcccgaggggaaagugauugaucucggauguggcagagggggauggagcuacuauugcgccggccugaagaaggugaccgaagucaaaggcuacacaaaaggcgggccugggcacgaggaacccaucccuauggcuaccuacggguggaaccugguuaaacuccauuccggaaaggacguguuuuucauucccccugagaaaugugauacacuucugugcgacaucggcgagucuagcccgaaucccacgauugaagaggggcgcacccugcgggugcucaagauggucgaaccuuggcugagaggaaaccaguuuuguaucaaaauccuuaaucccuauaugccuuccgugguugagacacuggagcagaugcagcgcaagcacggcggcaugcucgugcggaacccccugagcagaaauucuacccaugaaauguacugggucuccugcgggacaggaaacauugugagcgccguuaauaugaccucucgcaugcugcucaaccgguucacgauggcgcacagaaagccgaccuaugagcgcgauguggaccugggcgccgggacaagacacgucgcuguggaaccugagguggccaaccuugauaucauuggacaacggaucgaaaauauuaaacaugagcacaaguccaccuggcauuacgacgaggauaaccccuauaaaacaugggcuuaccacggcagcuaugaagucaagcccucuggguccgccagcuccaugguuaauggaguggugaaacugcucaccaagccuugggacgucauccccauggugacacagaucgcuaugaccgauacgacaccuuuuggccagcaacgcguuuucaaggagaaaguggacaccagaaccccgaaggccaaacggggcacagcgcagauuauggaagucacggccaaguggcuguggggguuucuuagcagaaacaaaaagccccggaucuguacccgcgaggaguucacaagaaaggugcggucuaaugcugccauuggagcuguuuuuguggacgagaaccaguggaauagcgccaaagaggccgucgaagaugagcgcuucugggaccuggugcauagagaacgggagcuccacaagcagggcaaaugcgcgaccugcguuuacaacaugauggggaagcgcgagaagaagcugggagaguuuggcaaggcuaaaggguccagagccaucugguacauguggcugggcgcccgguuccucgaguucgaagcucugggauuuaugaaugaggaucacugguucucucgcgaaaacagccuuuccggcguggagggggagggacugcauaagcucggcuauauucugagagacaucucuaaaaucccugggggaaauauguacgccgaugacacagcuggcugggauacccggauuacagaagacgaucuucaaaacgaggcccgcaucaccgacauuauggaacccgagcacgcgcugcucgccaagagcaucuuuaaacugacguaucagaauaaggucgugagaguccagcggccugcuaaaaacgggaccgugauggauguuauuucccgcagagaccagcggggcucuggacaagugggcacauacgggcugaauaccuucacaaacauggaagcccagcucaucagacagauggagagcgagggaaucuuuucccccagcgaacuggagaccccgaaccuugcugaacgcguccuggauuggcucgagaaguauggcguggaacggcugaagagaauggccauuucuggggacgacugugugguuaaaccuaucgaugaccgcuucgcgacggcccuuacagcucugaaugauaugggaaaggugcggaaagacauuccccagugggagccuuccaagggcuggaacgauuggcaacagguccccuuuugcagccaucacuuccaccagcucaucaugaaagacgggagagagauugugguuccuugucgcaaucaggaugaacuggugggccgggccagagucucucaaggagcuggcuggucccugcgcgagaccgccugccucggaaagagcuacgcucagauguggcagcugauguauuuucaucggagagaccuucgccuggccgcgaacgccaucuguuccgcugugcccgucgauuggauuccgacaucucggaccacguggagcauccacgcccaucaccaauggaugaccacagaagacaugcucuccguguggaauagaguuuggaucgaggaaaacccuuggauggaggauaagacccauauuagcucuuggggagacgugcccuaccugggcaaacgggaggaccaguggugcgggucccuuaucggacugacagccagagcuaccugggccacaaauauucaggucgcgaucaaccaggugcgccggcucauuggcaaugaaaacuaccuggauuauaugaccagcaugaagagauucaaaaaugagucugaccccgaaggggcucugugguga

SEQ ID NO: 19204 - RNA, 9879 nt, Artificial Sequence
  derived and/or modified CDS sequence (opt5) from DENV-1__GU131762__SS-prME
agcgugaccaugcugcucaugcugaugcccacagcccuugcuuuccaccugacgaccagaggcggggaaccucauaugaucguguccaagcaggaacggggaaaaucucuccuguuuaagacaagcgccggcguuaauaugugcacccuuauugcgauggaccugggggaguucugugaagauacaaugaccuacaaaugcccgcgcaucacagaagcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaugucucucuccaugaccuguaucgccguuggccuggugacacuguaccuuggggucauggugcaggcugauagcggaugcguuauuaacuggaaaggccgcgaacucaaguguggguccggaaucuuugugaccaaugagguccacacauggaccgaacaauauaaguuccaggccgacucuccuaaacggcugagcgcggccauuggcaaggcuugggaggagggggugugcggcaucagauccgccacacgccuggaaaacaucauguggaaacagauuucuaacgagcucaaucauauccugcuugaaaacgacaugaaguuuaccguuguggucggagauguggcuggcauucuggcccaggggaaaaagaugauccggccgcaacccauggaguacaaauauagcuggaaguccuggggaaaggccaaaauuaucggcgcugacgugcagaauacgacauucaucauugaugggccuaacacccccgaauguccugacgaucagagagcguggaauaucugggaggucgaggacuacggauuuggcauuuucaccacaaacaucuggcucaagcugcgcgauagcuauacccagguuugcgaccaccggcugaugucugccgcuauuaaagauuccaaggccgugcacgccgacaugggcuacuggaucgaaagcgagaaaaaugaaacguggaaacuugcuagagccucuuucaucgaggugaagacauguauuuggcccaaaucccauacccucuggagcaacgggguccuggaaucugagaugaucauuccgaagaucuauggaggcccuauuagccaacacaauuaccgccccggguacuuuacacagaccgcgggaccuuggcaucugggcaaacucgagcuggauuucgaccuuugcgaagggacaaccgugguuguggaugagcacugcggaaaccggggccccucccugagaacgaccacagucaccggcaagaucauccacgaaugguguugccggagcuguacacucccuccccugcgcuuuaaaggggaggacggaugcugguauggcauggagauuagaccggugaaggaaaaggaggaaaaucugguuaaaucuaugguguccgcugggagcggagaggucgacuccuucucucuuggccuccuguguaucagcauuaugaucgaagaggugaugcgguccagauggucucgcaagaugcugaugaccgggacgcucgccgucuuuuuccugcuuauuaugggacagcugacauggaacgaucucauccggcugugcauuauggugggcgccaaugcuagcgacagaaugggcauggggaccacauaccuggcccuuauggcgaccuuuaaaaugcgcccuauguucgcugucggacugcucuuuagacggcugaccucccgcgaggugcuccugcuuacaaucggccugucucucguggccagcgucgaacugcccaacucccuggaggaacuuggggauggacuggccaugggcaucaugauucucaagcugcucacggacuuccaaagccaucagcugugggcuacccuucugucucucacauuuaucaaaaccacauucucccugcacuaugccuggaagaccauggcuaugguucugagcauugugucucuuuuuccccugugucucuccacgacaagccagaagaccaccuggcugccugugcuccuggggucucuuggaugcaaaccgcugacaauguuccugaucgccgagaauaagauuuggggcagaaaauccuggccccucaacgaaggcaucauggcggucgggaucgugagcauucugcuuuccagccugcucaagaacgauguuccucuggccggaccccucaucgcuggcgggaugcugauugccuguuacgugaucucuggaagcuccgcugaccuuucucuggagaaagccgccgaggucagcugggaagaggaagcugagcauuccggcgcgucucacaauauucugguggaaguucaggaugacgggaccaugaagaucaaagaugaggagcgggacgauacacucacgauccugcuuaaggccacccugcucgcugugagcggagucuauccucuguccauucccgccacacucuuccugugguacuuuuggcaaaagaaaaagcagcgcucuggcgugcuuugggacaccccuuccccucccgaagucgagagagccgugcuggaugacggcaucuaucggauuaugcagcgcgggcugcucggaagaucccagguuggcgugggggucuuccaagaaaacguguuucauacaauguggcacguuacccggggagcugugcugauguaccagggcaaacgccuugagcccagcugggccucugucaagaaagaccugaucuccuacgggggaggcuggagacuccagggcagcuggaauacgggggaggaaguccaggugauugcgguugagcccggaaagaacccuaagaauguccaaaccgcucccggcacauucaaaaccucugaaggggaggugggagccaucgcccuggauuuuaagccgggcacauccgggagcccuauugugaaccgggaaggaaaaaucgucggccucuauggcaauggggugguuaccacauccggaacguacgugucugcuaucgcccaggcgaaggcuagccaggagggcccccugccugagauugaagacgaggucuucagaaaacgcaaccuuaccaucauggaucugcaccccggguccggaaagacacggagauaucugcccgccauugugcgcgaagccaucaagcggaaacucagaacccugauucuugcuccuacccgcguuguggccagcgagauggcugaagcccugaagggcaugccgauccgguaccaaacaacggcggucaaaucugagcauaccgggaaggagaucguggaccucaugugccacgccacauuuaccaugagacugcugucccccguucgcgugccuaauuauaacaugauuaucauggaugaagcucauuucacagaccccagcucuauugccgcucggggcuacaucagcaccagagucggaaugggcgaggccgccgcuauuuuuaugacggcgacaccucccggguccguggaagccuucccucagucuaaugcugugauccaggaugaggaacgggacaucccggagcgcagcuggaacuccggauaugaguggauuaccgauuuucccggcaaaaccgucugguucguuccuucuaucaagagcgggaaugacauugccaacugucucagaaagaauggaaaacgggugauccagcuuucccgcaagacauucgauaccgaauaccagaagacaaagaacaacgacugggacuacguggucaccacggauauuagcgagaugggcgccaauuuuagagcugaccgggugaucgaucccagacgcugccugaaaccuguuauucugaaggacgggcccgaacgggugauccucgccggcccgaugccugucacaguggcgucugcugcccagagacgcggacggaucggcagaaaccacaauaaggagggggaucaguauauuuacaugggacagccccugaacaaugacgaggaucaugcccacuggaccgaagcuaaaaugcuucuggacaacaucaauacacccgagggcauuaucccugcccucuucgaacccgagcgcgaaaaguccgcggccauugauggggaguaucggcugagaggagaggcucgcaaaaccuuuguugaacugaugagacggggcgaccucccuguguggcuuagcuacaaggucgccuccgagggguuccaauauucugaucgcagauggugcuuugacggcgaacggaacaaucaggugcuggaggaaaacauggaugucgagaucuggacgaaagagggagaacgcaagaaacugagaccgcgguggcucgacgcuagaguguacagcgacccccuggcccuucgcgaguucaaggaauuugcugccggccggagauccguuucuggggaucugauccucgagauuggaaagcugccucagcaccugacccagcgcgcgcaaaaugcccucgacaaccuugugaugcugcauaauagcgaacagggcgggcgggcuuauagacacgccauggaggagcugcccgauacaaucgaaacccucaugcugcuugcucugauugccgugcucacaggaggcgucacccuguucuuucuguccggccgggggcucggaaaaacaagcaucggccuucuguguguuauggccucuuccgugcugcucuggauggcuagcguggagccucauuggauugcggccucuaucauccuggaguucuuucuuaugguccugcucauucccgagccggaccgccagagaaccccucaggauaaccaacuggcuuacgugguuaucgggcugcuguucaugauucuuacgguggccgccaaugagaugggacugcuggaaacaaccaagaaagaccucggcaucgggcacgucgcuguggagaaccaccaucacgccgcgaugcuggaugucgaccuucaucccgccuccgcuuggacccuguacgccguggcuacaaccauuaucacaccuaugaugcggcacacgauugaaaacaccacagccaauaucagccucaccgcgaucgccaaccaggcugccauucugaugggacuggauaagggcuggcccaucucuaaaauggacauuggcguuccucuccuugcucuggggugcuauagccaggugaauccccugacacucaccgccgcuguccugaugcuuguggcccauuacgcgaucauuggaccgggccugcaagccaaggcuacgcgcgaggcccagaagagaaccgcugccgggaucaugaaaaacccuacaguugauggaaucguggccauugaccucgaucccgucguguaugacgcgaaguuugaaaaacagcugggccagaucaugcugcucauucuuuguaccucccaaauccugcugaugcggacaaccugggcucucugcgagucuauuacgcuggccacagggccccuuaccacacugugggagggaagcccuggcaaguucuggaauaccaccaucgcuguguccauggccaacaucuuccgcggcagcuaccucgccggggcuggacuggccuuuucccugaugaaaucucucggcgggggaagacggggcacaggggcgcagggagaaacgcuuggcgagaaguggaagcgccagcugaaucagcugagcaaauccgaguucaacaccuauaagagaucuggcauuauggagguugaccggagcgaagccaaagaggggcucaagagaggagagacaaccaaacacgcugucucccgcggcacagccaagcugcggugguuuguggaaagaaaucuugugaagccggaggggaaagucaucgaucugggauguggccgcgggggauggucuuacuauugcgcuggccucaagaaaguuaccgaagugaagggcuacacgaaagggggacccggccacgaggaaccuauucccauggccacauacggguggaaccuggugaagcugcauagcggaaaagacgucuucuuuaucccucccgagaagugugauacccuccuuugcgacauuggcgaguccagcccuaauccgaccaucgaagaggggcggacacugagagugcugaagaugguugaacccuggcuccgcggaaaccaauucuguauuaaaauccugaauccuuauaugcccucuguggucgagacccuugagcagaugcagcggaagcacggcggcaugcuggugagaaacccucucucccgcaauagcacacaugaaauguacuggguuucuugcgggacgggaaacaucguguccgcggucaauaugaccagccggaugcugcugaacagauuuacaauggcccaccgcaaacccaccuaugagcgggauguggaccucggcgcugggacaagacacguggccgucgaaccggagguugcuaaccuggauauuaucggacagcgcauugaaaauaucaagcaugagcacaaaucuaccuggcauuacgacgaggauaacccuuauaagacgugggccuaccacggcuccuaugaagugaagcccagcggguccgcuagcucuauggugaauggagucgugaaacuucugaccaagcccugggacguuauuccuauggugacacaaaucgccaugaccgauacaacccccuucggccagcagagagucuuuaaagagaagguggacacacggaccccuaaagcgaagcgcggcacggcccaaaucauggaaguuacagcuaaguggcucuggggguuccugagcagaaacaaaaagccgcggauuuguaccagagaggaauuuacccggaaagugcgcuccaaugccgcuaucggagccgucuucguggacgagaaccaguggaacucugccaaggaggcgguugaagaugagagauuuugggaccuugugcaucgggaacgcgagcugcacaaacagggcaagugcgcuacaugcgucuacaacaugauggggaagagagagaagaagcucggagaguucggcaaagccaaggggagccgggccauuugguacauguggcugggcgcucgcuuccuggaguuugaagcccucggauucaugaaugaggaucacugguuuuccagagaaaacucucugagcggcguggagggggagggacuucauaaacugggcuauauccuccgggacauuuccaagauccccgggggaaauauguacgcugaugacacggccggcugggauacccgcaucacagaagacgaucugcagaacgaggcgaaaauuaccgacaucauggaaccugagcacgcccuucuggcuaagucuauuuucaagcucacauaucaaaauaaagucgugagaguucagcggcccgccaagaacgggaccgugauggaugucaucagccgcagagaccagcggggcuccggacaggugggcacauacgggcugaauaccuuuacgaacauggaagcucaacugauucgccagauggagagcgagggaaucuucucuccuuccgaacucgagacccccaaccuggccggcagagugcuugauuggcuggaaaaacaugggguugagcggcucaagagaauggcgaucagcggagacgacuguguggucaaaccgauugaugaccgcuuugccacagcucugaccgcccuuaaugauaugggcaaggugcggaaggacaucccucagugggaacccucuaaaggguggaacgauuggcagcaaguuccuuucugcucccaccacuuucaucagcugauuaugaaggacggcagagagaucgugguccccugucgcaaucaggaugagcucgugggacgggcuagagucagccagggcgccggguggucccugcgcgaaacagcuugccugggaaaaucuuaugcccaaauguggcagcucauguacuuccaccggagagaccugcgccuugcggccaacgcuauuuguagcgccgugccuguugauugggugcccaccucccggacgacauggagcauccaugcccaccaucaguggaugaccacagaggacaugcugucugucuggaauagaguguggauugaagagaacccguggauggaagauaagacccacaucuccagcuggggcgacguuccuuaucucgggaaacgcgaggaccaauggugcggaucucugaucggccuuacggcucgggccaccugggcgacaaauauucagguggcuaucaaccaggucagacggcugauugggaaugagaacuaccucgauuacaugaccagcaugaagagauuuaagaaugaauccgaccccgagggcgcccugugguga

SEQ ID NO: 19205 - RNA, 9879 nt, Artificial Sequence
  derived and/or modified CDS sequence (opt5) from DENV-1__GU131763__SS-prME
uccgugaccaugcugcucaugcugaugcccaccgcccuugcuuuccaccugacgaccagaggcggggaaccucauaugaucgucacaaagcaggaacggggaaagucccuucuguuuaagaccucugccggcguuaauaugugcacccuuauugcgauggaccugggggaacucugugaagauaccaugacauacaagugcccgcgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguucacagugguugugggagaugucgugggcauucucgcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaagcugcgcgauuccuacacacagguuugcgaccaccggcuuaugagcgcggccauuaaagauucuaaggcugugcaugccgacaugggcuauuggaucgaauccgagaaaaaugaaaccuggaagcucgccagagcuagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgccggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuucaaaggggaggacggaugcugguacggcauggagauuagaccggugaaggaaaaggaggaaaaucuuguuaaaagcauggugucugcggggcucggagaggucgacuccuuuagccugggccugcucuguaucuccauuaugaucgaagaggugaugcggucuagauggagccgcaagaugcugauggcugggacacuugccguuuuccugcuccugauuaugggacagcugaccuggaacgaucuuauccggcugugcauuauggugggcgccaaugcuuccgacagaaugggcauggggacaaccuaucucgcccugauggcgaccuuuaaaaugcgcccuauguucgcugucggacuccuguuuagacggcuuacaucucgcgaggugcugcuccugacgaucggccugagccuuguggccuccgucgaacugcccaacucucucgaggaacugggggauggacucgccaugggcaucaugauucugaaacuucugaccgacuuccaaagccaccagcucugggcuacacugcugucccuuaccuuuaucaaaacaacccugagccuccauuacgccuggaagacgauggcuaugguucugucuauugugucccucuucccccugugucuuagcacaaccucucagaagaccacauggcugccugugcugcucgggucccugggaugcaaaccgcuuaccauguuucugaucgccgagaauaagauuuggggcagaaaaagcuggccccucaacgaaggcaucauggcggucggggugguuucuauccugcucuccagccugcuuaagaacgaugugccucuggccggaccccugauugcuggcgggaugcucaucgccuguuaugucauuuccggaagcucugcugaccugagccuugagaaagccgccgagguguccugggaagaggaagcugagcacucuggcgcgagccauaauauccugguugaagugcaggaugacgggacaaugaagauuaaagaugaggagcgggacgauacgcucaccauccugcucaaggccacacugcuugcuaucuccggagucuacccucugucuauucccgccacccuguucgugugguauuuuuggcaaaagaaaaagcagcgcagcggcguccucugggacacaccuagcccucccgaaguggagagagccguucuggaugacggcaucuaccggauuaugcagcgcgggcuucugggaagaucucaggugggcgucgggguguuccaagaaaacguuuuccacaccauguggcacgugacgcggggagcuguccucauguaucagggcaaacgccuggagcccagcugggccuccgugaagaaagaccucaucagcuacgggggaggcuggagacugcagggcucuuggaauaccggggaggaagugcagguuauugcggucgagcccggaaagaacccuaagaaugugcaaacagcucccggcaccuuuaaaacaccggaaggggaggugggagccaucgcccuugauuucaagccuggcaccuccgggagccccauugucaaccgggaaggaaaaaucgugggccuguacggcaaugggguugugacaacgucuggaaccuaugucuccgcuaucgcccaggcgaaggcuagccaggagggcccucugcccgagauugaagacgagguguuuagaaaacgcaaccucacaaucauggaucugcaucccggguccggaaagacccggagauaccuuccugccauuguucgcgaagccaucaagcggaaacugagaacccucauucuggcuccgacacgcguggucgccucugagauggcugaagcccugaagggcaugcccauccgguaucaaacgaccgcggugaaaagcgagcacacagggaaggagaucguugaccucaugugccaugccaccuucacaaugagacuucuguccccugugcgcguccccaauuacaacaugauuaucauggaugaagcucacuuuaccgacccuagcucuauugccgcucggggcuauaucuccacgagagugggaaugggcgaggccgccgcuauuuucaugacagcgacacccccugggagcguggaagccuuuccgcagucuaaugcugucauccaggaugaggaacgggacauccccgagcgcagcuggaacuccggauacgaguggauuaccgauuucccuggcaaaacaguuugguuugugcccucuaucaagagcgggaaugacauugccaacugucugagaaagaauggaaaacgggugauccagcucucccgcaagaccuucgauacagaauaucagaagaccaagaacaacgacugggacuacgucgugacgacagauauuucugagaugggcgccaauuuuagagcugaccggguuaucgauccuagacgcugccugaaacccgugauucuuaaggacgggccggaacgggucauccuggccggcccuaugcccgugaccguugcgagcgcugcccagagacgcggacggaucggcagaaaccauaauaaggagggggaucaguacauuuauaugggacagccccucaacaaugacgaggaucacgcccacuggacagaagcuaaaaugcugcuggacaacaucaauaccccugagggcauuauccccgcccucuucgaaccugagcgcgaaaaguccgcggccauugauggggaguaccggcuuagaggagaggcucgcaaaacguucguggaacugaugagacggggcgaccugccggucuggcucagcuauaagguggccucugagggguuucaauacuccgaucgcagauggugcuucgacggcgaacggaacaaucagguccuggaggaaaacauggauguggagaucuggaccaaagagggagaacgcaagaaacuuagaccccgguggcuggacgcuagaacauauagcgacccucucgcccugcgcgaguuuaaggaguucgcugccggccggagauccguuucuggggaucugauccucgagauuggaaaacuuccccagcaucugacccagcgcgcgcaaaaugcccuggacaaccucgugaugcugcacaauagcgaacagggcgggcgggcuuacagacaugccauggaggagcuuccugauacaaucgaaacccugaugcuccuggcucugauugccgugcucacaggaggcgucacccucuuuuuccuguccggccgggggcugggaaaaacgucuaucggccuccuguguguuauggccagcuccgugcuucuguggauggcuagcguggagccccacuggauugcggccucuaucauccucgaauuuuuccugaugguccugcucauuccggagccugaccgccagagaacaccccaggauaaccaacuugcuuaugugguuaucgggcugcuguuuaugauucucaccguggccgccaaugagaugggacugcuugaaaccacaaagaaagaccugggcaucgggcacgucgcuguggagaaccaucaccaugccaccaugcucgaugucgaccugcacccugcguccgccuggacacuguacgcuguggccacgaccauuaucacacccaugaugcggcauaccauugaaaacacaaccgcuaauaucagccucacggccaucgcgaaccaggccgcuauucuuaugggacuggauaagggcuggccuaucucuaaaauggacauuggcguuccccugcucgcccuggggugcuacucccaggugaauccgcuuacccugacagcugccguccucaugcugguggcucacuaugccaucauuggaccuggccugcaagcgaaggccacccgcgaggcucagaagagaacagccgcugggaucaugaaaaaccccaccguugauggaaucguggccauugaccucgaucccgucguguacgacgccaaguucgaaaaacagcuuggccagaucaugcugcugauucucuguacgagccaaauccugcuuaugcggacaaccugggcgcugugcgagucuauuacacucgcuaccgggccucugaccacacugugggagggaagcccgggcaaguuuuggaauacgaccaucgccguguccauggcuaacaucuuccgcggcucuuaucucgccggggccggacuugcuuuuagccugaugaaaucccugggcgggggaagacggggcacaggggcccagggagaaacccucggcgagaaguggaagcgccagcugaaucagcuuagcaaauccgaguucaacauuuacaagagaucuggcaucauggagguugaccggagcgaagcgaaagaggggcugaagagaggagagacaacccgccacgccgucucccggggcacggcuaaacucagaugguucguggaacgcaaucuggugaagcccgaggggaaggucauugaucugggauguggcagagggggauggucuuauuacugcgccggccucaaaaagguuacagaagugaaaggcuauaccaaagggggaccuggccaugaggaacccaucccuauggcuaccuacggguggaaccuugugaaacugcacagcggaaaggacgucuuuuucacacccccugagagaugugauacccugcucugcgacauuggcgaguccucuccgaaucccacaaucgaagaggggcgcacgcugcgggugcuuaaaaugguugaaccuuggcugagaggaaaccaauuuuguauuaagauccucaaucccuacaugccuagcguggucgagacccuggagcagaugcagcgcaagcauggcggcaugcuggugcggaacccccucuccagaaauagcacacacgaaauguauuggguuucuugcgggaccggaaacaucguguccgccgucaauaugacaagccgcaugcugcuuaaccgguucaccauggcgcacagaaaaccgacguacgagcgcgauguggaccugggcgccgggaccagacauguggcugucgaaccugagguugccaaccucgauauuaucggacagcggauugaaaauaucaagcacgagcauaaaucuacauggcacuaugacgaggauaaccccuacaagaccugggcuuaucauggcuccuacgaagugaaacccagcgggucugccuccagcauggugaauggagucgugaagcugcuuacaaagccuugggacguuauucccauggugacccaaaucgcuaugacagauaccacgccuuuuggccagcagcgcgucuucaaagagaagguggacacaagaaccccgaaagccaagcggggcaccgcgcaaaucauggaaguuacagccagauggcuguggggguuucucucccggaacaaaaagccccgcauuuguacgagagaggaguucacccggaaggugcgcagcaaugcugccaucggagcugucuuuguggacgagaaccaguggaacucugccaaagaggccguugaagaugagagauucugggaccuggugcagaaggaacgggagcugcacaaacagggcaagugcgcgacaugcgucuauaacaugauggggaaacgcgaaaagaagcucggagaguuuggcaaagcuaaggggagcagagccauuugguacauguggcugggcgcccgguuccuugaguuugaagcucugggauucaugaaugaggaucacugguucucccgcgaaaacucucucagcggcguggagggggagggacugcauaaacuuggcuacauccugagagacauuuccaagaucccugggggaaauauguaugccgaugacaccgcuggcugggauacacggaucaccgaagacgaucuccaaaacgaggccaaaauuacagacaucauggaacccgagcacgcgcugcuggccaccucuauuuuuaagcucacguaccagaauaaagucgugcgcguucagagaccugcuaagaacgggaccgugauggaugucaucagccggcgcgaccagagaggcuccggacaagugggcacauaugggcugaauaccuucacaaacauggaagcccagcuuauucggcagauggagucugagggaaucuuucugcccagcgaacucgagaccccgaaccuggcugaaagagugcuugauuggcuggagaagcauggcguugaacgccucaaacggauggccaucuccggggacgacuguguggucaagccuauugaugacagauucgcgacggcccugacagcucugaaugauaugggaaaagugcgcaaggacaucccccagugggagccuagcaaaggcuggaacgauuggcaacagguucccuuuugcucucaccacuuccaucagcucauuaugaaggacgggcgggagaucguggucccuuguagaaaucaggaugaacuggugggccgcgcccgggucucccaaggagcuggcuggagccuuagagagaccgccugccuggggaagucuuacgcucagauguggcagcucauguauuuucaccgccgggaccugagacuugccgcgaacgccauuuguuccgcugugcccguugauugggugccgacaagccgcaccacgugguccauccaugcccaccaucaauggaugaccacagaagacaugcugucugucuggaauaaaguguggauugaggaaaacccuuggauggaggauaagacccacguuagcuccuggggagacgugcccuaccucggcaaacgggaggaccaguggugcgggagccugaucggacugacagccagagcuaccugggccucuaauauccaggucgcgauuaaccaggugcggagacucaucggcaaugaaaacuaucuggauuacaugacauccaugaagcgcuucaaaaaugagggggaccccgaaggcgcucuuugguga

SEQ ID NO: 19206 - RNA, 9879 nt, Artificial Sequence
  derived and/or modified CDS sequence (opt5) from DENV-1__GU131766__SS-prME
agcgugaccaugcugcucaugcugaugcccaccgcccuugcuuuccaccugacgacccggggcggggagccucauaugaucgucacaaagcaggaacggggaaagucccuccuguuuaagaccucugccggcguuaacaugugcacacuuauugcgauggaccugggggagcucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccauugaacacggaaccacagcuaccaucacgccccaggccccuaccagcgagauucagcucacagacuacggcgcccugacccuggauuguucuccccggacaggccucgacuucaacgaaaugguucugcuuaccaugaaggagaaauccuggcuggugcauaagcagugguuucucgaucugccucuucccuggacgagcggggcuuccacaucucaagagaccuggaaucgccaggaccugcucgucacauucaaaaccgcgcacgccaagaagcaggaaguggucgugcugggaagccaagagggcgcuaugcacaccgcccugacaggggccacggaaauccagaccuccggaacaaccacaauuuuugcuggccaucucaaaugcagacugaagauggauaaacuuacccugaaggggaugagcuauguuauguguacgggcucuuucaaacucgagaaggaaguggccgagacacagcacggaaccguccuggugcagaucaaguacgagggcaccgacgcgccgugcaaaaucccuuucuccacacaagaugaaaaggggguuacccagaacggacggcugauuacagcuaaucccaucgugauugacaaagagaagccugucaacaucgaagccgagccgcccuuuggcgagagcuauauugugaucggggccggagaaaaagcucuuaagcucucuugguucaagaaaggcagcuccaucgggaagauguuugaggccacggcuagaggcgcccgccggauggcgauucugggagauaccgccugggacuucggcucuaucgggggaguguuuacaagcauuggcaaacugguucaucagaucuucgggaccgcuuacggaguccucuuuuccggcgugagcuggacaaugaagauugggaucggcgugcugcuuaccuggcugggacucaauucuagauccacgagccugucuaugaccuguauugccgucggccuggugacacuuuaccucgggguuauggugcaggcugauuccggaugcgucaucaacuggaaaggccgcgaacugaagugugggagcggaaucuucgugaccaaugagguucacacauggaccgaacaauauaaguuucaggccgacuccccuaaacggcugucugcggccauuggcaaggcuugggaggagggggugugcggcaucagaagcgccacacgccucgaaaacauuauguggaaacagaucuccaacgagcugaaucauauucuucuggaaaacgacaugaaguucaccgucgugguuggagauguggucggcauccucgcucaggggaaaaagaugauccggccgcaacccauggagcacaaauacucuuggaaaagcuggggaaaggccaagauuaucggcgccgacgugcagaauacgacauuuauuaucgaugggccuaacacccccgaauguccugacgaucagagagcuuggaauauuugggagguggaggacuauggauucggcaucuuuaccacaaacaucuggcugaagaugcgcgauuccuacacccaggucugcgaccaccggcugaugagcgcggccauuaaagauucuaaggcuguucaugccgacaugggcuauuggaucgaauccgagaaaaaugaaacguggaaacuugccagagcuagcuucauugaggugaagacauguaucuggcccaaaucucacacccucugguccaacggggugcuggaaagcgagaugauuaucccgaagaucuacggaggcccuauuucucaacauaauuaucgccccggguacuucacacagaccgccggaccuuggcaccugggcaaacucgagcuggauuuugaccuuugcgaagggacaaccgucgugguugaugagcacugcggaaaccggggccccagccugagaacgaccacagugaccggcaagaucauucaugaaugguguugccgguccuguacacucccuccccugcgcuucaaaggggaggacggaugcugguacggcauggagaucagaccggucaaggaaaaggaggaaaaucuggugaaaagcaugguuucugcgggguccggagagguggacagcuuuucccuuggccuccuguguauuucuaucaugauugaagaggucaugcggagcagauggucccgcaagaugcugaugaccgggacgcucgcuguguuccugcuucugaucaugggacagcucacauggaacgaucugauccggcugugcauuaugguuggcgccaaugccucugacagaaugggcauggggaccacauaucuugcucugauggccaccuuuaaaaugcgcccuauguucgcggugggacuccuguuuagacggcucaccagccgcgagguccugcuucugacaaucggccucucccugguggcuucuguggaacugcccaacagccuugaggaacugggggauggacucgccaugggcauuaugauccugaagcuccugacggacuuccaaucccaccagcuuugugccacccugcucagccugacauuuauuaaaaccacacugucucuucauuacgcuuggaagaccauggccaugguccuguccaucguuagccucaucccccugugccucucuacgacaucccagaagaccaccuggcugccugugcuucuggggagccugggauguaaaccgcucacaauguuccugauugcugagaauaagaucuggggcagaaaaucuuggccccuuaacgaaggcauuauggccgugggggucguguccauccugcucagcucccugcucaagaacgauguuccucuggcgggaccccuuauugccggcgggaugcugaucgcuugcuaugugaucagcggaucuagcgccgaccugucccucgagaaagcugccgaggucucuugggaagaggaagccgagcacagcggcgcuucccauaauauucugguggaaguucaggaugacgggaccaugaagaucaaagaugaggagcgggacgauacacuuacgauucugcucaaggcgacccugcucgccgugucuggagucuacccucugagcauccccgcuacacuuuuugugugguauuucuggcaaaagaaaaagcagcgcuccggcguccugugggacaccccuucucccccggaaguggagagagccguucuggaugacggcauuuaccggaucaugcagcgcgggcuccugggaagaagccaggugggcgucgggguguuucaagaaaacguuuuccacacaauguggcacgugacccggggagccguccuuauguaucagggcaaacgccuggagccuuccugggcuagcgugaagaaagaccucauuucuuacgggggaggcuggagacugcagggcuccuggaauacgggggaggaagugcagguuaucgccgucgagcccggaaagaacccuaagaaugugcaaaccgcgcccggcacauucaaaaccccggaaggggaggugggagcuaucgcccucgauuuuaagccuggcacaagcgggucucccauugucaaccgggaaggaaaaaucgugggccuguacggcaaugggguugugaccacauccggaacguaugucagcgccauugcucaggccaaggcgucccaggagggcccucuucccgagaucgaagacgagguguucagaaaacgcaaccugaccauuauggaucugcaucccgggucuggaaagacacggagauaccucccugcuaucguucgcgaagccaucaagcggaaacugagaacccuuauucuggccccgacccgcguggucgcuagcgagauggccgaagcucucaagggcaugcccauccgguaucaaacaacggccgugaaauccgagcacaccgggaaggagauuguugaccugaugugucaugcgacauuuaccaugagacugcucagcccugugcgcguccccaauuacaacaugaucauuauggaugaagcccacuucacagacccuucuuccaucgcugcccggggcuauaucagcaccagagugggaaugggcgaggcugccgccauuuuuaugacggcuacacccccugggucuguggaagcguucccgcagagcaaugccgucauccaggaugaggaacgggacauucccgagcgcuccuggaacucuggauacgaguggaucaccgauuuuccuggcaaaaccguuugguucgugcccagcauuaaguccgggaaugacaucgcuaacugccuuagaaagaauggaaaacgggugauucagcugucucgcaagacauuugauaccgaauaucagaagacaaagaacaacgacugggacuacgucgugaccacggauaucagcgagaugggcgccaauuucagagccgaccggguuaucgauccuagacgcugccugaaacccgugauucucaaggacgggccggaacgggucauccuggcuggcccuaugcccgugacaguugccuccgcggcucagagacgcggacggauuggcagaaaccauaauaaggagggggaucaguacaucuauaugggacagccccuuaacaaugacgaggaucacgcccacuggaccgaagccaaaaugcugcucgacaacauuaauacaccugagggcaucauccccgcucuguuugaaccugagcgcgaaaagagcgccgcgauugauggggaguaccggcugagaggagaggcccgcaaaaccuucguggaacucaugagacggggcgaccuuccggucuggcugucuuauaagguggcuuccgagggguuccaauacagcgaucgcagaugguguuuugacggcgaacggaacaaucagguccuggaggaaaacauggauguggagaucuggacgaaagagggagaacgcaagaaacucagaccccgguggcuggacgccagaaccuauuccgacccucuugcucugcgcgaguucaaggaauuugccgcuggccggagaucuguuagcggggaucucauucuggagaucggaaagcugccccagcaucucacacagcgcgcccaaaaugcgcuugacaaccuggugaugcugcacaauuccgaacagggcgggcgggccuacagacaugcuauggaggagcucccugauaccauugaaacacugaugcuucuggcccucaucgcugugcugaccggaggcgucacacuguucuuucucucuggccgggggcuuggaaaaaccagcaucggccugcugugcguuauggccuccagcgugcuccuguggauggccucuguggagccccacuggauugcugcguccaucauucuugaguucuuucugaugguccuccugaucccggagccugaccgccagagaacgccccaggauaaccaacuggccuaugugguuauugggcuccuuuucaugauccugacaguggcugccaaugagaugggacugcucgaaaccaccaagaaagaccugggcauugggcacgucgccguggagaaccaucaccaugcuacaaugcuugaugucgaccugcacccugccagcgcguggacccucuacgccguggcuacaacgaucaucacccccaugaugcggcauacaauugaaaacaccacagccaauaucucucugaccgcuauugccaaccaggcggccauccugaugggacucgauaagggcuggccuauuuccaaaauggacaucggcguuccccuucuggcucugggguguuacagccaggugaauccgcucacgcugaccgccgcuguccuuaugcugguggcccacuaugcuaucauuggaccuggccuccaagccaaggcgacacgcgaggcccagaagagaaccgcugccgggaucaugaaaaaccccacaguugauggaauuguggcuaucgaccuggaucccgucguguacgacgccaaguuugaaaaacagcugggccagauuaugcuccuuauccugugcaccucucaaauccugcucaugcggacgacaugggcccugugugagagcauuacccuugcgacagggccucugaccacccucugggagggauccccgggcaaguucuggaauacaacgaucgcugugucuauggccaacauuuuucgcggcagcuaucuggcuggggccggacuggccuucucccucaugaaaagccuuggcgggggaagacggggcaccggggcucagggagaaacacugggcgagaaguggaagcgccagcugaaucagcucuccaaaucugaauuuaacaucuacaagagaagcggcauuauggagguugaccgguccgaagccaaagaggggcugaagagaggagagaccacacgccacgcggucucucggggcaccgccaaacuuagaugguucguggaacgcaaucuggugaagcccgaggggaaggucaucgaucucggaugcggcagagggggauggagcuauuacugugcuggccugaaaaagguuacggaagugaaaggcuauacaaaagggggaccuggccaugaggaacccauuccuauggccaccuacggguggaaccuggugaaacuccacuccggaaaggacgucuucuuuacacccccugagaaaugcgauacacuucugugugacaucggcgagucuagcccgaaucccaccaucgaagaggggagaacacugcgcgugcucaagaugguugaaccuuggcugcggggaaaccaauucugcauuaagauccuuaaucccuacaugccuuccguggucgagacgcuggagcagaugcagagaaaacauggcggcaugcucgugcgcaacccccugagcagaaauucuacccacgaaauguauuggguuuccugugggacaggaaacauugugagcgcugucaauaugaccucuagaaugcugcucaaccgcuuuacaauggcccaccggaagccgaccuacgagaaagauguggaccugggcgcggggacgagacauguggccgucgaaccugagguugcuaaccuugauaucauuggacagcgcaucgaaaauaucaagcacgagcauaaauccaccuggcacuaugacgaggauaaccccuacaagacaugggccuaucauggcagcuacgaagugaagcccucuggguccgcuagcuccauggugaauggagucgugaaacugcucaccaagccuugggacguuauucccauggugacacaaaucgccaugaccgauacaaccccuuucggccagcagagagucuuuaaagagaagguggacacgcggacaccgaaagcuaagcgcggcaccguucaaauuauggaagugaccgccagauggcuguggggguuccuuagccggaacaagaaacccagaaucugcacacgggaggaauuuacgcgcaaggucagaucuaaugcggccauuggagcuguguucguugacgagaaccaguggaauagcgccaaagaggcuguggaagaugagcgguuuugggaccuggucaagaaagaacgcgagcuccacaagcagggcaagugcgccaccuguguguauaacaugauggggaaaagagaaaagaaacugggagaguucggcaaggccaaagggucccgggcgaucugguacauguggcugggcgcucgcuuucucgaguucgaagcccugggauuuaugaaugaggaucacugguucucuagagaaaacagccuuuccggcgucgagggggagggacugcauaagcucggcuacauccugcgggacauuucuaaaaucccugggggaaauauguaugccgaugacacagcuggcugggauacccgcauuacagaagacgaucuucagaacgaggccaagaucaccgacauuauggaacccgagcacgcucugcucgccacaagcaucuucaagcugaccuaccaaaauaaagugguuagagugcagcggccugcgaagaacgggacggucauggaugugaucucccgcagagaccagcggggcucuggacaggugggcaccuaugggcugaauacauuuaccaacauggaagcccaacucauucgccagauggagagcgagggaaucuuccugcccuccgaacuugagacaccgaaccuggcugaaagaguucucgauuggcuggagaaauacggcguggaacggcuuaagagaauggccauuagcggggacgacugcgucgugaaaccuaucgaugaccgcuuugcuaccgcccugacggcgcucaaugauaugggaaagguucggaaggacauuccccagugggagccuucuaaaggcuggaacgauuggcagcaagugcccuucuguucccaucacuuucaccagcugaucaugaaggacgggagagagauugucgugccuugccgcaaucaggaugaacuggucggccgggccagagugagccagggagcuggcuggucucuccgcgagacagccugucuggggaaauccuaugcucaaauguggcagcuuauguacuuccaucggagagaccugcgccucgccgcuaacgccaucugcagcgcgguucccguggauugggucccgaccucccggacaaccuggucuauccacgcccaucaccaguggaugacgaccgaagacaugcugagcguguggaauagaguuuggauugaggaaaacccuuggauggaggauaagacacauguguccagcuggggagacguccccuaucuuggcaaacgcgaggaccaauggugugggucucugaucggacucaccgcucgggccacaugggccuccaauauucagguggcuaucaaccaggugagacggcugauuggcaaugaaaacuaccuggauuacaugaccagcaugaagagauuuaagaaugagggggaccccgaaggcgcccucugguga

SEQ ID NO: 19207 - RNA, 9879 nt, Artificial Sequence
  derived and/or modified CDS sequence (opt5) from DENV-1__GU131767__SS-prME
agcgugacaaugcugcugaugcugaugcccacggcccuugcuuuccaccugacgaccagaggaggggagccucauaugaucgucuccaagcaggaacggggaaagucucuccuguuuaagacaagcguuggcgugaacaugugcacccuuauugccauggaccugggggaguucugugaagauacaaugaccuacaaaugcccgcgcaucacagaggcggaacccgacgauguggacuguuggugcaaugcuaccgauacguggguuaccuauggaacauguucccaaaccggcgagcacagacgggacaagcgcucuguggcccucgccccucauguugggcugggacuggagacaagaaccgaaacguggaugagcuccgagggcgcuuggaaacagauucagcggguggaaacaugggcccuccgccaccccggcuuuaccgucaucgcucuguuccuugcccaugcgauugggacaucuaucacccagaagggaaucauuuuuauccugcucaugcuggugaccccuagcauggccaugagaugcguuggcauugggucccgggauuucguggagggacuuagcggcgcuacaugggucgacguggugcuggagcacgggucuugugucacgaccauggccaaggauaaacccacacucgacaucgaacugcugaagaccgagguuacaaacccugcugugcuccgcaaacugugcauugaagccaagaucuccaauaccacgacagauagcagauguccgacccaaggagaggcgacccuuguggaggaacaggacgccaacuuugucugccggcgcacauucguggauagaggcuggggcaauggguguggacuguuuggcaaagggucucucauuaccugcgcuaaguucaagugcguuacaaaacuggagggaaagaucgugcaguacgaaaaccuuaaauauuccgucaucgugacgguucacaccggcgaccagcaucaaguggggaaugagagcacagaacacggaaccacagccaccauuacgccccaggcuccuucuaccgagauccagcugacagacuacggcgcccucacccuggauuguagcccccggacaggccuggacuuuaacgaaaugguccuccugaccaugaaggagaaaagcuggcuugugcauaagcagugguuccuggaucucccucugcccuggacguccggggccucuacaagccaagagaccuggaaucgccaggaccuucuggucacauuuaaaaccgcucacgcgaagaagcaggaagugguugugcucggaucccaagagggcgccaugcacaccgcucugacaggggccacggaaauucagaccagcggaacaaccacaaucuucgccggccaucugaaaugcagacucaagauggauaaacugacccuuaaggggaugucuuaugucauguguacgggcuccuucaaacuggagaaggaaguggcugagacacagcacggaaccguucucgugcagauuaaguacgagggcaccgacgccccgugcaaaaucccuuuuagcacacaagaugaaaagggggucacccagaacggacggcugaucacagcgaaucccauugugacggacaaagagaagccugugaacaucgaagcugagccgcccuucggcgagucuuauauuguuaucggggccggagaaaaagcccugaaacuuagcugguuuaagaaaggcuccucuauugggaagauguucgaggcuaccgccagaggcgcucgccggauggccauccucggagauacagcgugggacuuuggcagcaucgggggagucuucaccuccgugggcaaacuggugcaucagauuuuugggacagccuacggaguccuguucagcggcgugucuuggaccaugaagaucgggauuggcguucuccugacguggcuuggacucaauuccagaagcaccucucucuccaugacauguaucgcugugggccuggucacccuguaccuuggggugaugguucgcgccgauagcggaugcgugauuaacuggaaaggccgggaacucaaguguggguccggaaucuuugucacaaaugaggugcacaccuggacagaacaguauaaguuccaagcugacucuccuaaaagacugagcgccgcgauuggcaaggccugggaggaggggguuugcggcauccgcuccgcuacccggcuggaaaacaucauguggaaacagauuucuaacgagcucaaucauauccugcuugaaaacgacaugaagcugacgguggucgugggagauguggccggcauucucgcucaggggaaaaagaugaucagaccgcagcccauggaguacaaauauagcuggaaguccuggggaaaggccaaaauuaucggcgccgacguccaaaauacaaccuuuaucauugaugggccuaacacccccgaauguccugacgaucagcgcgcuuggaauaucugggagguugaggacuacggauucggcauuuuuacaaccaacaucuggcugaagcugcgggauagcuauacacaggugugcgaccacagacuuaugucugcggccauuaaagauuccaaggcugugcacgccgacaugggcuacuggaucgaaagcgagaaaaaugaaacauggaagcucgcccgcgcuucuuucaucgaggucaagaccuguauuuggcccaaaucccauacacuguggagcaacggggugcuggaaucugagaugaucauuccgaagaucuauggaggcccuauuagccagcacaauuaccggcccggguacuucacccaaacagccggaccuuggcaucucggcaaacuggagcuugauuuugaccugugcgaagggaccacgguuguggucgaugagcacugcggaaacagaggccccucccuccggaccacaaccgugacaggcaagaucauccacgaaugguguugccgcagcuguacccugccuccccugagauucaaaggggaggacggaugcugguauggcauggagauucggccgguuaaggaaaaggaggaaaaucuugugaaaucuauggucuccgcggggagcggagagguggacuccuuuucucucggccugcuguguaucagcauuaugaucgaagagguuaugagaucccgcuggucucggaagaugcucaugacggggacacuggcuguguucuuucuucugauuaugggacagcucaccuggaacgaucugaucagacugugcauuauggucggcgccaaugccagcgaccgcaugggcauggggacaaccuaccuugcucugauggccaccuucaaaaugagaccuauguuugcggugggacuccuguuccggcgccucacauccagagaggugcugcuucugacgaucggccucucucuggucgcuagcguugaacugcccaacucccuugaggaacugggggauggacucgccaugggcaucaugauucugaagcuccugaccgacuuucagagccaucaacuuugggccacacugcucucucugaccuucauccggacaaccuuuucccugcacuaugcuuggaaaacgauggccauggugcuuagcauugugucucuguucccccucugucuguccacaaccagccagaagaccacauggcucccuguccugcuugggucucugggaugcaagccgcugaccauguuucucaucgcugagaauaaaauuuggggccgcaaguccuggccccugaacgaaggcaucauggccguggggaucguuagcauucuucuguccagccuccugaaaaacgaugugccucucgcgggaccccugaucgccggcgggaugcuuauugcuuguuacgucaucucuggaagcuccgccgaccugucucuggagaaggcugccgugguuagcugggaggaagaggccgaacauuccggcgcuucucacaauauucucguggagguccaggaugacgggacaaugaaaaucaaggaugaagagagagacgauacgcugaccauccuucugaaagcgacacuccuggccgugagcggagucuauccucucuccauucccgcuacccuguucgugugguacuucuggcagaagaagaaacaacggucuggcguucuuugggacacaccuuccccucccgagguggaacgcgccguccuggaugacggcaucuauagaauuaugcagcgggggcugcucggacgcucccaggugggcguugggguguuucaggagaacgucuuccauaccauguggcacgugacgagaggagccgugcugauguaccaaggcaagcggcuugaacccagcugggcuucuguuaaaaaggaccugaucuccuacgggggaggcuggagacuccagggcagcuggaauaccggggaggagguccaggugauugccguggaacccggcaagaauccuaagaauguccagacagcgcccggcaccuuuaagacaucugagggggaagugggagcuaucgcccuggauuucaaaccgggcaccuccgggagcccuauuguuaaccgcgagggaaagaucgugggccucuauggcaauggggucgugacaacguccggaaccuacguuucugccaucgcucaagccaaagcgagccaggaaggcccccugccugagauugaggacgaaguguuucggaagagaaaccuuacaaucauggaucugcaccccggguccggaaaaacccgccgguaucugcccgcuauugucagagaggccaucaagcgcaagcuccggacccugauucuugccccuacaagagugguugcuagcgaaauggccgaggcucugaaaggcaugccgauccgcuaccagacgaccgccgugaagucugaacauacagggaaagagaucgucgaccucaugugccacgcgaccuucacaaugcggcugcugucccccgugagagugccuaauuauaacaugauuaucauggaugaggcccauuuuaccgaccccagcucuauugcugcccggggcuacaucagcacgcgcgucggaaugggcgaagcugccgccauuuucaugacagcuaccccucccggguccguugaggcguuuccucaaucuaaugccgugauccaggaugaagagagagacaucccggaacggagcuggaacuccggauaugaguggauuaccgauuuccccggcaagacagugugguuugucccuucuaucaaaagcgggaaugacauugcuaacugucuccgcaagaauggaaagagagugauccagcuuucccggaaaaccuucgauacagaguaccagaagaccaaaaacaacgacugggacuacguugugacgacagauauuagcgaaaugggcgccaauuucagagccgaccgcgucaucgauccccggagaugccugaagccugugauucugaaagacgggcccgagcgcguuauccucgcuggcccgaugccugugaccgucgccucugcggcucaacggagaggacgcaucggccggaaccacaauaaggaaggggaucaguauauuuacaugggacagccccugaacaaugacgaggaucaugcccacuggacagaggccaagaugcuucuggacaacaucaauacccccgaaggcauuaucccugcucucuuugagcccgaaagagagaaauccgccgcgauugauggggaauaucgccugagaggagaggcccggaagacguucguggagcugaugcgcagaggcgaccucccugucuggcuuagcuacaaaguggcuuccgaaggguuucaguauucugaucggcgcuggugcuucgacggcgagagaaacaaucaaguucuggaagagaacauggauguggaaaucuggaccaaggagggagagcggaaaaagcugagaccgcgcuggcucgacgcccggacauacagcgacccccuggcucuuagagaauuuaaagaguucgccgcuggccgccgguccgugucuggggaucugauccucgaaauuggaaagcugccucagcaccugacccagagagcccagaaugcgcucgacaaccuugucaugcugcauaauagcgagcaaggcgggcgggccuaucgccacgcuauggaggaacugcccgauacaaucgagacccucaugcugcuugcccugauugcuguucucacaggaggcgugacccuguuuuuccuguccggcagagggcucggaaagacgagcaucggccuucugugugugauggccucuuccguccugcucuggauggccagcguggaaccucauuggauugcugcgucuaucauccuggaguuuuuccuuaugguucugcucauucccgaaccggaccggcagcgcacaccucaggauaaccagcuggccuacguggucaucgggcugcucuuuaugauucuuaccguggcugccaaugagaugggacugcuggagaccaccaagaaggaccucggcaucgggcacgucgccguggaaaaccaccaucacgcugccaugcuggauguugaccuucaucccgcguccgccuggacccuguacgcuguggccacaacgauuaucaccccuaugaugagacacacaauugagaacaccacagcuaauaucagccucaccgccaucgcgaaccaagccgcuauucugaugggacuggauaaaggcuggcccaucucuaagauggacauuggcgucccucuccuugcccuggggugcuauagccaggugaauccccugacgcucaccgcugccguucugaugcuuguggcucauuacgccaucauuggaccgggccugcaggcgaaagccacacgggaagcucaaaagcgcaccgccgcugggaucaugaagaacccuacagucgauggaaucguggccauugaccucgaucccgugguuuaugacgccaaauucgagaagcagcugggccagaucaugcugcucauucuuuguaccucccagauccugcugaugagaacgacaugggcgcucugcgaaucuauuacccuggcuacagggccccuuaccacccugugggagggaagcccuggcaaauuuuggaauacaacgaucgccgucuccauggcuaacaucuuccggggcagcuaccucgccggggccggacuggcuuucucccugaugaagucucucggcgggggacgcagaggcaccggggcccaaggagagacacuuggcgaaaaauggaagcggcagcugaaucagcugagcaaguccgaguuuaacaccuauaaaagaucuggcauuauggaaguggaccgcagcgaggcgaaggaagggcucaaacggggagagacaaccaagcacgccguguccagaggcacggcuaaacugcgcugguucgucgagcggaaucuuguuaagccggaagggaaggugaucgaucugggauguggcagagggggauggucuuacuauugcgccggccucaaaaaggugacagaggucaaaggcuacaccaaagggggacccggccacgaggaaccuauucccauggcuaccuacggguggaaccuggugaaacugcauagcggaaaggacgucuuuuucaucccucccgaaaaaugugauacacuccuuugcgacauuggcgaguccagcccuaauccgaccaucgaggaagggcgcacacugcgggugcugaagauggucgagcccuggcucagaggaaaccaguuuuguauuaagauccugaauccuuauaugcccucugugguugaaacgcuugagcaaaugcagcgcaaacacggcggcaugcuggugcggaacccucucuccagaaauagcacccaugagauguacugggucucuugcgggacaggaaacaucguguccgccgugaauaugaccagccgcaugcugcugaaccgguucacaauggcgcacagaaagcccaccuaugaacgcgaugucgaccucggcgccgggacgagacacguugcuguggagccggaaguggccaaccuggauauuaucggacagcggauugagaauaucaaacaugaacacaagucuaccuggcauuacgacgaggauaacccuuauaaaacaugggcuuaccacggcuccuaugaggucaagcccagcggguccgccagcucuauggugaauggaguugugaaacuucugaccaaacccugggacgucauuccuauggugacacagaucgcuaugaccgauacaacccccuuuggccaacagcgcguuuucaaggaaaaaguggacacgagaacaccuaaggccaaacggggcaccgcgcagaucauggaggucaccgccaaguggcucuggggguuucugagcagaaacaagaaaccgcggauuuguacacgcgaagaguucacgagaaaggugcgguccaaugcugccaucggagcuguuuuuguggacgaaaaccaauggaacucugccaaagaggccgucgaggaugaacgcuucugggaccuugugcauagagagcgggaacugcacaagcagggcaaaugcgcgaccugcgucuacaacaugauggggaagcgcgagaagaaacucggagaauuuggcaaggcuaaagggagcagagccauuugguacauguggcugggcgcccgguuccuggaguucgaggcucucggauuuaugaaugaagaucacugguucucccgcgagaacucucugagcggcguggaaggggagggacuucauaagcugggcuauauccucagagacauuuccaaaauccccgggggaaauauguacgccgaugacacagcuggcugggauacccggaucacagaggacgaucugcagaacgaagccaagauuaccgacaucauggagccugaacacgcgcuucuggccaaaucuauuuuuaagcucacauaucagaauaagguugugcgcguccaaagacccgcuaaaaacgggaccgugauggaugugaucagccggcgcgaccagagaggcuccggacagguuggcacguacgggcugaauaccuucacaaacauggaggcccagcugauucggcaaauggaaagcgagggaaucuuuucuccuuccgagcucgaaacccccaaccuggcuggcagagugcuugauuggcuggagaagcauggggucgaacgccucaaacggauggccaucagcggagacgacugugugguuaagccgauugaugacagauucgcgacagcccugaccgcucuuaaugauaugggcaaagugcgcaaggacaucccucagugggagcccucuaagggguggaacgauuggcagcaggucccuuuuugcucccaccacuuccaucaacugauuaugaaagacggccgggaaaucgugguccccuguagaaaucaggaugagcucgugggacgcgcccggguuagccagggcgcuggguggucccugagagagacggccugccugggaaagucuuaugcucagauguggcaacucauguacuuucaccgccgggaccugagacuugccgcgaacgccauuuguagcgcugugccugucgauugggugcccacaucccgcaccacauggagcauccaugcccaccaucaguggaugaccacggaagacaugcugucuguuuggaaucggguguggauugaggaaaacccguggauggaggauaaaacccacaucuccagcuggggcgacgucccuuaucucgggaagagagaagaccaguggugcggaucucugaucggccuuacagcccgggcuaccugggccacaaauauucaaguggcgaucaaccaggugagacgccugcucgggaaugagaacuaccuggauuacaugaccagcaugaaacgguucaagaaugaguccgaccccgaaggcgcucugugguga

SEQ ID NO: 19208 - RNA, 9879 nt, Artificial Sequence
  derived and/or modified CDS sequence (opt5) from DENV-1__HM181967__SS-prME
agcgugaccaugcugcucaugcugaugcccaccgcccuugcuuuccaccugacgaccagaggaggggaaccucauaugaucgucuccaagcaggaacggggaaaaucucuccuguuuaagaccagcgccggcguuaacaugugcacccuuaucgcgauggaccugggggaacucugugaagauaccaugaccuacaaaugccccagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccaggccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucagaggggaggacggaugcugguauggcauggagauucggccggugaaagaaaaggaggaaaaucuuguuaagagcauggugucugcuggguccggagaggucgacagcuuuucccucggccugcuguguaucucuauuaugaucgaagaggugaugagaagccgcuggucccggagaaugcucaugacagggacccuggccguuuucuuucuucugauuaugggacagcucacauggaacgaucugauccgccugugcauuauggugggcgccaaugcuucugacagaaugggcauggggaccaccuaccuugcccugauggcgacauucaaaaugcggccuauguuugcugucggacuccuguuccgcagacucacgagccgggaggugcugcuucugaccaucggccucucccugguggccucugucgaacugcccaacagccuugaggaacugggggauggacucgccaugggcaucaugauucugaagcuccugacagacuuucaaucccaucagcuuugggcuacccugcucagccugacauucaucaaaaccacguuuucucugcacuaugccuggaagacaauggcuaugguucuuuccauugugagccuguucccccucugucugucuaccaccucccagaaaacaaccuggcucccugugcugcuugggagccugggaugcaagccgcugacaauguuucucaucgccgagaauaagauuuggggccgcagaucuuggccccugaacgaaggcaucauggcggucgggaucguguccauucuucugagcucccuccugaaaaacgauguuccucucgccggaccccugaucgcuggcgggaugcuuauugccuguuacgugaucagcggaucuagcgcugaccugucccuggagaaggccgccgaggucucuugggaagaggaagcugagcauagcggcgcgucccacaauauucucguggaaguucaggaugacgggacgaugaaaaucaaggaugaggagcgggacgauacccugacaauccuucugaaagccacccuccuggcugugucuggagucuauccucucagcauucccgccacacuguucgugugguacuucuggcaaaagaaaaagcagcgcuccggcguccuuugggacaccccuucucccccggaaguggagagagccguucuggaugacggcaucuaucggauuaugcagcgcgggcugcucggaagaagccaggugggcgucgggguguuucaagaaaacguuuuccauacgauguggcacgugacccggggagcuguccugauguaccagggcaagagacuugagccuuccugggccagcgugaaaaaggaccugaucucuuacgggggaggcuggcgccuccagggcuccuggaauacaggggaggaagugcagguuauugcggucgagcccggcaagaacccuaagaaugugcaaaccgcucccggcacauuuaaaaccccggaaggggaggugggagccaucgcccuggauuucaagccuggcacaagcgggucucccauugucaaccgggaaggaaagaucgugggccucuauggcaaugggguugugacgaccuccggaacauacgucagcgcuaucgcccaggcgaaggcuucccaggagggcccucugcccgagauugaagacgagguguuuagaaagcgcaaccuuaccaucauggaucugcaccccgggucuggaaaaacccggagauaucugccugccauuguucgcgaagccaucaagcggaaacucagaacacugauucuugcuccgacgcgcguggucgccagcgagauggcugaagcccugaagggcaugcccauccgguaccaaaccacagcggugaaguccgagcauaccgggaaagagaucguugaccucaugugccacgccacauucaccaugagacugcugagcccugugcggguccccaauuauaacaugauuaucauggaugaagcucauuuuacggacccuucuuccauugccgcucgcggcuacaucagcacaagagugggaaugggcgaggccgccgcuauuuucaugaccgcgacacccccugggucuguggaagccuuuccgcagagcaaugcugucauccaggaugaggaacgggacauccccgagcgcuccuggaacucuggauaugaguggauuacagauuucccuggcaagaccguuugguuugugcccagcaucaaauccgggaaugacauugccaacugucucagaaagaauggaaaacgggugauccagcuuucuagaaagacauucgauaccgaauaccaaaagacgaaaaacaacgacugggacuacgucgugacaaccgauauuagcgagaugggcgccaauuuccgcgcugaccggguuaucgauccuagacgcugccugaagcccgugauucugaaagacgggccggaacgggucauccucgccggcccuaugcccgugacaguugcguccgcugcccagagacgcggacggaucggcagaaaccacaauaaggagggggaucaguauauuuacaugggacagccccugaacaaugacgaggaucaugcccacuggaccgaagcuaaaaugcuucuggacaacaucaauacgccugagggcauuauccccgcccucuuugaaccugagcgcgaaaagagcgcggccauugauggggaguauagacugcggggagaggcucgcaagaccuucguggaacugaugagacggggcgaccucccggucuggcuuucuuacaaaguggccuccgagggguuucaauauagcgaucgcagauggugcuucgacggcgaacggaacaaucagguccuggaggaaaacauggauguggagaucuggacaaaggagggagaacgcaagaaacugcgcccccgguggcucgacgcuagaaccuacuccgacccucuggcccuucgcgaguuuaaagaguucgcugccggccggagaucuguuagcggggaucugauccucgagauuggaaagcugccccagcaccugacacagcgggcgcaaaaugcccucgacaaccuugugaugcugcauaauuccgaacagggcgggcgcgcuuauagacacgccauggaggagcugccugauaccaucgaaacacucaugcugcuugcucugauugccgugcucaccggaggcgucacgcuguuuuuccugucuggccgggggcucggaaaaacaagcaucggccuucuguguguuauggccuccagcgugcugcucuggauggcuucuguggagccccauuggauugcggccuccaucauccuggaauuuuuccuuaugguccugcucauuccggagccugaccgccagagaacaccccaggauaaccaacuggcuuacgugguuaucgggcugcucuuuaugauucuuaccguggccgccaaugagaugggacugcuggaaacaaccaagaaggaccucggcaucgggcacauggcugucgagaaccaccaucacgccgcgaugcuggauguggaccuucauccugccagcgcuuggacacuguacgccgucgcuacgaccauuaucacacccaugaugcggcacaccauugaaaacacaaccgccaauaucucucucacggcgaucgccaaccaggcugccauucugaugggacuggauaaaggcuggccuaucuccaagauggacauuggcgugccccuccuugcucuggggugcuauagccagguuaauccgcugacccucacagccgcugugcugaugcuugucgcccauuacgcgaucauuggaccuggccugcaagccaaagcuacccgcgaggcccagaagagaacagcugccgggaucaugaaaaaccccaccguggauggaaucguugccauugaccucgaucccguggucuaugacgcgaaguucgaaaagcagcugggccagaucaugcugcucauucuuuguacgucucaaauccugcugaugcggacaaccugggcucucugcgagagcauuacacuggccaccgggccucuuaccacacugugggagggauccccgggcaaauuuuggaauacgaccaucgcugugucuauggccaacaucuuccgcggcagcuaccucgccggggcuggacuggccuucucccugaugaaaagccucggcgggggaagacggggcacaggggcgcagggagaaacccuuggcgagaaauggaagagacagcugaaucagcuguccaaaucugaauuuaacacauauaagcgcagcggcauuauggagguggaccgguccgaagccaaggaggggcucaaaagaggagagaccacgaagcacgcuguuucucgcggcacagccaaacugcggugguucgucgaaagaaaucuugugaagcccgaggggaaagugaucgaucugggauguggccgcgggggauggagcuacuauugcgcuggccucaagaaggucaccgaaguuaaaggcuacaccaaaggcgggccugggcacgaggaacccauuccuauggccacauacggguggaaccuggugaaacugcauuccggaaaggacguguuuuucauucccccugagaaaugugauacccuccuuugcgacauuggcgagucuagcccgaaucccacaaucgaagaggggcggacgcugagaguccugaagaugguggaaccuuggcuccgcggaaaccaauuuuguauuaaaauccugaaucccuauaugccuuccguuguggagacccuugagcagaugcagcggaagcacggcggcaugcuggucagaaacccccucagccgcaauucuacacaugaaauguacuggguguccugcgggaccggaaacaucguuagcgcggugaauaugacaucucggaugcugcugaacagauucaccauggcccaccgcaagccgacguaugagagagaugucgaccucggcgcugggacccggcacguggccguggaaccugaggucgcuaaccuggauauuaucggacagcgcauugaaaauaucaaacaugagcacaaguccacauggcauuacgacgaggauaaccccuauaaaaccugggccuaccacggcagcuaugaaguuaagcccucuggguccgcuagcuccauggugaauggaguggucaaacuucugacaaagccuugggacgugauucccaugguuacccaaaucgccaugacagauaccacgccuuuuggccagcagagaguguucaaggagaaagucgacacacggaccccgaaggcgaaaagaggcaccgcccaaaucauggaagugacagcuaaguggcucuggggguuucugagccggaacaaaaagccccgcauuuguacgagagaggaguucacccggaagguucgcucuaaugccgcuaucggagccguguuugucgacgagaaccaguggaauagcgccaaagaggcgguggaagaugagagauucugggaccuuguucaucgggaacgcgagcugcacaagcagggcaaaugcgcuacaugcguguacaacaugauggggaagagagagaaaaagcucggagaguuuggcaaggccaaagggucccgggccauuugguacauguggcugggcgcucgcuuccuggaguucgaagcccucggauuuaugaaugaggaucacugguucucuagagaaaacagccuguccggcgucgagggggagggacuucauaagcugggcuauauccuccgggacauuucuaaaaucccugggggaaauauguacgcugaugacaccgccggcugggauacacgcaucaccgaagacgaucugcagaacgaggcgagaauuacagacaucauggaacccgagcacgcccuucuggcuaagagcauuuuuaaacucaccuaucaaaauaaggugguccgggugcagcgcccugccaaaaacgggacgguuauggaugugaucuccagacgggaccagagaggcucuggacaggucggcaccuacgggcugaauacauucaccaacauggaagcucaacugauucgccagauggagagcgagggaaucuuuucccccagcgaacucgagacaccgaaccuggccgaacgggugcuugauuggcuggagaaguauggcguggaaagacucaagcgcauggcgaucucuggggacgacuguguugugaaaccuauugaugaccgguucgccaccgcucugacggcccuuaaugauaugggaaaggucagaaaagacaucccccagugggagccuuccaagggcuggaacgauuggcagcaagugcccuuuugcagccaucacuuccaccagcugauuaugaaagacgggcgcgagaucguugugccuugucggaaucaggaugaacucgucggcagagcucgcgugucucagggagccggcuggucccugcgggagacagcuugccugggaaagagcuacgcccaaauguggcagcucauguauuuucauagacgcgaccugcggcuugcggccaacgcuauuuguuccgccguccccguggauuggaucccgaccucuagaacaaccuggagcauucacgcccaucaccaguggaugacgaccgaagacaugcuguccguuuggaaucggguguggaucgaggaaaacccuuggauggaggauaagacacauaucagcucuuggggagacguccccuaccucggcaaaagagaggaccaauggugcgggucccugauuggacuuaccgcucgcgccacaugggcgaccaauauccagguggcuauuaaccagguucggagacugaucggcaaugaaaacuaccucgauuauaugacaagcaugaagcgcuucaaaaaugagucugaccccgaaggggcccugugguga

SEQ ID NO: 19209 - RNA, 9879 nt, Artificial Sequence
  derived and/or modified CDS sequence (opt5) from DENV-1__GU131768__SS-prME
agcgugaccaugcugcucaugcugaugcccaccgcccuugcuuuccaccugacgaccagaggcggggaaccucauaugaucgugacaaagcaggaacggggaaaaucccuccuguuuaagaccucugccggcguuaauaugugcacacuuauugcgauggaccugggggaacucugugaagauaccaugacauacaaaugcccccgcaucaccgaagcugaacccgacgauguggacuguuggugcaaugccacggauaccugggugacauauggaaccuguagccaaacaggcgaacaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuuguuacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacguccagaauaccaccuuuaucaucgaugggccuaacacacccgaauguccugacgaucagagagcuuggaauauuugggagguugaggacuauggauucggcaucuuuaccacgaacauuuggcugaagcugcgcgauuccuacacacaggugugcgaccaccggcuuaugagcgcggccaucaaagauucuaaggcugugcaugccgacaugggcuauuggauugaauccgagaaaaaugaaaccuggaagcucgccagagcuagcuucaucgaggucaagacauguaacuggcccaaaucucacacccugugguccaauggggugcuggaaagcgagaugaucauuccgaagaucuacggaggcccuauuucucaacauaacuaucgccccggguacuucacacagaccgccggaccuuggcaccucggcaaacuggagcuugauuuugaccugugcgaagggacgaccguuguggucgaugagcacugcggaaaucggggccccagccucagaacaaccacagugaccggcaagaucauucaugaaugguguugccgguccuguacgcugccuccccugcgcuucaaaggggaggacggaugcugguacggcauggagaucagaccgguuaaggaaaaggaggaaaaccuugugaaaagcauggucucugcgggguccggagagguggacagcuuuucccucggccugcuguguaucucuauuaugaucgaagagguuaugcggagcagauggucccgcaagaugcucaugacagggacccuggcuguguuccuucugcucauuaugggacagcugacauggaaugaucugauccggcuuugcauuauggucggcgccaacgccucugacagaaugggcauggggaccaccuaucuggcucucauggccacauuuaaaaugcgcccuauguucgcggugggacugcucuuuagacggcugacgagccgcgaggugcuucugcucaccaucggccugucccuggucgcuucuguugaacuucccaauagccuggaggaacucggggauggacuggccaugggcauuaugauccucaagcugcuuacagacuuccaaucccaccagcugugggccacccuccugagccugacauuuaucaaaaccacgcuuucucugcauuacgcuuggaagacaauggccauggugcucuccauugugagccuguucccccucugucugucuaccaccucccagaagacaaccuggcuuccuguccugcuggggagccucggaugcaaaccgcugacaauguuucuuaucacggagaacaagauuuggggcagaaaaucuuggccccugaacgaaggcaucauggcuguggggguuguguccauucuccugagcucccuccugaagaaugaugucccucuugccggaccccugaucgcgggcgggaugcugaucgccuguuaugugauuagcggaucuagcgcugaccucucccuggagaaagccgcugagguuucuugggaagaggaagccgagcacagcggcgccucccauaacauccuuguggaaguccaggaugacgggaccaugaagauuaaagaugaggagcgggacgauacacugaccauccuccugaaggcuacacuccuggcggugucuggagucuacccucuuagcauucccgccacccuguucgugugguauuuuuggcaaaagaaaaagcagcgcuccggcguucugugggacacgccuucucccccggaaguggagagagcuguccucgaugacggcaucuaccggaucaugcagcgcgggcugcuuggaagaagccaggugggcguugggguguuccaagaaaaugucuuccacaccauguggcacgugacacggggagccgugcugauguaucagggcaaacgccucgagccuuccugggccagcguuaagaaagaccugauuucuuacgggggaggcuggagacuccagggcuccuggaacaccggggaggaaguccaggugaucgcuguggagcccggaaagaauccuaagaacguccaaacagcccccggcaccuuuaaaacaccggaaggggaggugggagcgauugcucuggauuucaagccuggcacgagcgggucucccaucguuaaucgggaaggaaaaauugugggccuuuacggcaacggggucgugaccacauccggaaccuauguuagcgccaucgcccaggcuaaggccucccaggagggcccucugcccgagauugaagacgagguguuuagaaaacgcaaucugaccaucauggaucuccaucccgggucuggaaagacacggagauaccugccugcgaucguccgcgaagcuauuaagcggaaacuuagaacgcugauccucgccccgacccgcgugguugccagcgagauggcugaagcccugaagggcaugcccauucgguaucaaacaaccgcugugaaauccgagcacacagggaaggagaucgucgaccugaugugccaugccaccuucacgaugagacuccuuagcccugugcgcgugcccaacuacaauaugauuaucauggaugaagcgcacuuuacagacccuucuuccaucgccgcucggggcuauauuagcaccagagucggaaugggcgaggccgcugccaucuucaugaccgccacacccccugggucuguugaggcuuuuccgcagagcaacgcggugauucaggaugaggaacgggacauccccgagcgcuccuggaacucuggauacgaguggauuaccgauuucccuggcaaaacagugugguuuguccccagcaucaaguccgggaacgacaucgccaauugucugagaaagaacggaaaacgggugauucagcugucucgcaagaccuucgauacggaauaucagaagaccaagaacaaugacugggacuacguugugaccacagauaucagcgagaugggcgcuaacuuuagagccgaccgggucauugauccuagacgcugccucaaacccgugauccugaaggacgggccggaacggguuauucuugccggcccuaugcccgugaccgucgcuuccgccgcgcagagacgcggacggaucggcagaaaucauaacaaggagggggaucaguacauuuauaugggacagccccugaauaacgacgaggaucacgcucacuggacggaagccaaaaugcuccuggacaauaucaacaccccugagggcaucauucccgcccuguucgaaccugagcgcgaaaagagcgcugccaucgauggggaguaccggcucagaggagaggcgcgcaaaacauucguggaacuuaugagacggggcgaccugccggucuggcugucuuauaagguggccuccgagggguuucaauacagcgaucgcagauggugcuucgacggcgaacggaauaaccagguucucgaggaaaauauggauguggagauuuggaccaaagagggagaacgcaagaaacugagaccccgguggcuugacgcuagaacauauuccgacccucuggcccuccgcgaguuuaaggaguucgcugccggccggagaucugugagcggggaucugauccuggagauuggaaagcucccccagcaucuuacccagcgcgcucaaaacgcccuggacaaucuggucaugcuccacaacuccgaacagggcgggcgggcguacagacaugccauggaggagcugccugauacaaucgaaacccuuaugcugcucgcucugaucgccguucugacgggaggcgugacacucuuuuuccuuucuggccgggggcugggaaaaaccagcauuggccugcucugugugauggcuuccagcguccugcuuuggauggccucuguggagccccacuggaucgccgcuuccauuauccuggaauuuuuccucaugguucugcugauuccggagccugaccgccagagaacaccccaggauaaucaacucgcguauguggucaucgggcuucuguuuaugauccugacaguggccgcuaacgagaugggacuccuggaaaccacaaagaaagaccuuggcauugggcacgucgccguggagaaccaucaccaugccacgaugcuggauguugaccuccacccugcuagcgccuggacccuguacgcgguggccacaaccaucauuacacccaugaugcggcauaccaucgaaaauacgaccgcuaacauuucucugacagccaucgcuaaucaggccgcgauucucaugggacuugauaagggcuggccuaucuccaaaauggacaucggcgucccccugcuggcccucgggugcuacagccaggugaacccgcugacccuuacagcugccguucugaugcucguggcucacuaugccauuaucggaccuggccugcaagcuaaggccacccgcgaggcgcagaagagaacggccgcugggauuaugaaaaaucccacagucgauggaaucguggccauugaccuggaucccgugguuuacgacgcuaaguucgaaaaacagcucggccagaucaugcuucugauccuguguaccucucaaauucuccugaugcggacaaccugggcccuuugcgagagcaucacccuggccacagggccucucacgacccugugggagggauccccgggcaaguuuuggaacacaaccauugcggucucuauggcuaauaucuuccgcggcagcuaucuggccggggcuggacucgccuuuucccuuaugaaaagccugggcgggggaagacggggcacaggggcccagggagaaacccugggcgagaaguggaagcgccagcucaaccagcuguccaaaucugaguucaauauuuacaagagaagcggcaucauggagguggaccgguccgaagcuaaagaggggcuuaagagaggagagacgacacgccacgccgugucucggggcaccgcgaaacugagaugguucgucgaacgcaaccucguuaagcccgaggggaaggugaucgaucugggauguggcagagggggauggagcuauuacugcgccggccugaaaaaggugaccgaagucaaaggcuauacaaaagggggaccuggccaugaggaacccauuccuauggcuaccuacggguggaaucucgugaaacuucacuccggaaaggacgucuuuuucacacccccugagaaaugugauacgcugcugugcgacaucggcgagucuagcccgaaccccaccauugaagaggggagaacacuccgcgugcugaagauggucgaaccuuggcuucggggaaaucaauuuuguaucaagauucugaaccccuacaugccuuccgugguugagacccucgagcagaugcagagaaaacauggcggcaugcuggugcgcaauccccugagccggaacucuacacacgaaauguauugggucuccugcgggaccggaaauaucgugagcgccgugaacaugacgucuagaaugcuccugaaccgcuucaccauggcucaccggaagccgacauacgagagagaugucgaccuuggcgccgggacccgccauguugcgguggaaccugagguggccaaucuggauauuaucggacagagaaucgaaaacauuaaacacgagcauaaguccacauggcacuaugacgaggauaaucccuacaaaaccugggcuuaucauggcagcuacgaagucaagcccucuggguccgccagcuccauggugaacggaguugugaagcuccugacaaaaccuugggacgucauccccauggugacccaaauugcuaugacggauacaaccccuuuuggccagcagcggguuuucaaggagaaaguggacacccgcacaccgaaggccaaaagaggcacggcucaaaucauggaagucaccgcccgguggcuuuggggguuucugagcagaaauaagaagccccggauuuguacacgcgaggaguucaccagaaaagugcggucuaacgcggccaucggagcuguuuuuguggacgagaaucaguggaacagcgccaaggaggcugucgaagaugagcgcuucugggaccucgugaaaaaggaaagagagcugcacaaacagggcaagugcgccacaugcgucuauaauaugauggggaagcgggagaaaaagcugggagaguuuggcaaagccaaggggucccgcgcgaucugguacauguggcucggcgcuagauuccuggaguuugaagcccuuggauucaugaacgaggaucacugguucucucgggaaaauagccuguccggcguggagggggagggacuccauaaacugggcuacauucuucgcgacaucucuaagauuccugggggaaacauguaugccgaugacaccgcuggcugggauacaagaaucaccgccgacgaucugcagaaugaagcuaaaauuacggacaucauggagcccgaacacgcccuccuggcgaccagcaucuuuaagcugacauaccaaaacaagguugugcggguccagcgcccugccaaaaaugggaccgugauggaugugauuuccagacgggaccagcgcggcucuggacagguuggcacauaugggcucaacaccuucacgaacauggaggcucaacugaucagacagauggaaagcgagggaauuuuucuucccuccgagcuggaaacaccgaaucucgccgagcgggugcuggauuggcuugaaaaguacggcgucgagagacugaaacgcauggcuaucagcggggacgacugugugguuaagccuauugaugaccgguucgccaccgcgcucacagcccugaacgauaugggaaaagugagaaaggacaucccccagugggaaccuucuaagggcuggaaugauuggcagcaaguccccuuuugcucccaucacuuccaccagcugaucaugaaagacgggcgcgagauuguggucccuugucggaaccaggaugagcucgugggcagagcucgcguuagccagggagccggcuggucucugcgggaaaccgcuugccuugggaaguccuaugcccaaauguggcagcugauguacuuucauagacgcgaccuccggcuggcugccaaugcgaucuguagcgccgugcccgucgauugggugccgacguccagaaccacauggucuauucacgcucaucaccaguggaugaccacagaggacaugcuuagcguuuggaaccgcguguggaucgaagagaauccuuggauggaagauaaaacccaugucuccagcuggggagacgugcccuaucugggcaagcgggaggaccaauggugcgggucucucauuggacugacagccagagccaccugggcuuccaacauccagguggccauuaaucagguucggagacugaucggcaacgagaauuaccucgauuacaugacgagcaugaaacgcuucaagaacgaaggggaccccgagggcgcgcugugguga
